United States Patent 7,868,149 (PLANT GENOME SEQUENCE AND USES THEREOF) - sequence listing, part 72

SEQ ID NO: 39305 - DNA, 11110 bp, Oryza sativa
tgtgtgtggttccgtggagtgatcctatcgctttcggagtttcgcattttgcgagttctttttttttcctttttcacaactgcacgtttaggtgatgggttttgctcggtcgaggctgaacatgaacttttgacttagaccaaacggataggaataaaactttttaagtatctatcatatcacatgtttatatactaattataaatatttaatatagactattaataaaatctattcataatcttgaactaattcgtgagacgaatctattgagcctaattaatccatgattagtctatgtgatgctacagtaaatattctctaattataaattaattaggcttaaaaaggttatcttacaaattagctttcatttatgtaattagttttataagtagtctatatttaatactctaaattagtatctaaatacagagactaaagttaagtctctggatccaaacaccaccttacattttggttgtttacttgtttcttttggtaaacatttcaaacatacttcctccatctttaaaaaaaccaacctgaccctcttagtacaacaaatctgatcaggttatttttttaagacggagggtgtatatgtctaatgtttcgatgtatctcccttaataatttagctcatacttcctccgtttcacaatgtaaaactttctagcattgtccatatttatatagatgctaatgaatatatatatataataatgtctaaattcattagcatctatatgaatatggacaatactagaaagtcttacattttgaaacggagggagtagctgttaaacgcatgcttattttatgacataaaaaagtactagaatgaaacaatactttattatccatgatgcaaaataaactataataaaaccccctagttcaactataatctaaaattaagttttaaaattaaactttagttctgactgatctaaccagcagacgatgaggtggtgctcataccttttcaacaatcaagaaatgatttctatgtaagatagttattttgagttagttacttattccttacatcctaaataaattgatttcatatgagatgtaacatatcctatgttcaagtattgcaaacttagaggctgtttagattaatgccattttttaagtaaacttaccaaaaataatatatatgtttaatttgttgctaaatttgataaatatgtaagaaattctgtcaaaattttgacaataccaaaacttgataaggtttattttggctacaatttaaacatacccttattttgaaataaagggacagtttgcacacatggtcatacaagcaaaaggttgtgaagtcaaaagtcaatgtgtttgcctaccatcactatcactcgtccgcagcttttaaagttagaaagttgaccctgcaaataaaaccctagctgactaaacaccgacaagatataattattatattgtttttttttgtcatataatagtactatctctgtcccataaaaaaccaatctaaaataagataagatgtttttttttctagaacaataaatctgtacatacttttgtccaaattcattttccaagaaaacattccatcatatcgtaggttggttttttttggcacggaaggattacttggcaattggcattgttattgtacaacgagcctatcttcttcccatgcattaaaattagctataatacataggcgatatgtgctacagtaccctacggtttccgccgggggaggggggggggcaaggtttacaatgcgagctcatacacaagtatacctcctattgtcatatttgttatgagattcatgcatatggcacatatttttataaagggtcaattacttatttgaccttgttttggacgctaactattaatttgaccctactttttggagtttgcttatttgaccatccttttaaaaaaatgaagctcccatttgaccctgtttccactcatctgttaaagtttgattttttttcaaaaaagaaagaaatgtgattattagtcataatgcccaaagtaccctcggaccctatccatccgatccccatctctgtctctctcgggcttcaggcggcagcatcgggcggtgaggcagcggcgtctagaagctgacccctgccggcgcccgctcgggcttgcggcggcgtgaagccgacccccgccggcgcccgctcgtggaggtagagggcggcggcggcggcgggatccgcgccggcgcccagccgtgaagggaaggagcggtggcggcgggaagtggaggaagggagcacaagattagaacaagattagattagtagaacaagtattgatccgaaggttaaagcacccatcggctggaggtccgatgtcatgaaatccacaagattagattaaacaatgaaacctttgttgccatcggctaaattcaacttatatgtatatgcaatccttatgagccgatgcaacgtccagataactcaccggctgaaaccccgatgaaacccttattggcaatcaataagcagactagagattatggttctaagcacgacttagtagatcaaacttaactgatgcagcactaagtatgaaaagaaacacaatatctagacaatcaagccgttgactgattttcagggtggtagatgcctaggctaatctaatctagcaacgcgatttagccgataccggcaaaaaccctaaagcgagagacagccaatacagctaaattgatatgctaagactagattaacagagacatgataaataggtaggcaaatatatcatccaaaccagagcaatccaagaggtcgaatgtactgatgcagccttgaacgacgccgatgtagatgagacaattgcctggactgacggaacattggacttatcccttcgccggagatcgaagacgatgcagccccacgtcgggtgccaagttccgccggaacgtaaaaaaacaaaagtagaagtaaaaaggatagcgatgcgccgaattgtattgatcgtagcgatagattacatagaccccgggtgtacatatttatacccatggattgatacaagtcattgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaatccgactattggcgactttataactcctatcggctgattccgagatgctgcagccgataatgattctaagtcgatgacgtctttgttgattaccaaatttcactattaacacagcggcagcggcgtgaagcggaggaagggagcggcgacggcggcggcggcgtctgcgggcgctctgagggacggcaacgacgtgaagccgacccccgccagcgcccggccgtgaagggaaagagcggctgcggcgagaaacggaggggagggagcggcggcggatccccagcggctggagcttcacgcgcggtcgggggcagcggcggtggctacctccacccatatgtccttgggttcgagcttggccttcatcagcgccgcgtcgtacgtcctcgggctcgacctcgccgttcatctgcacgctccctgtcctgaaggcgtcttcttcttcatccgccaaaagacagagacgccatggccagcttgaggttcaccgttttttttttttgcttttatctatgtgcttcgattgattgatattattggacacatgtggttcaaactagattccaaggtgtggttgtttatttttaaaaaatcctgtcaaatttaagtcgaatttgtcaaaataattcaaatttgttcaatttatgctaaatctgtcataactgtgtcaaattttgtttaatttttttttgtcaaaattctgtcaatttaagtcaaatttgacaaaatgattcaaatttgttaaatttataacaaatctatcaaacttgtcttcaatgtgaaacttattacaaatatgtcaaagtatttgaatatatacacggtatgacataatagggtcaaacaatcaagatataatggggtcaaataatcaagggcaaaatggactatttacccctaagttaacaccgtgaactcaactaaacggaatagggtcagagaggagcttcgtttttgaaagggagggctaaataagcaaactccaaaaagtagggtcaaattggtagttagagttcaaaatagggtcaaataaacaattgcccctttaatagaacataatattgtattcctcttttcatatattatctgctggattaaatctaaaagtcacaaattattaatggggagtaactatacaccattcaatattttttaaaagcgaacttttaaacataactataatataattgggatgcatataacttataactataatataattgggatgcatataacttatataacttatatgtaacatgtataattttattcgaaacatgggctcaattagatggctaacaccacaagatgatatttctcaggctatgggtttgattcccactctttcgttggtcttgtgatccgacgattataaatttaaaagtcttgggaatttatatttttctgctctgcacaattcttgaagtgatccaacggttataaatttggaagttgcgagagagaaaaaaaactgttgtatatttacaagaaattctgttattaaaaatctgcaaggggaaattaaagcactcaaattcgtatgaacaagtccacatgcaagatgcacgttgaagacctgctatacagattcaatatatccggatcgattcaatcctaagccttattgtaagtgtaacgtgtttacactttacagtttacaagagccgatcggggggcttaacgccttaatccgatcattattccttgccatctgaattaaccaaaccatacacaaaagaatcgaggactccgaatctccgatacccctgttacacacgctactaaaattacctatgtacacccgacgcggcgacgcctgtacgcactaacgcacgtctctacaaaaaagccaagctacatgtacggtgccgtgcacgtgtagcctagtttccacaaacgatcacacgtacctgcatcggaaagaacaccatacggccccgtgccgccgtgcgacgatgcgatcgagaaaaaaatggttatgaaaatgtagtcgacgtagtaaggcgcagcattagcagagcaagtgcactgctggcttaatcagctggtggcgcgaaccatcggggactgcggcgacaggagcgccaatggactggagagatgggctgggctgaggtggtggtggtgcggcaggctgaggcggagctgcctattggcggcccagcgctcggccttgaccctgcgctgctggtgctggcgcacgaagtcgtggatccggccgagcgcgacctccatggtctcgtcgtccatgttggcgtggcagacgcggaaccacccgggctcgcggcagtggaacgacgtgccgggcgacacgttcagcttcacctggtgtacgatcacccgccacagctccagctccgcctcggccgtcttctcccggagcatgcggcgcaggtccatccacgagaacagcccggcgttgccgcgcaggcagccgatcccgacctcgcggaggccagaggtgaaccgctcgtgccgcgccaccagccgacacttgctctcctggaggaagcggccgatgaactcctcgtccgagagcatcctggcgaggaagtactgcgtctgcgacgagacgagcccgaagctggacatcctgcgcgcggccgccacgacggcgtcgttgtacgagtagatgatgccgacgcggaagccggggaggccgaagtccttggagaggctgtacacgacgtggatcaggtccctgttgcaccacggcacgtcgcgctcgatgacctcggcgatgctcacgtactccggcgtggcgaacaccgaccccgcgtagatctcgtcgcagacgaggtggacgcggtgctcggtggcgaaggtggcgagcatggccagcgtgtcgcggtcggtgatggtgccgagcgggttggacgggttggtgatgaggatccccttgacggagatgccctgcctccgtgcgccgtcgtacgccgacacgagggcctccttggtgagcctgaagtcgttgaagctgtggcactcgatcggcagcagctttattcctgacctccagcaacagtcgcggtcgaaactgtcaacggaagcacatgtcgtcaggccttaggcttagctacctcagctatgttacattgtaaacatgcatcagagttaaaattgcattgactacgaccgtgtgcgaacatcgtgcatgcgtttgcttgcatgactagatttagtcatttgacttcaacggcatccataattaggtcgcagtttgattcaatcacgggaaaattaatccatcttttctctccaagccaattttaaaacgtaactcaaatctcggagagaatgttatctgattttcttagttgacactcggatatcttttcctcgtttgacgaactactagatattcagaggaaacagaagacttctacgagcggaagagaacaaattcagtttcagttgtgatagttaaggttgacgggacatacgctgggtagtatggcgtgggcacgaggaaggcctcgccggggttggcgaggcagaaggcgagcgtctcctgggcgccggtggcgccgccgctcatgacgacacggtcggggtcaaacgttgccttgcctcccctcacctgccccataaactgggccatcgcctgcaacatcacaatcacattcagttgttaacaatatgacctcccgaacgctagttgctgcgttgctttcacggtcgcaagcagcagctttgtcatctatctggttctcaatatttttatcgaattttctatgatgttatatagcttgtctaatatgctgatgtgatgtcagcgattgattggccttacctttctgaactccgggaggccgtggtaatcctggaaattggcgatcctcttgaactgcgagacgccctccggtgtgcaaatggatgcctcggggtggttcttgctccattcctcgatcaggtccagagaaagctgtgacatttacagggcaacaaagacggattagcactttgtcgagaacgatccttaattcagaaatgagtatacacaggtctgtgcgcgtacctggttctcggcgagacccatctggatgacacccccgcgattgtgccgcaggtcgaacgggttcgtgtcgtaggccttccacccgtcgaagtacgatgaattctcgccgtggtcatcgcctgcggctttcgtcgagagaaggtcgatgccctggtacgccattgatttggtgtcggactccgaggatatccgaagcccggaccctggctggaacgcgagcagccgagcaggtagctactctacctgcctagccacgcaaggatgatcggacagacccccacaagaaaaaaaaaaggatgatcggacagacaacgagtacgtgcaatatggcacttagctagctcagctagctcgatgattgattgagctggcttgtttgggagataatagaacgaggtggccatcggtatttataaaccatggtaaagttggaggtcagaacaaccagcttgagtttttggcgcatgcatggccgagagaagcttccatgaaagggagactggaggctaggcacgagcgcgacgtggtttggatttttggaacatggaagaacggggcgacctcgtggccgtgatgttggccgcttttaatttccgtttaccaagttacctcgccgcagccgatggctatcctatcctattctctctgtccgtttcaggttacaagttttgactttcaaagtcaaattactttaaatttaactaattttatagaaaaaaatagaaatatttttaacctaagacaaatatattataaaaatttatttaattatagatttaataaaattatattggtgttgtaaatattactgtttttttctacataattagtcaaacttagaatagtttgactttgactaaaatcaaaacgtcttataacttgaaacggagggaatacggtaaagttaacccacttattctaaaactcaacatacagatatgatacatcatcatccactagcaataattacatacaaaacttatgtaagcatgcaacatcatctataatttattgaattatacaaatcaacgtccaataatcttccttcacattatttttcacgatattttaaacatatatatatatatatatccatcatttttataatacttgttaacatatattcatccatataatcaaagtgggatatcatatttcatctacaatctcatagagtctactaaatttatttctctcttaacatagtttgacaaatcagttttatttgttattgataactaatattttttttacttttaactcgattgttaaaaaattattaaaagttagtaattttcgcaataaagcgcggagaatcacctaatattccggaaagagaagaacagagcatcgtatgtggtctgtggttcggtttgggttggaatgcatactactaacgtttaactttcttgttctaaaatgttaaacggtttggctataaagctcgttttcgattagtatgttttcctaatcgttaaacggtgtattttttttaaaaataaatatataagtttctttaaaaattcgaatgaacctatttttaaagtttataataactaatacttaattaaatatttgatcatgagtcatcccgttttgggcggctgagcctgaaagatggaaaatttatcttttttctcaagtgcacgcttcttgaattttaaattttgtgttttttgaaaaaaaatgtatagaagagttgtttaaaaatatattaatctatttttaaatttaaattaattaatacccagataatcatgtgctaatgtgtaagttctcaatctattctatttttctccttccaggacaccctaactctgtttttactgaagccgggcgatggcttaactgagctcggcttggacgcggcagtggacttagagcaagttcaatagtgacttagagcaagttcaatagtatagtccactatagcttcaatttatctatagccgatttaatagccaattcatacaatagttgcttactatactattaacatatggtcccacctgtcatacacacattgcatcttggagtctgtgttacagttggctacagatctgtagcccgttgcttttctctctcatattttatcttactaaaatatgtttatagctggctaatagcccgctattgtacctgctcttaccgggctgcccgagatcgatcccggaagactagttctgccgccggcgcagctacctcaagaaaacgggaggtgggttctactttgcatgagagggaagtagtatgggcgtacaaccacaagtcccaagataccacataggactaaatactaaataatgatgtggaggagagaagaaagatgagagaaatagtcacctctcatgaaggggtaacccctacacaaactttaataaacatgtgagagtgttagaatattgggaattgtgtggtagaggtaatatattatacatgtcaccttttaatttaattatatgtatatgatgcatgaaattagatgtggtggtcacctctattataaaacttgcccttatactaaaagcaagtttaacaatacagccaactatgggctccaaatcagctatagtcaatttaatagtcaattcacacaatagttaccaataaacatgtactacataattaatgtctagtcccacctattatacactcatatcttggagtccgtgctacaactggctagaaatctgtagccgcttatctatcctcttttatcttgttaaaagagtaaaaagcacgggcggtccttaaacttgtagggttgtgccatcggtcccaaatcaatacaatcccttcaggatcctacgcggcgttaatgtggcgtgccacgcggacatgacatggcatcattttgactaataaatgggacccatttaaaaaaaatccttttttatattttttttcttctccttcatctcttttttttcctttcttctcctttatctacccgagcggaagaaaggaaaaaaagaagaatgagaagaaaacgaaaaagaaaaagaaaaaaaagaaaaggacacgtcacatccatgtagcatgacacatcagcgccacgtaggatccttggggcatgtgttgatttgggatctagataatacactttgataagttctgggatctggatctgcattttaaaagtttagggacccagatgacacaaccttataagtttaaggaccaactatacactttactctcgttaaaatatatttatagccaatttatagtctgttattttacctgctctagttgtcatggaattaattaacaccgctagtgcgcggaccgcggataccggatcgatcaaaggatctggctctcgttggcgattgcgtcatgcttaattatggcttaactgaagttagtaactgactctgtgaaacagtactacagcacaccaggtgaaatgcacgccgtagaatcattgatgagcgtcgagcaccccagaatcccggagttcgttatcaactctcaggttgccagtcaacttggcaacccagtttaaagtactagtctttcctaagtctttgggctaccacaataaattcgcatccaatttggccactacagtgcccaacttgcttttccaacgaggggaaataatgatgtgatagaccatcgtgatggtgatctgaccgtgtaaattgatggaaaaaaattgtgataaaaaacccatcaaaatcaacttttaaattgagttttcaaaaatttaggttgcagttgataaagtgaagagcaaacaattgagttacttgaatataagccgctttaggtttaattttttcgtaacaattaataaaagagcgtgaacaactt

SEQ ID NO: 39306 - DNA, 2425 bp, Oryza sativa
  unsure (1)..(2425): unsure at all n locations
tcactaagtaagaaaaacgttaggtgattagcatttattctagatttttactttaacagcattatcatgcaggaatataatggcccttttgaacaaatttagcatcctttgtactactggttgtagtttgaagaataaagagaaaattccttatgtgcctgtgatttttcttaaccccttctgtacatctttgaattttgcctcatccccaaatacctatgggtttttagtttgatctatttgtacccatccagttagttgaccgttggattttttaaaaatttactatattttcctacacaattatatgctacttacttcaaaaacactaatttaaatgtggaaaacttaatttgtaaaaaaaaattatttgaatatgtcattaaaagggacaaatttatttgatgccaaatttgaaaaaagaaaaaaattcaaacaaattttgaaaaaacaaatgattgaatccatacaagaatttcaccgataaattaattcaggcaaaatattctttttatttgggtttaaatgttggtgaaaatgttgtctgcatttaatcaaatttgacacaaaattatttaaaacttttaaatttcagttctaactttatgttcaaatagttctatctccttgtttttttaagtaaagtgcataggtagtccttaaatttgtagggttgtgtcatctagatcttcaaacactcaaaatgtagatttaggtcccataatttgttaaagtgtatcatctaagtcccaaatcgacacaacccctctaggattttacgtggcgttgatgtggcatgccacatggacgtgacatgtctttttctttttttcttcatttcttttgcttttttttcttttcttttttgttttcttctcattcttcttttttttttcctttcttcttctcgggtcacagagaaaggaggagaaagaaaaaaaagaaggaaagaaggaaaaaagaaaaattttaaatgggtcccatttgtcagtcaaaatgatgccatgtcatgttcgtgtggcatgccacatcagcgccacgtaggatcctaaaggggctgtggtgatttgggatctagatgatacactatgacaagttctcggatttggatatgcattttgagagtttaggcaggggcgaagccaggatttatgattagggaggtgtgggcagggcgaacaaatcataagtcagagtaagcaatgccgatgataaaataacatatcatgtgttctgccattaaaaaagcttgaatttagctcttaagttgtatcattggatgtttgacagtttgagacttgagacatagtgagacacaatgggagaacggagagacgtgtgaagccgaagcaatgaagacgaggagttgatttgcgttgtctctccatctctttattattaattaattttctatatcatgtttattgataatgtactaactaacatgctaatgcgctagttagtacagcagggagggggtcggatagggggttgttggccccctccggcgagatctanatgacacatccctacaagttaaaggatagctcatgcaatttactctttttttttctaacaaatgaatcttattttcatgttggtatctgtgttttttcctcaataagcttgcccataagtattagagggacaatttagtcattctgaaaaaagaataaggtcaacttgcagaatggtacagtgaggattaaaacgaaaactcaaaagcatacagggacgagaaaaaaatcagtgacataggattgataaaaactcaagagcacgtaaagttttttctaaacatgacatgacatggcttgttttttttattcttatttggtttgtagataaacgggagtttgttcgtttcgttgataagagtctgtttggtacagctcccagctccatccctcctggagctggagctcagccaaacaatttcagctccatcaaaactaggagtggagttgggtggagctctctcacaaaataaactagagttgtgcagctgggtttaggcagctccataattccactctagacccaactcctgaagctaaatttaaaagttgaaactgtaccaaacatgctatttaggttgtttagcatcgattaagtttgtaggttattcctgatctctctaccttaattatctacaccacgtacgtctcgatcggtacgtggccataagtttccgttcataacgccacgacatacgtacgtacgtacgtactcattactgcagcgctggtagtactgtactgtgtgtttttttgttgtaacttgcaaagtcaaacaagacgaactttgacactacgtacgtactcctgtacaaatacacgagagaagtagagaacaatgtgccgcgcctccctcacgctgtcacgccccaggtcaagcggtagagtacgtagtacacgtacagcta

SEQ ID NO: 39307 - DNA, 6754 bp, Oryza sativa
tccgacggagggaaggccgccgccgccgcttggccgcctcccctcccggatctgacggaggggaggccgccgccgccgcccggccgcctcccgccgccggaggggagccggagggtaggggaggggggagagaatgagggggggagagggttgagaggagaggaggaggagaaggagaagtgagaaagaggaggagaagtgggaaggagaagggataagatagggcggggaggacgaggtgctgctggccggtggcgcatggggatctttactcccggttggtgttaccaaccgggactaaaaatacatcttatgttggtgtaactccaaccgggagtaaagcttatgttgatcttttttcccggttggtaacaccaaccggtactacaaatagatctttagtatcggttggtaacaccaaccggtactaaagatgaaaaagtacccttgatcttttaaactgggactaaagatgtttttagtcccggtttttaatacaaccggaactattatgaaatctggtcgaccgatcaaagatgatttctccaccagtgtctgtaagattgatataacatatatcactctataaatattttggtataacttgttgcagtcgaatttgaacgtgtatatttgttaaagtaacaaattacatattgataaaatctcttttattttagaacggaatgagtaatctatcttgtcttttttttaaaaaaaaatgatcatttaattgacatgcaataaacaggtgaatgtgtataattaaaagtattttgctgacccgtcgcgcataggtgaaaatggttgtgcggtacgtagtcgatggactgatacaaagcacgggtagctcgcgtggcacatgcaaatttgcgcaatggcaagtagacattagactccaaagaagttcgcgctaattggcattattgtacgcatgcgtacggttgtctggtcgatgttttggattggtcggtgggacggtggctgcctcggtgcacggtaggcggtagcacgggtggtgtgcaaacgtggcgtccgaattcgcacttaaacaagttaacgttgaaacaaaaaactctgaaaggctaagctgaaaggcagagagtgggagagacatagcaagttatacggttgtaccgtatacataatgcaggcgcgatatcttttgaggctcgagagacgagtaatacactccggtttaataataattattattgtagataaacaaatgatcttaaaaaataacttggactactattttctattacaatatatataaaaatattagcaaatatataattttattgaagtaccttttaaaactgatttatacatatagtcttcatatccttgataaatattttaaaaattatttatagtataaaagattttaaagtttgatctcaccattcttcaaaactacaatattatcaaccggaagaaaatccaccggccacatatttgttgaagttttagtagtacgtacactgttttgatttgacaagttaaatagtcaatcgtgccttgatcatcaagtttgacacttttcgcactgagctagtgtcccgtgcggccgtgcgttagtggctcactgtacttgcaaggaaaccgtgtacgtgtggctctacattcaccgtggcgcaattgttttcgaggacgtgcgacagcgcgaaaaggtgaaaaaaaaaatgtgtcaaagggaagggctagatggaatattagtttgaaaaggcagtaaggcactgcctatagttcttaaaagaaaataagacaaggcactgccgttcacggatcggacctgtccgggcaaaccctgcagatgtacatcacggcgtttctgccacgtactcattgacaatttacggttaaacacagaatttctcccattattaattagagcactactgtatagtttaactacggatgcggaaacgtgccgccgtgcatatatgtacattgacacattgtctttccgcgtctttttcatgttcaaggaaagaacattgcatgctctcgtgcacagaatcagtccaagttcaataatctagcttattaccatgacgtcccttgtctaaaaaaagtgttcggctgttgcgtgtgtctcactatagctcgacattgcatgttcttctggtaaagctagaagcgatggatcgaggtgaagcgagagatcgactggcgatgacgactgacattacgttattacgtacctacgtggtcagcgattccaatttctgtgtgcaaaaaacgtttttggccggtcagtcatcgcacatgcatggcagcatgtgtgaccgatcgaccagctgtcgcttcatgtttggaacaacgactgtgaccgattgacgacagtcgccatcttctgttcgcaaatggcgatcaacgtttctatgcagaacaacgtgcatgcatgagtttcaatcgatcaacatgtcgtcaaaggctcaagctgttgctacaatgggaacgagacagtattaagtgtaatatagacaacttatatcgggcaactttagtttgctaccacaatttaccttactggtaggataacaaaccaaatgcttcaataatattttgacactatcaaatattaggattgttggtacattatctcgcattgacacaatttaacatcgaaatgtaccaaagcaagatcatcatcagatcttttcgattattgttcaggtctagcgtggaggcgggagagggttgacaaaggggaagttcctttatttagagggaggctaacgcaacaacggtccagtaacggatggtggatattctggggacggcgagacaagaagggcaatgaatagtggtagcagtagggcatttggatcaagtggttagctagcagcgagtaagagcatctccaacagccttccaaattagactctccaaacacacatatagctaactctccatctaatttagctagttagactagtttcttactctaacagactctccatctatactcttcattatgagtacagtgggacctgtatgtcagctaaatatccccttttcttcctcctcttttctcccttttccccgagtcatgcgaggcaatggctaccgcctaccgcggacggcggcagtcgatttgtgcgtgagcgagacgacgacggagccctacttttctcactttctccgccgccgctcgtctctctctctctctctccggcgctccgcgctcgagagcaagcggcgagcgggaggccgcggcgaccggaggtagtgctcgaagctcttcttgcgtgtgcgaaacaatggcgatgggcatgcgaagcgacggcggagccctccctcgccggcccctctaccaccccgtctcccatctcactggcgccgccgctcccttcatgctgtcgccgctcatccattcttctctcctcagctctcgagaacaggcggcgagcggaaggccttcgcggcggcggaaatcggcgctggaggccggtggcaacgagcgggagaccgcggcgacgctcgctgtcatgccgccctgccgccgcgccctcttccctgatttttccccgcgcgtgcgaggcgggcgacgacggtggtgacgaggcgggaagcggcggcggctccccgtgcgcgtgagcggcgacgaggcgggcggtgacggctgcagcggctccacgcgtgcacgaggcgggcgacgacggcggcgacgaggcgggcggcgatggcggcggcggctccccccgcgcgcgagcggcaacgaggcgggcggtgacggcggcggcggctcccgcgcgcgcgagtgggcgacgacggcggcgacgggtcccaagcggcaagcgcgcgaggcgggagccgacggcggcgaatgacgaggaagccccaccgctgccatggtcctctgctatttgggcaaagagagatgggaggagtggtgggacccacggttggccagccaaaatgactctctaagtttggccggtgggtgctgtggtttagctagccatatggcttagccaaccggatagagaggctgttgaagggtattttttttcttcgtatttgccaaaatttagtttggatagccatttggccgttctcttggagatgctctaacaacaacatatgtagtatagtagcaggagtttccagtcgccgagtatattgctagttgggacgcaaaggatgaagcggttgcattggtcactggcacaggaggaagctgtggtggtagttgtagttgcagtgagaagtggacatcatcatcgatatcaagggtgacggcatacagggacgaggcacataaggatgcatcggccggcggtgacaccgaaccaaaatggatgaaaattcagataatcagctaggtagggatctttttagaggaatcgatcaagtagggattagatacagtttagcgttttagcgttctcatcatgtgtgccttttttccacattcagatgcaatgtcatgctgcatatgaaaatggtacggtattcagtagtacaagattatcaactatttctccaaacgaatttattttcacatgtgtgccacactgtgtgctaacttgtgtggggcttgtaggtagcattagaccatcaacctgtcacattagtaaaaaccatttctcaaaccaccaaaagaggattgtattattgtttgcactgatttttcaagacaaggaaggtgttattgttagttgcgatctccggggatcaggaaaccgatccctactccgcctacgcgccctgatcaggggagccagccgttcgtggctgtgggcccctctcacgcaacgcaatactaaatagggggagctgccgggcacgcgaaccaacgttcgccctgtacttggactccccacacaaaccctagtacccaccgatccgggataggcgctgaagtgaggggaagcccgctacagccatcgcccacaccaacaccgtcgtcgtcaccgatgccctcacactgccacaccgtcgccatggctgcatcaagctctaagaccaatgaaggtatgggttcctctctctctttctctaccattcattctctaaggcaaccaccattattccaatgagcaaattacccctagatctgcaccttagggaaacctagaatctaacagttctaccccgttttacggttgagggagacgattcaatcaggagcaagagataagagtgataaagtagactcattcccaaaatgttggctctgcaagggtgttgaggtttgtgatggcccaatactaagttattaacatagtacgctccatttgtttcggcctagcgagaagaaagcctttgcaaaaggctggtaagcggtaaccggtaagcctataaacaggcccaccctagtctgaagtacccattaaaaatgaactgatttatctattcttgatatctttaaccaaccattcttttttttttctcaacactgtacaaactcaaattgcttatataaccatgtacacacttatccttataaatatacacacatatattctttccgtatgagtagcttcaaagaatattatagatatcttaaaatttatgaaataaatacaaacctaccgttcaaataataattaaattgaaaaatcgtgttttataaatactttaattttgcgtaacgttgtatcacactcctcttcttttctttttcttttttccatttccatatttcgatctcaaataataggcgtggtgtagtacatggtgtcattggtcaccacatatatatttctgaaagtgaaaaaggcaaacatatttcggcctcaaaaataaaaactactagaaaaaagtccatttcttcttggtcgctttgttggcgaggccggatcagctccggtcctccggcggccgcaggaaaaggaatggccatgcttgtccgctctccaacttctaccctccccgcagcgaatcaccggcagaaatccggcgtgctcctccggcgtccaacgcgccgctccgctcgccgtttccaactgcacgcggagaagcccgcttcccctggcgcgggcaacgagacgtcctccagctcggagaacgccgtcctcagggccgcctggtacggctccgagctcctcggcatcgccgcctcgttcttccggccgtcgcagccgcctacggagggggacagcgccggagccgtagaagaagcagcgtcggagcctcagggccgcgctcaggtcgccgaggctgtcaaggatgacttcgcgcggtcatatttcgtcacaggtcagcgacggactgtgaaatgcttaaataactcgagtcgtttctgatgaacaatcgatcggtgatgcagcgcgcgattgtttatgtaattttcagagttttgtttatcatttaggcttcaccgtgcacatttctgtgtttgcttcctacttgttgcagggaatctcacgctgaaggcttatgaagaggactgcgagttcgccgaccctgcaggttcgttcaatggcctgcagcgcttcaagagaaactgcacaaacttcggttctctcttggaaaaatctaacatgaagctcaccaaatgggaggatctggaggtaccacgatttaacacatgctatatatctcgttgctgatgcttagggcaaatccactaacccatcttgctgcggctgctgctgaagatgattcatgattctggacttgtggttgcaggacaaatcaattggacactggcgtttcagctgcgtcatgtcgttcccctggaggcctattctgtccggtaagtgcgtgccatttaacatgtccttccttgctttct

SEQ ID NO: 39308 - DNA, 10664 bp, Oryza sativa
  unsure (1)..(10664): unsure at all n locations
aggtgtgcaggtcggtaagtagggggacgaagaaatgcagtcatttttaggagcagagagagagatagagagagagagagagagagagagagagagagagagagaacacacagatgttgcgtcgttgtgcctgacgaactgacggattttactgtcgtccaggcatgtcgagcactggaacgtccccaagatggcactcctgcggcagattttcaggccgagtcgatgggtatgggagaaacgcaccgacgaatgaagcatcggtgttcatcgtgaactaggattatgcatgattatactcaatggtacctggttaggggcattagtagtactagtaccttgcatggaccgcatggtagcctatcaggttaaggctgctcgctcctgttgtacagactacagactacaagcagtaatagatcgaaccataatcattttagttctgggagattaaaccgtattgggacatccttcaattatctgttctaatctaaacaacgccaacagaaggataattagcgatgggatatctggaatcgtttctcggatgagagtctgaactctgaataatctctgtagtttctcttgtgcaatgcaactgcagcatccccgccaggtttcccaaaccgtcagggccgggattaccacgtccctgcggtaagcacggttaccgcgtggtaaccgtgaaaaaccgtacgaaaccatacaaaatttatcaaatatttaaattattctttaaatttatttgaatttaaagaggttaccgtgggttttttattactgtaccccgtggtaagactggtaaccgacgtaatgtaaactctgatcctcgcaatccaggaatcggaatcctcgaaatcaattgaaaactctgatccccgcaatccaggaatcggaatcctcgaaatcaaatggactgtaatgtgtaacgtgccaggattacacatagacccccttcgactgtgtggttccagaaccttcctagcctcgacgggaacgtactgtgtcgcgccttaaacaggcccggcccatataagcagttgggccttctagggtttcttatgtcgcacgactttataagtaggtgtggtgcctgctaggacggccgcaatctttcttccacggcagccgcctcttctggtgatctttttctcgcttctcctgactccctgcgttctcaattctttcgatttgctgcccttgctttgatgttcttgttcgcatagccttctctctcgtggtatttctgaagttcttcggatgaatccgcggttagttagtttgtttgtgttttctgaagcaacagttttgctggtcaaatgatgagagatataactgcaacaatatgatccatgatgtgattcttagtatttaagtctctgatgaccacttcgctgtttctaatggctgtactagtctactttttttttcaaaaaaaactttttgttaaaccggtcctttgtaggaagtgatgaagaaaaggttggtccgtgtttctgatttgtcagtgactgataaccatctctctttgcttctgatcctacggacaaatgacattcttttgttattattccttaaaatctttaaatccccttatgcatttgttctcttgcactttgcctatgttgttgcgaggatgaattatgaacaaacttcgcatgtcagacttcggagatgcttcaaagcatccatgagaagacatgtcatacgactgagcaatgctggcaccatctgttaatctctagctagataagttttcagactatgacaactcactgttagcggccggagaacggagtccttagaccttaatctgaataaaattaaatatttttcagtactatgaatatggacagtaatattttgggatggagatagtattagctttcaatatgcacttttttcaaacagaaaaaaagttgaaagaaaaagaaaaggtaaggtaatcgtcgctcttccgttgtaatcggatcgtaatgtgctgagtaggacagagcaagtgcagcatcgccatcaccagcctaatgaagtaatggtaataggagtgagcaacaaaaaatcagaacgggcgatcgtaagaagattcctcgcaagctgatatcccgcaacaaaagcactgattaatcagaacggcgattgagacgtgcaatgctactgtgatacactggtactggacgttgacgcttctgcgtgtgtaggatgaaaaataatgagatattcccacgcttaaaatggcaaacaatttttttgaaggaagggaacaaaacaattttgggcttgaacaatcacagccattcgctctattaaactgttcaagacttcaagcacagttaagttccgtctggggcgccatatcactgtgcagcatgacccacttaccaactgagaaaaactgcaggatgtcactgtcaactgtctgtgaactgtgacaaatgggtttcttcttgtgtatcgagtgtttaacagcggattgtgcgttgcttttccgaacgtaggatcagcgttggagggacgtgattggggagttggcaaactgtcgtgctcttgcatcccaaaaggagataacgtccagctcatgcttttcacagcttcttaatcattatatcgtgtgattagttgatttgtgcgctatcaataagctgtccgaagatgcaccacgctcgcatcaagctccatataaatagctgacaccagtacatcaagtcattgctacagatcacactcgctcagatcaacaaacgcagatagagagcgccgagaggaagaagatgagtagagcctgtagaggagagagcagtggcggtggccggagctctctgggctacctcttcgagccggagccggaggatatcattccggatcactcgactaaatccgttcaaggaaccaacaaggccccaaaaggcaatattgttcttggggacaagatggccagcgacgaagcagatcaagaacaccaaggctggctttggcctcccctccttgnaaaggaaaaaaggaaaaggaacctttcnccaaacccccccaaattaaggttatttccttttaagccncccggaaattccctttggggcccttttttcccaacacatctaccatactaaccaagtaggcaataactctggccttcttatcacggtgagtatatatcagagagtatatatacctcttgcttgtagactctagaaatggattatggtatgcataagcataacctgagctatttgtattgagtttgccccactttttttttgaaggaccggccgtccacgagagtccgttgtgcgcctggagggccatcgtcgcttggatttctgtttggtgatgaggatgcctaacgtgcaagtgcaactctacaagaccatagcagtgttgttatgactgtacacctatcctttgcatccatggggtggagcaagatttggcccaagtcttggagacttggaccggggtatgtcttgggttgtgcctctgtatcttcagatatttacgtttattcccaacaatacttgtgctccatgtcctggttttagggatctagtttaatttatgtacgtacgtgtgtggcaaaggtctccgccgtatggtgtgaggatgcgtgctaattgctttatcgtgtgtgtgcatgtttctgtatctttgtttcggcctgttatttgttgcatggctatttgacattattgttgtaaattgttgccatcgagggcataagttgtatttatatatgtgactagtaatttatgtttggatgatcttctgtatggtgaaattatggaccacatgtgttggtgtgttttccggataatatggattcgcctaaagattatggtgctctccactgttggtagaaaacaatttaaaccgttaatcttatttgatcgaacgatttatatctatatatactaccaccctaattagcgggagtagaacatggtttagaatgtgtggaggggtataatcgtcatttagtaggaactgaacttttttcttctttttttggctttttggatggaacagagctatgtcagtgaaatggataaccacctatcaatctagccaggaaaaaacataaataacaaaatgaccctaatcactgtagtagccaatcgctcaaagatttatggtgttcatgtataaagtaaccaatcgccttaatcttgagaattatcgatcaagatgataagaatatcataaccgactagcggaaccgatttatatatcaaaactagcctcctctataacaatttagattgattttggggtaagcacgtatttcatatgggtaaatcggaaggtttacgggacaaatctacagaggatatcgactttcgtaacaaatacaaacaatttacaacaaaaactataaaaaattatgggcgcatggccatatcgaggaaaacttacgaaaattgagacctaaacatggggagtctaggacttgggcaaccaacgatgtcttggcgttggcaagatgaccagacgagtaggcaacatcatgaggaactcgggagtcttggacttggggggtggcgcgagatgccttggcgaggcaaacaggaggtgccaatgttggtgtctcgcttgctctcgtggcaggcacagtccataggtggagcgattggacagtagaataggcgcatgcaaacgaccaaccgacacaacactatgatagttgagctagtgagctcatctccactgggtccccccaaatttctaaggcgggggtgagggggctatatgatcaaggagattgcacgcgctcatcatggttggatggacaaactaggcaaaaggttgagaaaaaaatatggctaaaaagtagaagatcggtttattgtcgagggttagggtggttattcaattgaatcgaccacaaccattttagggggcggggggatttttatataagcagctcgttcttcatttcctataagctttgggcctaaacaagaaaacatgataactgttttaattggactcgaacgaagttctcccatcgtttagaccgacctccgaggaaaagcccttatctcttccagatttgatctaaatttgtttaaaattcaaattcatgctaaacatggttgtcaacaatgtcaatggtcttgttcaaatgctatattaaaatgggccgcccaaacactccacaaccaagaacgcacggcccatcaacccaactttcatggcgccatggccgctcgctgctgcagcagcgcccatccactcgtttcatcgacgaccgtatcccgccgacgtggacacctgttgttgttgcctaccagtggtcaatttcccaaactcaggtgagccccccaattaacgatcgttgcgtaggagtacaacataagcgcctatgccgtccgaagccaagacgcagacttgcagaggccagagggaatgaaaggatcaccatcaacgagcgactcttcctcctgcaatctgcaccatcaagattgcctctgttcagcgttttttctcacgctttttcttcgtcttttcgtgcgcacttttctgacttattttcttttccgtggcggcgaggcctcacgaacgcgatgagatgctcgatcggtagacaggagggagggcaggcgggggaggcgacagcgtgttcctgcccttcgccgcacaacgcccacaggcgccgtaactgtacacggtatggacatggcacgctcgatccttgtaatttgtactctactaccgtgtggcgttggactgttctcgctgtcaggtgtcaggcccgaccgcccaactttgagaggacctactccccactcgtagtatttgtaccgtttcataaggctatttacaatgctcataggtgacgttcagcctcaaccatctacgtcgaaaattcggcgcatgtacatatctgccattcccaactgaagatcacggagcctaaacgaagcaacccgttcttcgtcagaactggcaagcgtggggcaagacgcggggcgcattgagagggggcatggccctgtgcaacgccaccatactcgtgcaacggtcacggcggcagcacagggagaagaaggaaagatggcaactgcggtggcctagggcggagaagggaagatgccggcggcggaggaagagaaggcggcggatctagcacctaacctcatcgtcgtcaccgttccgccccgcctctgaacgcaatagtgacagatcgacggagagggccgccccgaaccctgcaagcgcaccgccgagctccccccgcgccatccgccaatcgaaggaggaggagaggtggagccccgccgccgccgtcgccgcttggactgcacctctgccgctcgggccgccaatcagaggaggagaaggagaggcggcgccgcgcttgggccgcgccgccgccgagctccgttgcgccgttcgtcgcgggcgtgccacggagctccccccgcgccatccaccagtcaaagcaggaggagaggtggagccctgccggcgctgttgccgcttggattgtgccggtgccactcaggccgccgattgaagaaggaggagaggtggcgccgctcttgggccacgccgccaccgcttgggccgtgcctccgccgctctgctcggctccgtcggcaggagacacttggtgccgccactcgctttctctccgctaggcaaaattgctgagagaggagagagatggagaggaaaaatgaaggagagatagagacgggacccaccgaaaataatctgcattgtggagcatgtgacatatatagttcttaatccacgtgacttgtgaggttcggtaaaaattggtggcacattgctattgccctaagaaatatttgcccttgcagccgttggatccaaatcgaccggcaaccagggccccatcgccttctcgctgacatgaacgtctgtgagccaacgagaaatcacagtcgaatttccccgcttcgtcgtccccagatgcacacgcgttccacggtaagccaccgggcgactcgacgactcgacgtctctttaagtagtagtactacgaccgagccgcggggtctctcgattacactcccccgtcacactctcccgctccatccctgtccacgaaagcgcgcgcgggtaagatacgaggccgggagggaagaacgaccacggcatggccaccggtctctccggcggcgctatgaccagcttcgccgtcaagaagccgctcctcgcggccgccgtgcgccgccggtcgtggcccccgccgtcgggccgcgcgctgccgttctcgccgctcacgcggaccccgcgcagccgcgggctcgggaccgtcacgtgcttcgtgccgcagggcacggagagccagcaggccccggctccgtccccgccgccgacggtgcccgtgcccgtgccctcgctggaggaagaggcggctgccgcggcggcgcggcgcatcgcggagaggaaggcgcggaagctgtcggagaggcggacgtacctggttgcggccgtcatgtccagcctcggcttcacgtccatggccgtcgccgccgtgtactaccgcttccattggcaactggaggtacatctcctcttcgcttctacttccattatagtatgcggagaagtcatcgccgtaatttttgccggacaagatgtcccagtaatttaagtgtgcaaatggttgttgaccgtggttgatatctgtgcggccgtgcagggcggggatgtgccgatgaccgagatgtttggcacgtttgcgctctccgtcggcgcagcggtaagcggccgtgacaccgcaaaatccctgtttgctcgctgataacgtccttgggatgtcaaaattttgcttaattttgacgctcgctggggggttgcaggttgggatggagttctgggcgcagtgggcgcaccgctcgctgtggcacgcctccctgtggcacatgcacgagtcgcaccaccgtgcgcgcgagggcccgttcgagctcaacgacgtgttcgccatcaccaacgccgtgccggccatctccctcctcgcctacggcttcttccaccggggcatcgtccccggcctctgcttcggcgcggtaagcccagcgccctgcagggagcacgtaacgctctctctggtcggccgggcccacctgtcagagccatccaattgggatctgacctgccacgtgtccgtttcttacagggcctcgggattacgctgttcggcatggcctacatgttcgtccacgacggcctggtccaccgccgcttccccgtcggccccatcgcgaatgtgccctacttccggcgagtggccgcggcccacaaggtacgagaccaccagctgctcactgacgtttactgcaccactactactagtccacgctgctactactactactggctagagagtgtacttttgctgattttctttgtgtggccacgagcagatacaccacacggacaagttcgagggcgtaccgtatgggctgtttcttggacccaaggtgcgtgactggtgcctatgcatttgtcgtctatatgtgcttgtgaccagtacatgacaaagcaatcctggtttccttgtaccgtcttctcgatctcaacgtgtgtgtggtcgtgcgtgcaggagctggaggaggttggtggtctggaagagctggagaaggagcttgcgagaatcaaccggagcttgtgattttgacggcggcaattgcagctagcaagactgcgcctgtcgagctagcagaattgcctttgccttgcaagattttttgtatttctggccgcttcgtcgactccattaattgtcggtaccggagagaaggggactccagaagcggaagcgcttcgagtatacgacgatgtggcagcggtgaagagcacagtatatttgtttgattgtggcctgtggcatgcatgcgtctctgcggctgaacattgtaaggaggatgttctgtgggatggttattctttgaatttcactgcgccaacgtttttggtggagacgttgtgcgtccagtcccctgtcttgtaagaagcaccacattactgtgtataacacatgttagagattgttaaccacttcaatgaaactaaaataggtggttggcaacaatgctgaaatttcaggactttcacatctgtcttgttcagtggtgcgccgcatatgcgaatgattgtccacattgctcccggtcattctacgcgactccatctttattcgtagagggtatgtagtgcatgccatacggcccatactggtattacgtgacaattcacaattttcttattgtctactactctttcataaaagataaactctagttactaatctagatacgcatgtatctaagatttatagttaggattgaacatttttttttaaaacggattgaggtaaaaaagaaaaactcaccatgtgagctcgtttttcgtgtgtgctactagcagcatgatctcggggtcagataaggaaatcacaaaatctggtcattgattagacagccatggagactgggaggtaaaaaaaatataaacaaactaaattgatcacaacagaagtatatatggtcaacaatatcaaaatattccttgttcttgaaaagagagttacatgtatcttgtatttgtgaaatcaaaatgcgttttgattattattctgtgacgaacgattgacatctatgattattgattttgatatttggagattattggtgaagtggttttggagatgattgagttttcaggtgatgaacagggttactgttttgtcaggaccggattctgtgtcggtttcggtttcgggttgtttgtttggatatccgttattgtttcatgtttatggcttctagatggatactatgcgtatgtaatattgttgtttgctaccaatgagttaagttggagatagcttggcctcggaatatggtttctttgtttgattcatgtgtaggtgacttgatgtctcgggaaagtattgccggtgatggattgggagtcaacttggggaaaaggcgatgtccgtgacggtcagatatcatgcaggatacttaggctagagttcaatgcacgtggttggtgaatattccatatggcatacgatggaggtattgtgtgcgtatgggatgcggagtcgaatttggaaggagtccaaatttgatatgattggagtttgtaaagtttgtttcttgtacgggaaggtttcctaggtggattaggacttcatgtataaataaagaggaagcgtgaggcttatcggtatcatttttgagagcaattgagttgtaagtttaattagggtttcgagtttagtcgagattttcgtgaggagtgctgttgttgcactttataaacacagagagaagtaataaagttatcatctactttgagagttcttcgatttatgtttgctcggattcggcggtctaaccggcaagacaccggcggtcagactggcggcatacctgcggtcagaccggtgacgacgacaggaggcataggcgatcttcaggcggttggactgggcgatcaactccagttagaccgatggtattagctcggtcagaccggcagatcaattttggtcagaccgcgatccgtcgaatttgagggtaacttttaattccgcaaaaagtttaggttttggggtatacgaaccattcaccccctctctggttggcctagttcttatgtttttttgatcctactgtattgcgaggggg

SEQ ID NO: 39309 - DNA, 2624 bp, Oryza sativa
cccatcttccttggccaatcccgcgatggctcgtgcttcttgtctccagccagtcggatccaccagcaaagaagttagggccactggatccgacgatcctgtctttctcgctaatagatgtgatggcatctggttgagggagcatgacgacactcagtagcagcggcaagggggtggtggcaaccagcgggcgaccccggctagaacaggatgtaggggaggagacggggtggagggaagagatggccgggagaaaataaattgatcaatatattaatataggaagggtgtagctatatttatggcaccatatttttcaccaaaaaatagtcggtatgtatttacattgtaaatccttaaattacatatgtaattttagtatatttataatataagtctcaaaattacatatgtacgtcctaaaattacatatgtaaattcaaaaattacatattaattaatatgtaggtagggtgtaagtgtggtataagtgaggtgtaatttctgtgtaagtggcttaaaaaaatcgattatagcatgtgtctacataattttagctaacctgatccggggtcgtgcttgattcatatcatgtaaactatcacggcacgaatctttgtggggatcgagtgatccagaaatcgcctgtaatgaagcaaaaaatgtggcgacagtagtttagcaaatccgtataggaaatacttattttaaaataatttgtataaaaacataattttatttttagaaacatatgttatatattagacctaactcgactttgaaaaagtctagcactatatatactaaattacacgggtaaatcttctattacctccaatcccccattcagcaaattaaaggatgtcgttttagcccgtattgcacataccaatgcaagtgttaaatgcagcaaaatggcctctttgcgcctttaggcatcattaattctagctccaatcaccctgttcggcactgcatgcaaaatatattttcgcgggttgctacgcagagccatgagcttaattaagcgccaactggatttgtttaggggcaacatgagaaaattttgcctacaaaacataaaatgacatctatttgagaaaaacaaaatgctaaaacgacatctatttgggagtagaggtaattttcgggctagtttggtttggttctaaaatgtgccctaccaattcactgtcaattttcaatagtatttcttgtcgtttaggttggtgccaaattttaacaacacatcttttagatagtaaaaattttacccatctaaatttggtagtgtcaaaagttgcccaaactttggcactaccaagattttggtatggaagcaaaccaaattggcccttcgtacagatagctcaacctgtcatccatcgaaaaaattgctcgacactaacgactctcatgctcttgttattctactaagacagttttaaattattgctcatcccgacctcaaaattcttttctttaatgaagtccgacactccgatcgacctcaaattcttaaagcaatccaaccaaagatttgttgagtgtttcatttagctttcatcctttacctgcctttgacaaagcctctgcagacttagcgggcgacacgcacgcataagagcactgataagtcggtcgaacgctcttctcgcgcgcacagtattttatcctctggctcatgtgcttgcgccactgcctacgtcaaatgcaccagctgatgaatcgcgtgcgctgatgcacaaacccagcacgatgacacctcgctgcaagcaaaaaacttatactaacaaagcagcagcagcacgcgctgcattattacttgtatattaaacgaaagttagttcctcttagatttgggaaaacccggatgctgtgcggcgttcatcagcgaaccaaatgatagaggcttaatcttctaggctacagctttcaaatggccacgtcactttcttccacgattgctccggggaatcaagccttctcacgtacagtggaattttaattttctgaaactcccatcaaaatcgtagcgcggatcaaagaaaaacgcagtgtgatagtggcaaaatcgcggtggtgatagaggaacagcccaatgccaatccgagatcagtaggctggaggcccatacaaatatagcccaataccaatcgctgtggtaattgtcctgggccgaccacggctatactggagcccatgtgctcaggtaaggccatgacgcttctagcatattcttccggaaatttctggagatctcgaccatctcccacaagccgaacgcaatctgctcgttcgttcctcgcttctgggactacggaactcggaattgaggcatcctgcgcaacttgatacaagtttcaatcaagagattcaaggtacggtttcgtttctgtttctctcccgcgatttgccctgcaatcctgctttccttgtgtcaaaggtacagaatttctcacatcgatcgtagcagatgtgtgttttcctaccggaactcgttacctccagtctccgctattctttgatcgcttgtttctgggcgcctcgttttgaggcaacaaggtggaatatgactttgagtgtgggtacaccttagagatcaggaatctgacgcgtaggaa

SEQ ID NO: 39310 - DNA, 8509 bp, Oryza sativa
ccctccagtttgctttgagattcagtaccgaagttcagtgtcttttgtcctttttctgctatgtaatactgtcgagcagggttgatgacaattactactcctcagaagcatggcaaggaaaataattccaatgattcagtgctcacagaggatgaaaacatcgagccacttgttgcttttagcaggccacctcctttgccaccagttcttggccccttgatcatgctctcacttttcaatatgtcaagcggcggggatgaaaacaaaaattaagccggtatgccacccatatgcattgcatatgttttgctctttactttgtgtcacgatgccatgctcataatattcagtgttttttttcaggaatctgaatgaaatatgtggtttatctccgaccgcataccgtctccagaggtgttgtacatactaagttgtagcaatcaactactagaaaaacatgatgtagcataagctatgcactgtttactgctgtagacttgtatggaccaagtaagctgctgtcaaaactctgttgctaatgtttcagtagcgaattgacaactttccaggctgctgaaatttgttcagttgtgctgatgtttcaattgctttattttctgtgttagctgttcactttatgattcgagcccttcttcaaaacttttcaattgagccaaataatctatcttttatattattaaaacagccttgaaagaagacatcacgttcgctgtgggggctagaaattcttacattaattggagaaaaggaaaagaagagtctaactagaaatgcaatttaaaaatagctgaaattcggaattaaaaataaacaatattgaaagaagagttcatgtaagaactaaatacgagattaattaaaatttagaataaaaataaaataaaatacggaattaaaaaagttcttacatacgagattaatttaaatttagaataaaaataaaataaaatacggaattaaaaaagaaaaggagagttaagtaggaataaaatttaaaaaatagctaaaattcgtaattaaaaataaggaatattgaaagaaaaatccatataagaatacaatacgagattaattaatatttggaataaaaataaaaataaaatccgaaattagcaaaaatagaaaaataaaagaatagttcaattaggaatacagtttaaaattaactgaaatttggaataaaaaataagtaatattgaaagaaaaatccatataagaacccaatacgagattaattaaaatttaaaataaaaaataaaataatatccaaaattataacaataaaaacgatttcaagtaggaatacaattttgaaactattgaaattgaaaataaaaataaaaatattaaaacaacacaatacgatactaattaaaatttgaaaaaaaataaattcataaattagaaaaaggaaaaaagattttaattaggaatacaatttataaataactaaaaatgatgataaaaaataaagaatattgaaagaaaagaccatctagaacacatgatgagataaattaagtaacgggcctataaaggagtagagtggtggcggttgatatgacatataaaaattgttaataaaacaccaaatgggatcctaataatgattaaaaggagggacaacaagcaggctgtgaagcaaacgggcaagacggttgccgggacttctagaaagtaaaaaaaacaaatcccattgataaatcatatttgatttttaaaatctcaataacaataaaaagaagaaacatgggatgggggtgtataggagtatagttgcagagccgccgccggttggcgggacttctataaaataaaaaaaataaattctaacgatcgttatgttcgatttttagaatcccaatgacaataaagagtagacggcgaacgggctgtagaggagcataatggcatcatttgatgggacttctaaaaattataaaaaataaaacccaataagacaataaactctgaaaactacaaggtctaatttttaaaaggtttggaacttctaaaaagtacaaataaaaaacccaatgataatcatgtttgattttaaaatctcaccgacaataaagaagagaggcaacgggtgagccatagaagagtacaatggcaacgccgctgacggtttggcgggatttataaaaagtaaaaaatgaatccgaacaataattatgttcgatttttaaaatcccaatgacaataaagagaagagatagtggaggggccgtagaggagtataatggcagcgtttaatgggacttctagaaattataaaaatgaaacccagcgagataataaactctacaaactataagatccaatttttaaagatttaaaggagaatgaatagaaatagtggtaaatcgagcaagaaaataaaggagatgacagaaataaatggtatttgacttttaaaagctatataattagaagcacggagatagctatataattagatgacagaaggtttggtcttttaaagttttaagacaacaagattgctacttaataaattttaagtaaaatcatactaaatatatatgattttatctgggtgctagccatgcaattacgtgggccacccaagctatataatagcccacaagaattgaagatctagaaagaggtcggaaaagcagaaacaacaacagaatagagcgctgggtgacaagtgttaggcaattttttttttcttataatggaatttattccggcctgtgcaagcgacggccaattaattacaaaggtttcttgtcgaagcaaattaattacgaagattgctagtcgaaaactgcgacttataaaattacaacttaattctaaaaagaaataattcaaacatcaacccaaaacggggaaaacactattggcagcacaccagcagaaatgaggctccaatttgtcttttctgaaagaacaatgtccattttctggagtgccaagctgctttgaaatgccttgttggctgttggttttttcaccgagtgaagcttatggacgcgaaatggagattgctcgccgacccagacgagcagattgtcgcgacgtcctcgagcagctccggcggaccgctcgccatcatgcggacgttcgtgccaccgatctccagcaatgtggagattatagataccccatatctacatgacagttataatttagtcggatatacggtaccaaatatagatagaatatctttatgaggactcgggttagtttctaacttgtatgtgaaggaaatacccgagatcttagtcggttacgattgtattttatctgtgattccatattctgttaagatatggactactgtactttgtaaagcggactccttcccctatataaggagggtccgtgtgcctctcggggcacggtactttttttccagtttatacaatcaataacacactcggcggaatcatccccggacaggagtagggtattacttcttgaataagaaggcctgaacctgtataaaattccttgtctccaaacccatccactttccaagcttgatagccacccccttttattattgccgaaatcttgtttcgacagttggcgcgccaggtaggggtagcgtcaagtttatgccgactaagtgcgatgggttccgtctccggcatcgacgacgtcaccttccctcccgggcaggcgttccggttcggcagcctcaacttcatcaccaacgacttcggcaagatctctctccttgactcggattcgaaccagtcggggagagaccaggtccccgcgccgttcggtattccgaactcggccgaggcctattctaagatcatctctcccgagtcggcttcaaaccactcggacgagatccaatctactcctccacgaccagatgaagacggcgggtcctatccctcaatcctgatgaaacttcctgatgatttggccactgtcttcacaaccaagacatctcccactcgaagatctaggcaagctccggcttcggccccgatccaatctagatccagggaggttggtgttatactccaacctcttgggacagtctcgacggaagagttggatggctacctcaactcccccggcgtcagttctcgaccaaccgagatcctcgactacgacgacttcggctaccactacgaccaaggcgacctcgacaacttcgacgacagctatgaggataactacacgcccctcttcttcggcgtattcatggatgacaacgaaacggaggaacagcgccgagcccgagaagcggaccaagatcgcgcacggcaagaagctgaatgtcgcagactggaggaagagtgacagcgacaggaacgagaacgactacagcgtgagcaacaagatcgcgaacggattgcaaaggaggctgaagatcgacggcaacgtgccttggaatctgggcggcgaccgagagagctcattgggcaacaagacgtcgatggaacaacggtctttcgcaccccccagcagaacgcgattgcagcaatcactctcctcgacaccctcctcaaggaagacgcactcaaccaaactgatcatgttgtcaacatcttgaaccagacgaagaccatgatcgctgcctcggttccagccaactccgcaagcacccgcaccccgactggtagccgagtccctcatcttcgatctcaagactatcaccagccaagcctcagcattgccggcgtcggatctagtcgcaggagcaggggacatgatgaacggtctgttcgttcgcctcccgaacgatataggaagcgtcgagttgaacgaccacactccccacatcgaaggcgccccatcgatcttcgcgacaccatcaaccagcgccgcgcagcaagaggccatcattcaccagatcgctacgacgacgatgtggacggagttgctgccttcacaagcgatctgcgtcgagtggattggccaaccggctttaagccgactagaatcgagaaatatgacggcaccaccaaccctgagtcttggctcaccgtctatagtctcgcaatccacgcagcaggaggagacagcaaagccatggcgaattatctacctgtggccctagcggattctgcccggtcatggctccacgggctaccccgcggcacgatcggatcatgggcagagctacacgaccacttcatcgccaacttccaaggcacttttgaacggcctggtacacacttcgatctctacaacatcattcagaagtctggagagtctcttcgagattacattcgacgcttctctgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagtctatgagtatgccaaagccgaagatgctatcacggcgttcaagcagtcgggcatcacttggaagccaaagaaggatacgccgaccgcaggagggagtggaagtaacaaccacaaggatcgcaagcgtaagcccgaagaacttgtggcaacgacctctccgtcttcccgacaacgttcccgcgtcaacaccttcgacaagataatgaactcccaatgtccgcatcatcccaactccaaccacgtggccaaagattgcttcgtctacaaacagtttgcggagcaatacgtcaagaacgcacgtaagccctcagacggagatcaaggcacatcaaagaagaaagatgatgaagacgatgccccgactggttttcaagatcatcgcaaagaactcaatcacatcttcggcggacccctgacttatgaatctaagagaaagcagaagctaacaaaacgggagatcaatgcggttcagcctaacacgccccaataccttcggtggtcagagatagcaattaagttcgaccgctcggatcatcccgaccgagtggtccacccggggcggtaccccctggtactagacctagtggttcgcaatgtcaagctccgacggactctcatcgatggtggcagtgcactcaacatccttttcgctaagaccctggacgatatgcagattcctcgcacggaattaaagccgagtaatgcacccttccacggtgttatcccaggattgtcagctacaccactcggccagatcactattccagttaccttcggcactcgggagaattttcgcacagaaaacatttgtttcgaagttgctgatttcgagacagcataccatgctatactcggacgaccggctctagccaaattcatggccgtcccacactacacttacatgatgatgaagatgcctggtccttgaggggtcatatcactacggagcgacatcaagcaagccgtcacatgtgacaaagaaagttgcgagatggcccaaacccacgagatcactctcgctcgcgaagagatccgactggctgccaccacggcaagcaaaggagaggtgcctacgaccaagctgtcaaagaccgaagaaggcgacaacaaaactaagaagatttcactagatccctccgatcctaccaaaactgctgtaataggcgccgagttagattgtaaataggaaagcgcgctcatcacctttcttcaaaataacaaagatatctttgcatggaaaccatccgatatgccgggtattcctagagaggtgattgagcactctttacatgttaaggaagacgccaaacccatcaagcaacgactccgccgttttgcacaagacatgaaggatgcgatcaaggaggaattaaccaagctgttagcagcgggcttcatcaaggaggtccttcatcccgactggctggctaacctagtcctggttcggaaaaagacggggcaatggcgcatgtgtgtcgattacaccgacctcaacaagtcttgccctaaaaacccttttgggttacctcgcattgaccaggtggttgactcaacagccggctgcgagttactcaatttcttggattgctactcgggatatcatcagatccgactaagagaatccgactgcttgaagacctcgtttattacgccctttggggcctactgctacatcaccatgccctttggattgaagaacgcaggagcaacctatcaacgcatgattcaaagatgtttttcaactcagatcggtcgcaacgttgaagcttatgttgatgatgtagtcgtcaagaccaagcagaaggatgacctgatcgtggatttagaagaaacttttgcaagcattcgtgctttcaggatgaaactaaaccctgaaaagtgcatcttcggagtaccgtcagggaagttgcttggatttatggtatctcaaagaggcatacaggccaacccggagaaaatcaacgccatcctcaacatgaaaccgccaagcacccaaaaagacgtccaaaagctgactggttgcatggcggcgcttagccggttcgtctcacgactcggcgagcgggggatgcccttttttaagttgctgaagaagactgacaatttccagtggggacccgaagcacaaaaagcctttgaagacttcaagaaacttattaccactccaccagttttggcctcgccacatccgcaagagccgctactgttatatgtgtcggcaacctcccaggttgtgagcacagtcctggttgtcgagcgtgaaaaggaaggccatgttcaaaaagtccaacgaccaatttatttcgttagcgaggttttagccgactccaaggcaagatatcctcaggttcaaaagttattatatggtgtcttaattaccgtcagaaaattatctcactactttcaaagtcacttggtcacggtggtcacatcgttttcactcggggatatacttcataaccgcgaagcaaatggatggattgcgaagtgggccctagaattgatgtctttggatatatcgttcaagctacgaatttcgatcaagtcacaagctttagctgatttccttgccgagtggaccgagtgccaagaagacatgccagaggaaaagatggaatattggactatgcattttgatgggtcgaagaggcttacaggcactggagctggggttattttaatttccccgactggggaaagattgagctacgtattgtggatatatttttctgcgtcccataatgtggcggaatacgaggcgctactccatggattaaggattgccatctctctaggcattcgccgattaatcgtctgtggagactctcagttggttgttaatcaagtcatgaaagagtggtcctgtttagatgataatatgaccgcttatcgacaagaggtacgcaagttggaagataaattcgatggacttgagctcacccatgtcctccgacataacaatgaggtagccgacagactggccaattttggttcaaaacgggaggcagccccttctgatatgttcgtcgaacatctttatgaaccactgtacccagaaaagcacaattgaagccctggatactcaaggcgtaagcatgatcgaaacc

SEQ ID NO: 39311 - DNA, 2660 bp, Oryza sativa
attcctgcagccccgttatgaagagggccgagtagacgacatcaattgactagaagaagcccgtgaagcagctttaattcagtcgactcggtatttgcaagtgttgcgccgttatcataatcggaatgttcgatcgcgagcctttttagtcggcgacctagttctgaggaaaattcaagccacacaggatcggcataaattatctcccttatgggaaggaccgttcataattgtcgatgtcactcggccaggttcttatcaactcaagcgcgaagatggtactctcatcaacaattcttggaatattgaacaccttcgtcgattttattcttaggtatttcgtttgtatctttcctctttgactgctaacttcaagtttttccttgaagtttttcagtcggggggctactatgataataatggagtgtaatttttatcaattcaatttgcttacttgatttatcattgccctgtttggtctttcgactaagtcaatgaggactgaaggtttttaatagcttttgcgggttttaggctcaataaggcttgacaaaggcttttaagaaatcagaagctaagtatggaacaccaagcatagcataaattcgtcagtattgtacaaattgagcctccatcatcattaatcatcaaaatcattgttatatcaatcagtatcagttttttcatcatcagaattatcagacccagtcggccgaaggtcgacatcttggaatctctcaaccacgtcagcaacaatcttgtcagcggctttttgcgcatcattgatgaggtcaagagcagcttcttcgctcgtcccgtctgcaaagccatcaatggcatcaatgtcaactcttggataaagggatttggtcatcgccaacaccagacttgctcccatacttccagcttctttgatgttcttgaagtaagtatccggagcgactctcagcttgtcgaagatttcggcagcatcaagtgtacttggaccggcgttattgaagaacatggcttggatgagtggagtagcggcattagcgactttgtccctggccccttcaagcctattgatcttgtcaactaagacatcaaactgtgcctgtgacttgatcttgtggtctgcatcaacagattcacattaacgaatcagcatatagaagataatggcttttgaggtattgatttttggtaccttcaacctcctttaaagctgagtccctctgtcttgccagttctgccttatcattttccagagtttgaatctgcttctccagttgagatatcttggcagcttgcactacattgactctggttaatcaagattacaaagataacaacataagttagttgggcagagtttgtgtgtaccttttgatgagccgctcagttcaaaattggattcctggagctcagcaatccgatccctcagatcatgttcattcttcctggcaagctcttttgtctcgtgcagctgattcctggtggcttcgagggtcccaagatgagggactaacctctctaaggtcgccgttttggcttcgttcctaagatgaatcctctgcaagacagtttaattagcgcctggactaaatggcaaacgagatggttgagatcaggcgccaaagagcttacatttacaatgcgggtggcttggctgagcgcatttttcagcaagcaaacttcttcatcttctttttgcttatttattacgattccttgaggctgcatgttgtcatcccaccacttgaccagaatgggaggacgcgaatcctcagctgcttgtatccggaggatctcttcttcatcaccaatcattggccctagtgtatccataaataaagatgaggcgatcaaataaagtctgttggatcgaaatgatttcagatagtgtgtttacctgtgatgattcccggtcggggacgagtagactcttgtgtcttcacaggagatctggtttctgagtcattgccagcatcctttccgggaggattgtttgtttgagcttcaacctcgggaattttttggcttggccctgcatccgactggtttccagtcggggactcctggttaactctgactccagcttcggccgactagcttgcggtcgtgggttcgttgctgggttttacattgtcgctggcctgcggattatcactcgggtgatcttttgcagtcggcccggtttcttttgaggtgtctgtttccatgttagtcgggtcagagtctttctcagaaggatctatgtcggatggtttcctacaagttttgccatcggtgttatcttcatgatgggagaatattaatacaaggaaggttgttatatgatttgtacctggaagactttctgatttttggtacaggatgactggaggttttcttcttcggattagttggcttcggaggtcttccggtcgctcctttatctctgagctttccggtatcatcgccttcgtcgtcacttagaaccagcttcctcttgcgagaatctgactcgccgactggatcagaagcacttggttgggtttcagaccgaattcttggttctccgcttccctgaccagtttggcagcgaggtgattggcgttgagcgattgggggatccgatttcatcaaagcaaattcctgggcgtgatatcctttattgttaactgattcaacaaaca

SEQ ID NO: 39312 - DNA, 9183 bp, Oryza sativa
atcgtgtttgccgtcaaattcaaaagctgtgcgggatctttctttgattggagctaaccggctttttatgaagtgccgagtgatttgttctccttgcaagccttgctctttcagctttatcatgcgctccatcagttctactgcttgggcagcctcatcccctgtaggcaatgaattccatgtgtcttggtacaccggaggaagacaagagtactcaggaaggactggttcaggattttgaacatagaaccagttggcgtgccagcctttgttcgaggtcttgaagggcatggagaaatatttttggcttagtgttcccctgagttgaaaaccaacgcccccaacaacacatggtttgctcttgtttggctgaggtttgaggaagaagatgcggcataacaaggcgaaatgtggcctaatacctaaaaaggcttcgcaggcatgaatgaaattggcgatgtgaactatggagtttgggttcagatgatgcaggctgattccatagaaattcagaattccccgaaaaaatcttgaggttggaagggagaaaccgccatagaagaaatgagcaaataccacgatttcatgcgtatcgggggttgggaatgcttcgccgaatgccggtcgccaaccgatgatctccttcgctggaagaacgccgtgcgccaacatctccttcagattatcttccgtcacatcggagggcgcccactgactctcaaagctttctctttcttccgccatgaatgtgaactggatggtttaatttggtccgagatatggctggaaagggatgaggaatcagagcggtggacgcggggagaaatttcgtgaatggattggggcggattgatgaaccctagtttggccggcgcagttttgtactgtagcaggaaatggggaaaatggcgagagtctcggcggggaagacgaagagacgttttctttcacttcggtgttattagggtatagggagtgctaacaggcctgggtctgtacagtacttcagcccaatattattaccagcgtggcccgttgtgatccttagggacttaggcgctttttgctttggcagtttgtgctcacaatgatgtggcccaatgctgttaaaatcctttttaatgtggtttgataattctttggaattaacacgatgcaaacaaaagatgtccgacaggaaggtgttatactatttttgtaagccttattaggctgcaaaagctgtttgggttgattcgagatgacttatttattaagagtcattctcttagcatgttatatgcttaatttggttacgatgagggttatagcttaggctattagactcgttgattaccatgatttttatcatgtttggtggatcattttaagagtttcttactcgtagtcctatcaaatgtgtttatttttggaccttttgagtgtttatcactcggcccttttcgtattttttatccttgatacgttcaagttgagaaacagtcggctgggtattttactaagtaccatgcatgcttcgctataaaaccactcggttcttgactacatgtttagtttttcaactaatcacatagtcaggggctacacctaattaggtgcatctactcgatgcaccatgttttattttcgcccttcgcagtctttgattttagcactcggcaagctagagcaagttgaattgaagcactcggattactgttttttgtttcgagaaggctattttgtcaactgcgaaggtctcgggggctactgtggagattatggataccccatatctacatgacagttataatttagtcggatatacggtaccaaatatagatagaatatctttacgaggactcgggttagtttctaacttgtatgtcaaggaaatacccgaaatcttagtcggttacgattgtattttatctgtgattccatattttgttaagatatggactgtactttgtaaagcggactccttcccctatataaggaggttccgtgtgcctctcggggcacggttcttttttcccagtttatacaatcaataacacactcggcggaatcatccccggacaggagtagggtattacttcttgaataagaaggcctgaacctgtataaaattccttgtctccaaacccatccactttccaagcttgatagccacctcttttattattgccgaaatcttgtttcgacaagcaacatcgttgcacagacaaatttcgcatttcacgcactcttcaaaggtaacagaaccaattcgacccaaaaggagaacaagattgaacggtgcatcgtacttctgagatcgggacgacggcctacctctgcgtccccacgacgcggcttgtcgagccacgttgccggcgacgacgctggcgtcgccacgttctcgacctgcttcgcctcctcggccctcctccgcttgttccacaggacggccgcgctcgccgccacggcgatgccgacgcagaggagcagcaggtttagcaacgtccttgccgcccacgggtacacgcggttgctgttgccgtcgacggggtatatgtacaggcgctgcaccgcgccgacgagcaagaggaagatgaagaatgaggaggagacgacggcggcgagccagagccagccgttgtggccgagcaccggggcgatgggcgcgtgcgacggcgacggcttgaacaagacctcctctgcgggcaccttgtgcgcgattgcgacgacatcgcccgcggagggcacgctttctcgcgtcacgaaggcctcgatgcgcagttcgaggcgggagatgtcggagaacccaccggaggcagggacgatgaggtccagcatggccaggtcagccgacgtcttgaacacggcgatgaggagaaggctcggcgtcgcggcttctgccgccgtgccgctccggtgaacgagctcgcgtatgacggagatgaacggcgtgatgccgccgccgccactgatcatcaccaacgagtcgtactgaaggaagcttgctggtgtggcctggctgtaaggcccctcgaccgagacgtcgaggtgcccgggctgcgacggcggcagggacgagatcgtctcgtacagcttctccgtccatcttcctgctctcttgacgacgacgcttaacctgtcaggctcaaggctgctgctcgacgtcaccgtgaatgggtgccattggagccgcgaaacgcatgggacgttgatgaacaccgtactcatcggactgtgcgtcaaatctgcaagtgatcacgacatcaagtgtcagaacatgcttacttgcaccgtgaacgtgtcggatatatgtgacacctacgggggcttttgcagaagttgagctcgacggcgtcgcacgctaggaggcgggcggagacgagtcggacgcggacgcgggactgcaggaaccggaggtagcggtcgaccatgaagaggaacacgccaggcaggatggagcagaagaaggcgacgccgacgtggagcgcgaagagcacgaggaagagggcgtagaggtggtgcgcgtagaagaagagctcgaacatctggcgccggacgcgcggcagcgccgtcacccacatcaccagcccgctgagcagcgcgagctccccggggacgtttgcaactttcgttcttgtccatttcagcatctggaatcacataattggccgtttattaagtcccgacattggacatgtctaggacgatagaagaaatcgttagtttgtattacctcgtggatttgatcagtcgatgcccagaagacgatgtagcagagtccatgagctgtgaagaagagcataacgagattgcccagccagacatggtacttgatgctggcttccgacgtgaggccaatgagcggcaacagggacgagccgcgtgcgactggaaagaacaggaacgcgcagcagaagctcccaacgtggccaagccgcagcgctgctctgtccagcttcgcctgccacctaagaacatttcgcatacttacaaaagttagcacacaagtaaattacagatcatagatgaaacatatacgagtattattttgcttttttttttggacggagttaatgcatggttatcgtgagttggtcgacattttctcgacaggcttgacatggatcttggagaagtcgaggttgatgaaggcggagtaggaccagaccaggagtgccaggaacaagagaaagaaggcgagttctatgcctgtcacaattcccagtggacctctcaccagcacaggtctcctccaggccgccattctcgtacagaatactcctctgcaggaacaaaatcaagagaggaacacgcagaaaatttgcattagtactagtacatttgatgcggaatgtctgatgagattgatctcctctcccagtttagccagaactgaccgtacctctgactttggaccccagtactgtcgccgctcctcttcagcaagtgcaggtaaatgcacgcaactacactgacaaacagtattggcaaagtcagtgtagttcacgattcagacatgcacaggtattgggaacacgtagatcacgattctcgtccctgcaaatcccgaaacgaagaacacgaagagatgatcacggcggcaatgcagatatgcagtggaatggatatacagctgagctgatagtacaagagatggggaaaaaaaccttgtttgccaaagtaggtggaatttgtgtgggaggcgagcgtcggcgcccacgtcgagctgaatgtcctggtcggcaacatgacccacatcatgagccacccaacgaacacggcggcggccaggagaagcatggcgctcctggtcgccggcgcgccattcctgtctcggccatgcctagtgtccatcgcgtcgataccctgcgcttaacctgttaattaaccgctgtatctggtcaggattagattgtcactcactgggacacaagtcacacaagtaaggacgtgtgttgtgcttatataggaagaacggacggagagagtgagctgcacttttaatgcgaaatgataccgaggagatatcccttgctgtaatgctgtcatttgccatatttatgaggtaagatttggttgtggagatggcaataataactctttcgattcatcaattggcatggactgacgggggtaaagggtgtacagtgtactaacacactgggaaatatttaaccgagtgctgcatgaatatttttggaggggcatgaaaaatgcatttccgtcgtttatctctgtacggatatacaggttggatttctatcttttaactcgtgaaaaagaaatctgcatactagagaaatactaattcgataggcataagatatatgttttcattacacagtgtcgttgttctaggctgtgtgtttagatctaggggtgaaaatttttaccgcgtcacattgaatattcagatacacatttgaagtattaaacgtagtctaataacaaaacaaattacgtaatccgcctgtaaagtgcgggacaaatttattaagcttaattaatccgtcattagcaaatgtttactgtagcaccacaatgtcatatcatagagcaattaggcttaaaaaatttgtctcgcaatttacacgcaatctgtgtaattagtttttctttttatctatatttaatacttaactagcggggtgacccgcgcatttgcgcggctagcacccaaacaaaatcatatatttttcagtatgattttacttaaaatttattaaatagctatgtcgttgtcttaagactttaaaagaccaaaccttatcatcctcgtatttctaattatatagtttttaaaagtcacaccagctgctacctattacttttgtcataccgttatttatttgcttgcttgatttctatttattctccttgaaaccttatactgccattatactctacggcccgtccacggtcttttctttgtattgtcattgggattttaaaaatcaaacataattattattggggttcattttttactttatagaagtcccaccaaaccgtcagcggttttgctattgcacacctttgtggctcacccgctgcctcccttctttattgtcactgagattttaaaatcgaacacgattatcatagttttttttactttttagaagttacaaacctttaaaaattagtcattatagtttttagagtttattgttcattatagtttttagagtttattgtcttgttgtgtttcttttttataatttttagaagtcccgtcaaacgatgccactatactcctctacggtccatccgccgcctactctttattgtcattgggattctaaaaatcaaacgtaactatcgttggaattcattttttattttcttgtagtcccgccaaccgtcggcggctctgcaactacactcctatacatcccgcccactgcttctccttgtcattgagattttaaaaatcgaatataattatcaatggggtttactttctttgctttctagaagtcgtagaaaccgccttgcccgttagcttcacgggcttatcgtttctccttttaatcgtcattaagattctatttggtgttttattaacctttttatatgtcgtattaaccgccaccactctactcttttataggcgtgttatttaatttatctcgtcatgtgttttagatggtctttttatttcaatagtctttattttttatcaccaattttagttatttataaattttattcctaattgaaatctttttttctttttttctaatttcagaatttattttttatttttgaatttaacttgtttcaaaattttattcctacttgaactcttttttagtttttctaactttgaatattattttattttttattctgaattttaattaatctcgtattgggttcttatatagattcttctttcaatatggttttatttttaattccgaatttcatttaattttaaattatattcctacttgatctcttcttttctttttgctaattttggattttatttttatttttattccgaatattaattaatatcgtattgggttattatatcgactcttctcttaatatcccttatttttaattccaaatttcagttatttttaaatgtattcctacttggactcttattttcttttgtaattttggattttattttatttttattccgaattttgatcaatattggattcttatatggactcttatctcaatattgattaattttaattccgaatttcagttatttttaaattgtatttctacttggactcttcttttctttttttccgattaatgtgggaatttctagcccccacagcgaacgtggtgtcttctttcaaagttgttttaataatatactccctccatattttaatgtatgacgtcgttgattttttttgtccaacatttgaccattcgtcttatttaaaaaaattatgaattatcatttattttattatgacttgatttgtcatcaaatgttatttaagcatgacataaatattttcatatttgcacaaaaattttgaataaaacgaatggttaaacgttggtcgaaaagtcaacggcgtcatacattaaaatacggagagagtaatagatatatgtgtcaaacatttgatgcgataaagatgaaaaaacttgtcagggtctaaacaggtccctagtccacttgcgttgcgtcgcgtcgggtccgctccttttcttcctctcctcccatggtcaactgtgatgctagtatggtacagtactatacattgctactcgcgagcgatgtgtgactcgtgcgaacgagacggcaggagatgcaccgaacacgtacgcttgcaccttgcagggccgcgaccggtgcggtgaagatgggacaacgaaattgcgccgcgcgcatcggctactcggcagacgacgaccggataaggagagcaacggtggtggtggcactgtgcggtggccggtgtagtcactgagaggcgaaagaggaggccggaaaggggcagggcgacgcgcactcggcgccgcgtgacgggggcgcggcgcgcacgcgccggcctgcgccgcgccgcgcgccgtgccgagctgccatgcgacgctggccggcacggtggaacagccgcgccaccgcggacacgccagccaggcacgatattgggcctcaatttcttctttatcaacgacatcggcccaaatggaggtacagtaatacggtccacaaagcatagtaaagctgcacgtgttgtagtacagctcggcctgcaccagggctcgatggaagcctggaaggaataataagttcagtagttgtccctaatctttacgttgagcttacttggtatcctaaactacaatatcataaatcttcaaccccatcttaacaaaaccattcgagtcaagtgccatgacagtatagatgggtggttttactaacgtagtaacgtggcatcctagttgaaaaaataaaataaaaacatgtgggacccacttaaagtggcatacatcttcttcctccgctcctttctcttccacaatctctttcgatcgaacgcaacatgcgtcacgaagcacaataggtgagctcgttgtccgctcgtcacacaccgacggccccctagcgtgcgaagcaaaggggcttatgctcggtccctgatggcgaagatagaggtgatatgaccatcagcaacctcacaacggtgcctctccctcaacgagcttgtcaccatttctaccatcgagcacaatttttcttgtagagaataaaaaagtgggtgctaacggctaacatgtgaatcccacttttttttatattcttttccggactagggcgtcatgtcaatgaaaccatccatccgtactatcatgagatgacttgaacaaattttattaagataggaggtgatgattcaactatagacttaaactttgagtttatttgctgtggctgggtgttggtacgttggtgtgtcatctttttatttatctttgtttctgtctattatatttttcttataagattgatccaagacctagggccggtcctatgattttgagggccctatgcgaactcatcgcgatgggccctctaagctatgtataaaattctatgatatatatagacgctaattttacttgcaaaaacaaaaacaaatacatccatatatatatatatatatatatatatatatatatatatatatatatatatatatatat

SEQ ID NO: 39313 - DNA, 3866 bp, Oryza sativa
tccaagacctagggccggtcctatgattttgagggccctatgcgaactcatcgcgatgggccctctaagctatgtataaaattctatgatatatatagacgctaattttacttgcaaaaacaaaaacaaatacatccatatatatatatatatatatatatatatatatatatatatatatatatatatatatatatatatatatatatatatatatatatatatatatatatatatatatatatatatattaaatttaacatatatggtaattatcaagaaataaagtcgaccaaaataataatatatttgtaacttggaactaatatcattattcattaacttaataaagaatagaaccccatcatatccattgcttctcatgaaaacgtacttcttcgggcatttcttgatgcaaaatcatcaagaacgatattaagaacaatagtgtccaagatatccttctcgattgagcacatagccaagtcatttaacctttcttgcaacatagttgatctcaaatagttcttcaaaacttcaattttgagaaacttcttttaggtgaagctaccgtcacaggtacagataagagtattcgataggcaaaacatttggatagaaatctgcatccataacaaactttagaatctcaggcacggacatcgaaaaatctggcaaactcacttgcaacacctttaactctgaataaaaatcgttgatctcaacatcgcatgaggtactagactactagtattaggtgttggccccccatcatcatgggcccccaccatcatgggcctcggcggtcgcctcggctacatagggccagggccggccctgccaagacctatgtaataagtggttatagttttaactcagttgaagcaaaggctgggtttataaccattattaaaaaagggaggtggtgaaatattatattatatcatttaggtatattaattaaactcaatgtaaagaagagagacaacttgtgaacttagggttggtttggtttgtggcctaaataggccttaccaaattttgtcaatgccaaattttgacatgattaatttcggtaagacaaagttgtgtttggattgaagccaaaatagtctaagttcactattaaaatgatctattttcttaggcatgtcaaaatctggcttaaaccaaatagacattaaacactattaaaattgtcaaatattggtaaatgtaatttatgcctcaaccaaacgagcgcttatttcctcgatggaattcgaattcggaagccgaaggcccagaagaccgcaacatgcggagcacgtcttggggtggccgggtggagcgggatggaagggccccactcgcagtgtcacaaggaggacgccgccatttcctcccccacaagaaaggccgaaagcgaaagcggatcacaagggggtagcccgtcaccatcagcgctcacgcctcgcgcacctgcgctctccctcccccttcccggcctaggtgtcggaagcgcggtggggaggaagcgaacgcgccgccgtccgggtctcctccgcctcctcctcccgagaatcgtaagctccgggcatcctactccccctcccgctcccagtccagtgtcgcgtcctagcggcgctttgctgtgttcgtttggtagcttcgattcgcacgacgtggttcgctgtactgcttcgagatgccgcgatcgctcgccctggagatttatcgcggctccggcgtattcgtctcgtgcgggtttttgtggcgcggtgctcttccgctggttcggttcggcgtcgcatcatttcaagggtttatgctagtgtagctttcgggaggtgggagtggtcgccgccggtatttcgatttctctcttcttatttgacgcccaaatgtgccctgttgcttaacctagttctgattgtgctgacgaattctaacccgtcgtgagtgtgattttggggttttgggtgctagttgtctcctaagatattataaggagatatctccgttgttttggtgttatggactgcggactacttgtttttaatgttcgatttctagaagttggaacccaattagtcgatggaattcacagaatctggtatcgtgattgagatgcaaaatcgtgtttatttcataaagcagatggatctgttcatggctgcactttactgttcgatgtctataatctgtgtagctagatttaccatttatcacacaagtttaatctagttggcagtacggatctgcagttttgattatagtggattcgaatttttgtgcactgtgagtttcattttggtatttgtacatctacaattaagagtttcatgtagtatgtcgtcatgttgatctactgttctgcatgttcaaagtttgaagctatctctaagacatactgtattatggttcgttatgcatttcaacaggcttttaacacttctattactgggatgaatttcatcttaactgagcaatgtatgaagcattgacgcatgtattaatgaaatttcacgtttttcaggacttctattttgcctctgcatccaggttatttagaactctgtattcaggactgcacaatgtctatgatagcagcaactcttcgtcgatcgtctagagtaactggtagtcagaatatcatggagatatgtcttggaccttgtgtatcttctggtgcttcttcaaggtggttcagcagctgtactaagcactcaaacacttccatacttaaccagatcaaggcagttgatcggtattctccagttaatggtatgtcaatgatcagtagggtgcctctttcagctcatatggacacaaactggttgtctacttcaaatcccagatttaatgcactgccaggattcttaggtgcttcaagcatctgccgagcatactcctcagacactgggattaaggcagaagttccacagaatactgtctcaaatgtaccttccacagaaaccgttgcgcttggaacatctgatggtggtagttcttggattgatatcttcgacaatgctcgcaagtgtactctagatgctaccactgatgcaggcaagaaagttaaggagctgactgatgcaattacacctcatgtacaacagttctttgatgcaaatccaaacctagaaaaggttgtggttccacttggcgggacaatctttggtacaatgatggcttggtttgtcatgcctatcgttttaaggaggattcacaagtattcgatacagagtcctatatcagcacttttggggagctcaacaaagaatgatgtctcgtatgaaactagcctctggagtgcattggaggatcctgcgaaataccttatcacatttatggcattttcagaaatgtaaggcttctttttactttttctggcagattttatcgttgttgtggatggggtgcaacacactctagattgatgatatttcttcaatatttgcaagagatatatccatcttcgtattgttgaaatgttcattgttctgatgttttctcttcctcagggctggattcaccgcaccaagcatatcagcttatcttccacaggcatggaggggtgcaattgttctctcttttgtctggttccttcataggtggaaaacaaacttcatcactaaagttgctgcctcaagtattgatcaaaccaggttgtcagcatttgataagatctcgtcattaggactgattgcacttggagtaatggctcttgcagaggcttgtggtgtagctgctcagtcaatactaactgttggtggtgtgggaggtaatgttatattcccttcagtcataaatatttgacgtttagatcaatattacattaatttaaaatttaataagtttatgatatcaggatagtactttcg

SEQ ID NO: 39314 - DNA, 13719 bp, Oryza sativa
tgctctttcgactctcgcgaaccttccattcccatagagcttagattttcaccctgagtccccggcctaaccggcaaaggggggcctgcgcggtctcccggtgaggagccccacgctccgtcatctggcgcgccaggtagggggctcagtgtgtgttttctgagctcttgtgctcttcggtgtgcgccaagcttttcctgttcagcctgatggccgagcaagcaaaggcgcacgacctctctccgagtgtgagtggcgacgacggggagccgaacctacgccgtcgagctcgtactccgccgccccctccacgccaaagtcctaagcggggggaggcgctcgagagggtcgaaagatccgcgacttcacctatcgcgggcgatggagaagaacggcgagatggggagcgtcgtctcctcgtctacggcgacggcagcacgccccagggcgcgctccaagctgcgggcgcgctcttacgtcacccgcctgtcgtccctgacccggagtctccagcccaacgatggctggacgacgtggccaaattagtcatgacggcacggcagcgcctagatgctggtgggcgatcctccgccaccaaggcctctggtgctgctaccaccggctccgcgtcgtcaagacgaagggcacgacgagcggcagccgctgttcgccattcggccgccactccttcgtcgactcctacgacccgagaagatctgcgtggggggccggacgcccgcaccagcatcgagcgccggcgtaatgaccgaagtgctgcccacgcaacggagggcgcttcctcgtccagagtgtcacctcaacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccaccgagtttctccaggtctacacgaccgggattgaggccgctgggggtgacgacagggtcatggcgaatttctttcccatggccctgaaggggcaggcgcggggttggctaatgaacttgccacccgcgtcagtccactcctgggaggatttgtgtcaacagttcaccatgaactttcagggcacatatccgcgcccaggtgaagaagcggacttacacgcagtacagcgaagggatgatgagtcacttcgctcgtacattcagcggttctgtcaaatccgcaacaccataccatgcatccctgcacacgcggtaatctaagcgttcagggggggcgtgcggcacaaccgcatgctcgaaaagatcgcctccaaggagccccagactaccgcggagctttttcagctcgcggaccgagtggctcacaaggaggaggcctggacttggaactcctccggttccggtgtggcagcttcggccgcccccggatccgccgctcagacagggcgacgtgacaggaggaggaagaagaggtcagtccattccgacgacgagggtcatgtcctcgccgtcgagggcgcttcgcgggccacccaaaaggggaggcctacgagcgacaaaaagaaaaaggccggcgctcccatcagggagcgcccagccggcaagtggtgcaccgtccacaacacctccctccacgaccttatggactgtcgcgcagtcaaaagtttggcagagcgaacgaggaagtgggaggggtagaggaggcaggagcgccgtgagggcaggtccccggcggttccctccggtaatcggcgaagtgaggccaagcagaaggcccccgccgaggacatcgatgatggcgatgatgacctaggcttccaagagcctggggccaccattgccaccatcgatgggggagcgtgtgctcacgtttctcgccggagcttcaaggctatgaagcaagagcttctggccgcggcccctactcatgaggcgacgcgtcaggcgcggtggtcggaggttgccctcaccttcgaccagaccgaccacccaccgtgcgttgcccggggagggcagattgcgatggtggtttcccccaccgtttgcaacgtgaagttggggcgtgtcctcattgatgggggagcggccctcaacatcctttcccctgcggcctttgacgccatcaaggccccggggatggtgctccggccgtcccagccgattatcggtatgacgccggggcacacgtggccgttaggtcacatcgacctaccggtcaccttcggtgcatccgccaacttccgcacggagcgggtgaactttgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccactgcgtccaagcccgaggatggcaacgagaggcttggcacctccgcccccgccaccccgaggcagcggatgattacatgcgacgaggtcccggtcaaggaggttgccctgggcgacggcccgtccaagaccacacggatcggtggtcttctggacggcaaataggaagacgcgctcgtctccttcctgcgggcaaatgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatacatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacattactcacagatctagcggaaacttttgcgagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagctgaaaatgccctcacccagttgaaggcgtatctaagctctcccccagttctggtcgccccggagccagacgagcccttgctactctacttagcggcgaccccgcaagtagttagtgcggcattggttgtggagcgcgatgaggacaattctcatttcgcgcttccccaccctgtgctgactctacccgggagagagcagggagaagaggcccccgagccgaacggtggcctaaggcccctgacgaccggagttgccctttgcccgtttgtccgacgacgccaggagcccccgacccccgggacggccccgaggccactgtgggaaggccgcccctgtcatcctccgaccccgaggtcatcagcacagaagacgagtgcgccccacgaggccgcttggacgaagagcgccccggggatgcagcccctagcgaagaggatcggccccaccgaaaggtgcagcggcctgtctactttgttagtgaggccctccgggatgccaagacccgataccctcaggcctagaaaatgctttacgctattctgatggcctcgaggaaactgcgccattatttccaggcgcatcgggttacggtggttacgtcttaccccctcggtcaaatcttgcataatcgagagggtacaggacgggtggtgaaatgggcgatcgaactttctgagtttgatttgcactttgaaccgcgccacgctatcaagagccaggccctcgccgactttgtggcagagtggaccccggctcccgagcccgtctcaatccccgaggccaactcgggcccctcgcagttgcctcacaccgcccactgggtgatgcagttcgacggctccctgtctcttcagggcgccggtgcaggagtcacgttgacctcgccgagcggagacgtcctcaaatacctggttcgccttgactttcgggcaaccaataatatggcagagtacgagggactccttgcgggactcagggtggcagctggactggggatccgccgcctcctggtgttaggcgactcccagctggtcgttaaccaagtctgtaaggagtaccggtgctctgacccgcagatggacgcctacgtgcgccaagtacggcgcatggagcgccattttgacgggattgagcttcggcatgtgcccagacgggataacatgattgccgacgaactctcacggctcgcgtcctcgcgagcccagaccccaccgggcgcctttgaagaaaggcttgcccagtcgtcggcgcgacccgaccccttaggggagacggacgcgcctgaccggcccccgaggcccgtcggagtccaggcctcgggacccgaggggagcactcccagcacccttagattgattgcttggatcgctgagattcaagcatacctcacagataagactctacccgaggaccgcgaagggagtgaacgcgtccatcgcatctccaaacgctacgtgctggtagatgggaccctctatcggcgcgcggcttatggaatcctcctgaagtgcattcctcggaaacaaggcgttatgcttcttgccgatatccatgaaggcgaatgcggagcccactccgtctcgcgcaccttggttggtaaagcctttcgccagggtttctattggccgacagctcccaatgatgcggtcgacctggtccggcgatgtaaagcgtgtcaattccacgccaagcaaatccatcagccggcccaggtcctgcagaccataccactttcgtggccatttgctgtctgggggctcgatatcctgggaccgtttaggcgggccccaggcgggtttgagtatctgtatgtcgcgatcgacaagttcactaagtggcccgaggcttatccggtcgtcaagatcgataagcactccgcacttaaattcattaagggcatcacggcccggtttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggtcttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgacctcaccctgaggtctcctcgggccaccatgtactgcgaggctgatcaagatcagcttcgcagagatgacctcgattacttggaagaacgaaggcggcgcgcggccctccgagccgcgcgttaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggttccgtacggctggccacgggcgacggcacagagctgcctaacccgtggaacatcgaacaccttcgtcgcttctacccctaaggggggtcgggtgtcaggtttcgggctcgggccaaccccgcaccccctcgggcgtgcagggttggccgggggctgccacacatgcacattcttatttttcttatttcagtatttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgcctcggggcgtggtgagctccgggggggaatcggcaaaaacccacaatcgggtcacccataaccctcggtcaccacgttcccggcctggccagtctcgacatgtggatctccccaggcactagccccgacccgcgccttttgaggactgggacttggacacgagcccttaatcaagctaagacacaaaaggaccatggcacagatcatcctcatctcatacacatagcaaaatgaaattgacacaaaaaatttcttcattttttacagattaagttgatctatacaaaaaaaggcccgaaggccttagaagaaagaaaagaagaagaaactgaagattggcgggggcctgggggctcaatctgatgcgcccgggtcgacggcctcgtcgtcactgtcgtctgcaccaccggcatcgccctcctcgtcggagttgggggcaaacgcgagccgaggggctgagccctcgaagctgtggacgatatggtcggcggcatcccggacctgcgcgcgcgcgctgtcctcggtcccaggagggaactcatccagcgccatccatggagagaaattggggtccctggcctggtaactcgctagtatgagctccaccgctccttgggcgaggtccctcgagaatgacttaattgtcttctcaagctcctcggggagccgttggagagccccggccatcttcgagaggcgttgggcgaggcctccctggttggcggagtactttacggaccgccctctccagaggcccacctgccgaccggcgcaatctaggcgggagacggcgtcccaaagcatgccgggccccacctcgcttgccaagcggagggcctcgacctccccggcggacgagtctagcgcgccctgcaggtcggtgatggtgtgttcggcagctgcgaggcgggcggctaagtcgttttcgcccgcagccgccccgccgctgcgcgccctcgcgtctagctccttctcccgcacctcgagttcagcggcccgctcaatcagtgcggccccctcggcgcggacacattccagattacggcgcgcctgctcctcctgcgctgcctcgcggagggacaggctgtccgccagccgttgcgccgcggcctcggcctcctcgagagctcgctcccgctcggtgagtgcgtcctctcggaggcggagtgcggactactcttcggcacaggcagactcgtgcgccgacagcgttgcctcccggatagtgacggcggcctcgcggtccgccagatccctctccacgacgcaggcgcactcttccagcgccatggcgcgcgcctcaaaggtctcttcgcgccgtcgggacgccgcttcggtttccgccgcccgctgttcttgggcagcggcagcgtcaagcaccccctgggcggcgtcgagcttcttccctagctccgcctcccagctcccgtattgaaggcggagggtgtcctgcgcctcgttcatcacggtggtggcgatgagggcagctccccgctcctcctccacttccttggcgatttccgccaacaccgtcttacgagcttcaagctccgagacgtgctggcggtgtgccttgcggcccacctccaccatggcctccaccgagggccgcccctccttgacacacgcccatgcggcgtcgagctccgcccgctcagcttgcagggcctccacctgggcacttaacccgtccaacaccacggtgtttgcggcggccaaggcctgcagaaggggctctgcgctcagcggggcgatagaaggcgtggggaagagccgccttggagaggatgccacgcggctcgggccgccgatggaagtgccggactcggggatgtccctcggacctggttggtcctgggcgtcgcccgagggagtgggcccaagcgacgcgcccgcagcctcgtcgccagctgccccggaagttgtcgcctgagcgtcgcccgaggaagtgggcccaagcgacgcgcccgcgacctcgtcgcgagctgcctcggaagtcgccattgcctcgtcctggcgaaattcggcttcctcccgagcggcttcctcggcctggcgggctcgggcggcctcctcccgagcggctttctcggcctggcgggctagggcggcctcctcccgagcggtttcctcggcctggcgagcccgggcggcctcctgggcggtctcctcggcttcccgtaggcgatccgcggcctctcgccggtcagattcccgcctccgagcctctgcggccgccggatcctcggcctcagactggccggacttggaatggcgggagagacgcgacgggatctcgctgaaacagaagaaaagaccagaagacgaacaagatgggtgagtgaaaactcgtgttaagagaatgaatacagccacaatgggtgagagacgaacctgcgagggggtcggttaaacgaccactttggaggggaaatgaggtttccccgagatggttctgtctcccccatcttgcggagccgcttcttcttgcgctccccctcgggctgcgatgtcggcgcggccccctccgggcgcctgctactgacacgcgccgccccgccccctcggggaggagatggggaagaggttccttcctgcttcctcttcccccgggcgtcggcagggcggctgctccccgggcccccgtcgcggggcccagaagcacgaccccctctcggggtagattgttcccccctacggctcccgcccgcgccatcgtggcctcgaggggcccgctcctccgacgccccgaccgcctgcatgatggtcaggatggaggcgcggtctggatcgctgcagagggggaggactccttggggaatgagggatgcctccacggagctgagattcagcacccgttggaccactatcttgaagtcctcaggagcccaatcccatctgaccccctggtgggtcctcatgtagtcctcggacccggtgtactcccaggcgccccgggcgcgccgctggagcggcgcgatccggcgacgaaggtagtcgccgtacaccatggcccctgtgagcccctgggatcacaggcccgccaggtggtcgaggacagcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcctccgcggctggaagtagcagccaccgaccaccgacggcggcgacaccgactgcacggtgaagaaccaccagaacagccgaagggatgggcgcaccccgatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagactggcgccgggcgtccctcgcccagcgtgactatctcccggccggtggcagattccggcatgaagcggcgtggcagcccagcctgcctctcgctcacgatgcgggaaggcggcagcacgctaccatcgagcagagcggagccccgtgccatggcgccggaggaagagaagattgagagcgagcgcgtgtggcgaaggtaggacacaggaaagaaggagttagggtgcaagcggcgaagacaaggggaatgatggcgaaaggaaggaagcagatcctttcctcagtgcctttatactcttgccaacgctgtgcccggctcctcgcttctcgtgcccactatttcgccccctcgtatctcgcgccctcgcttccactaatcccattcgcccgcttgcggcgcatgaggtggatatgcggttgtggcagtcgagataaatcatatcgtgcgcgcgttaattacgctcgccgaccgaagcgacgttaccatatctcctggcaaagcgaatcggctcatccagattcgtgtactactcgagtaatgtggcagtcttgaagagaccgctcattattgacagccgagttaccattgccgatgtgcgaaatttgtgaccgttgggtttctgcccaattgtggagaccggtcccacctgtcaccaggccttaggagtggcgtcacgcccgaccgctccccttgaagagggcgatcgccctggcataacgccgggggctactgtcggcgacatgggaccgggagtatcatgactagaggcttgaggcagacacaatcgcccacgtggcctggcaccctcgggggacgtcgggcccgagggtgatgtgttcgccctcctcttagtctccccgagggggtcggaccattcccgcctcggccccgagggccgaggcgccccgacccctcgtgggttctgctccgcgtgtatgggttaggtgagcacagcggggctcacctaaccgcatttattgcggtttggctgagcgtgtcacgccgcatgtaacgcagtgcagtgcactcgtatatccggtctatgaccagtcacagaccggtcagatcacgggttaggtggcgacaggcggtctgacgcacgcctcgccccatcccgtcaggacgagagcttctaggcacgcgtccccagctagagctagcgtgttacctcccagagatggcacgttagtccccgtcagatatacgccaggcttcatcctaaccattacaggcaagatgttgtgtgaagaagggcgaacatgcatactgttaagctgacgcatcgtggacaagaatgaccgatttgtgatcagtctgacactggtcatgtcgtcagcagacagccacgttcccacgtcgcgcctgcctccggcggaagtggaggtaggtatgtgccgtcccatcagaaggtcattcggacagcaaccatacaaatctccgtccatttatgaagagaaggcaagtccagtttggaaagagagagagggtgcatgtggtatccccttgagatataaaaggaggaccttgcccacttagagaggggacggggggagattcggaacccagaacaagggagaggctggttcatactttgtagctccttcatacacagatccaccaaaaacacaggagtagggtattacgcttctcagcggcccgaacctgtatacgtcgcccgtgtcttatgctctttcgactctcgcgaaccttccattcccagagagcttagattttcaccctgagtccccggccgaaccggcaaaggggggcctgcgcggtctcccggtgaggagccccacgctccgtcagccgtggctcacacgacggattcacaacgattgctctgttttgcgtgacacaagggctttgtttcgcgcgatgagggccgacgccagacgacgacgacatccatagcggttagtagccctgacgacgatggtgttgttgcctatttgtgggtgagacaagagatagaggaggtggtgtaggaacatggagggagatgggagaggggggtgggacacaccttaggctagtggaggaggttagctacgtttggccattcgaataaagaatctattgtatagctttcttttttctctatgttgatcaaattttagtgtggagagtcaaattcacattctattagagatgatcttagcttaaatttgtcgttgcacttgccgtatagcgacaataacctcttctgcattgaattgcagtgagactcaacagtaaattcaatcgttgttgagcttgctacagtataagagcaggtataatagcatgctataaaccagttataaatatattttaaagagataaaggaagagagagaagagcagcgggctatagatctatagtcagctgcagtaccgacttcaagatgtaatatgtgtatgataggtaggaccaaatattaatagtataataaacaactattgtataaattggctattacattagttataaatgatttggagctaatagttgctattatattaaacttgctctaaaagacacggtacacagcacatgtcaccgcctcgtcagaccgggcccacacgcgcagataggggggatgagctggagcgggcggccacggtcacgccacgtcagcttccatttgcccctactaatccccctcatctaatcctactcctactcttcccatttccatctccgtcgagcacccagccccttcctcctcctcctcctcctcctcgtcgttccgcctccggccatggccgccgcgctgtccgccgtcgtctccgccaagctcggctgcccgccggcggcggcgctcggtagctggaaggtgaagaactgatgacttccctgcactttctgatgccttgcagcttgttagttgttacagagttatttctgctgctgttctttactacagtagatatcttttccgatttgtaggtttttatttacaaattgtttctgtagatttgcttcttttcttgattagagtggtagtggtgagagtgttgcataatttgcggctattctttttctaatctcgagataatgggggtgtttgtggtacaaaaccacaaagggtgttgtcattaggggcttaataaagtggggcagcaaaggcattggttggttagtgtctgctttcttgctctgcagctgcttaacaaggggaataatgttgagggctacttgacctaaccatgcataatatacataaagttttgttctgaaaagaagccaaaaaagagtgaaatcctcttggcctagtcagtaatcacatgacaatattaagaaagcatgtcccctgccctaaccctaaaggctaaaaacttgttgttgtttttctatgtttttttttaaaagatggtttaccactcttacaattcttagcacactgttgcactactctttgaaggtttccttgtgctctttccagtgtatgaccaaaattaaaaaccgggaatttcaatcccttctttaataacatgtcccatatgtgacctatggcgccatgcatgtcctacaggtttatcttgtgcaatctagtttctattgccaaactgccaatgtcatctttacataagaattatatccagaagtgggctcatgtagatgtaattaactccagctctggttaatctgtcagtgcaaacctctttgtgacagtgcaccactctatctgaaaacttgcagggaagcagaatttcaagcagaaacctggtctccatgaagacgatgacagcaaggagaggcctcgtctccctcagatcccctcgcttccgcgtcttctgcgcggt

SEQ ID NO: 39315 - DNA, 4181 bp, Oryza sativa
cttctgtttgatgaagaagagacgtcagtctagctagctcgagtagcacatttgtcatcagagagaagttgattctttgcgcttctagtcatcgatcggtgtgtatttgcgtgtaatttcgaacaattttgtcacttaggttgctcgattgattgctactactagtactagtttacttatgtacttttgctgccgttttttttttgttcggtacaattttaaattttagatgatggggttttcataaagcaaagtaatgtctgcctggccaaattataatttggttattgtctggcttccgctactcgtttttctcctccagattttgtccatctttggccgagtttagtttcaaactttttcttcaaacttccaactttttcatcacatcaaaacttttctaaacacactaactttcaatttttccatcacatcgtttcaattttaaccaaattttcaattttagtgtgaacacaccctttgtattcttgttcggttggttgcttaacatggaaatgacatgaagtccctttttgggctgctttcctaacatggtaagtaccaggttgtacttcattcatttattcattattcatggcgagtgtaacacacggcactgtttggattcgatccttaccttgttcaaacagcatttacagagaacaacaattagttcttgtattccgagatctactaggtgtaccctgtatcttaaaaaggtctagggaatgaatcagcaagtatgaagaacattagacattacttgacgagctatataatgtgtcaacattggacattaagtatggccttgtgtagttccaaaaatttttttttgccaaaaaagtcatatcgaatctttgacacatgcatggagcattaaatatagataaaaaaaactaattgtacagtttgcatggaaatcgtgagacgaatcttttgagcctaattagtccatgattagtcataagtgctacagtaacccacatgtgctaatgatggattaataggcttaataaatttgtctcgcggtttccaggcgagttatgaaattagttttttcattcgtgtccaaaaacccttccaacatccgatcaaacgtccgatgtgacaccaaaaaattttcttttcgcaaactaaacacaccatatgtagtactacacatatactatacagacacacatttctcacatgcaggttcagtgcaaatttgttcgcatcttcctaggaaaggcacctaaaatgagaggtttgacggttttgggacaaaaatttctttgaccacatggtggtttcgagtcaactttgacgtctaaacaaaagtggccccagacaaatgccaaatcctcaatagttttgagtcagattgtcacctgcgtagaataatgaccaaaattacagcgtcttgtttttgtttataagagaagcaatggttaacgcaacaaattccacaaacaaactggacggatagcccaccaccagagcaatcaaaacaagcacaaaggggctattatggtacaaatttcgtataggaaaggcagcactcactgctacaaaatttgtttttccatacggccaaaacggtattcccgcgtgcggatcttccatccatttgcatgaaaaggtctgcaaaaattcgattttttcatgcgggtggcgtacccgcacgcgaaaatcgaaaatctaacttcgcgtgagggcgcttaagtcatccgcatgcgaaaatagaaaattacaacaaaaaagccccgaaaatcgaaaccctagccctggaaccctaatccagccaccgttgtccaacccgaggcctaccgccgtcgtccccggggtcgtcggtgagggatctagcctcccaaggcctagcggctgtggatccaatgctcctctcgtggcactgccattgccgggaaaacgctaccgccaccgccgtcgtcgtcaacgccctgcccaaggcctgccaccgtcgtccccgtggtggccgacgacggatccgctctccccacggttgccgggagaccgccaccactaccctagtcgatgcagtcgccgtcctcgccgatgccgccgccctcgtcaagagtgggtagagggggggagtgggaaggggagatgggaggagtaggaaggggagaatatatatgcgggaaatatagaggtggggagaaaagaaaaaggagtggggagagatgggtgtgggtatatggctatttttgtgtgcgggtcacttaacaggtctgtatgcgaaaatacgcttattttcacacgtgggtctattaagaggcccttctgtgaaaatcaattttcgcatgtggcccataaacctatcacgggggaatgatttttgtagacgagagcacttataacccgtctagaacctaaagacggtcttgtatagaaaaatcaattttgtaggagtgattgcattgcatctacgcttcatagctagcaaaatttcttattatatatttagctgaaaaaaataaaggaagaataattgcaatcacacatgtaaggggttcatgatatcattgctcttttggggccgtttatgtatggccagtctaattcaatattaatagtactaacttatctctaaccaactaattaacaacatgtagactctacaaatgccattggaaatatctctctcggaaatttcgttacatgtaaaccctaaaccgtagcaaattgaagtatatttcatgatccaaatccgttatgaccctatttggaacaatcaaagtttacacaaattgatcgttccgcacgatcagcctgaggaaacgaacgagtgccctgaatctctctagctttggtggattgttctctcagttctcggccttccttagtgcttccccactgacatctcctctttcaacgaatggatgtgcgctagtcgaaagaaagtgcacatggaatgccgccgcggcttcaacacaatcacaacccttagaacttggtccatttggaaggagaggaatagtcgagtattctattagtccactcattttgttgccggaagcggtggagcaatggatcgggaagctgacctccagtatcttgtctcactatcattgccagcactattagtatattgcttatgtcgctaggtcgtttcaaatgatttcgtgagaatagaattaatatataagtcctttcttttcttttctgtttcatcttttgttccccctcttttggtttctggcttttcttttgcttggccctacatgtatgagttttattcatcttaatacaaaagcacacaatccttttgtatatccccgaaaaatatcattcccctactagaattcatcctaattagccacacttcctccaatcacttttatacgatgtttaaggcataatggtgcacccccaacccttctccctccccctcccccccgaaaaaaaaagaagagagaaaaaggtgtggttcaaaagagctaaacaataatttctaggctacagttgtacaacccagccgttcggtgagcgtgtcacaatgtcatgcggttgaacctacactgcccttgcagccatcgtagctattgtaggttgttgccatagtgcagttgcatgtagctcttccaaataagcccaaaattaataagcgatttagtatgactttgttgtctgaaatatcaaataatattgattgaagtgcgcacttaactaagtcatttcgaataacttttatcattggtttaccctaagctaggcagaactcatcttttaagaacaaagatccaaattcattaccacaatgcttatttaggccgtgttcttccccccagttttcccaattcacctctctcgtttccatgcgcacgcttttcaaactgctaaacgatgtgtattttgcaaaaaaataaaagttgttttaaaaaattatattaatctatttttttttaaaaaagttaatacttaattaatcatacaataatgtgtatttcgttttgcgtgacggggaggcgaattcaattcccaaactgcatgaagagagaaaaaaaatcgtaaaacaataaccacaaaacacagtaaattcccacgaaaaccagcatgaatacagcatccaacacatggataacacaagaaaccaaccacacacaaccattgcatcatcacagaaggaatgtactcacacgagctaaaggccagccaccgtgtaccgcattgatacgccc

SEQ ID NO: 39316 - DNA, 4081 bp, Oryza sativa
ttggtcggggaggcggcgcggggcgctgcggatcgagctccgggtcgacggatttggccgcgtggaacgggagctcgactcgatttttgcggaggcgcgcggtcgccggaggcgggagagggagagggagagagagggacggcatatgcgtgtgacggtgacgcccaaggacgaggagaggctggtggtgctcatggcgcgggagcggccgcggtcggcggtcgtggcacccgggggagacctcgttacggcgggtggcggcggcggtgggggagggggaggggaggggtccgacggggactcgtcggggtcgctggaggagatcagcgccgacgacttcaagaaggagtcgtcggccgccggcggcgcggcggcggcggccgcggcgcagcagagatctagggtttggatggggtacaacatcccgcggagctacgcgccggcgttccacagcttcgcgtgggcgcaggccgtgcagaacaagccgctcgtgccccgcgccgccgacgccgccgacgaggacgaggtggagcacgtcgtggacacctcggacgaggagaaggaggagggcgagatcgaggagggggaggccgtgcagaccaccaccacctcctcctcgtccccgccgtgcgcgcagccgcccgaaaccatcgacctggactccgacgcgccggagaagtccgagtcgatggtggccatgtatggcggtggcgccgcgccggccggtgctgaggaggaggaagtggactttgaccagcgtgtggggagtatactcgaggagcttgagatggtctccattgaggaagctgagaagtatggactgatgatacttctatatggcaaagttcatgtgctcgatgtgttttggtgtatgattcagttgctgagggacccgattctgatgttctgtaggtcgtttgagggtgcatgtacgcgtctgcgaacgtgcttcgagaacctgaagccgttattcccagagagcgggagcccaatgcccatgcttgatgcccttgtgcagcaggcgtttgttggaatcgacaccattaccaccgtaagaccgactgttgacttggctctgtgttgtggactgtaaagctcacagttgttgcattgttgtaggtggcaaattcgtatgacatgccgaagagggagcagaccaagaacatgcttcttaagtaatataagttcatccttttctaatcacattgagaactaatgtgctatgtgttctttgcagcataaactaaaatgttctcgtctgaatgtgtaggttgttattccacataaaaaacagatattcagacatgctaacacctgaccaacgagatgaggtttgtaaaccttgtactttgtggttttagagtctgccattattaattttggctgtggtagcatgctcatttatttttcttttgctttgtgtcagctggatagccgtgtgaggcagttagtgtttgaggatggaaaagacaatgcaaatggtccaaatgccacttcaactaatgctgcagctccatctggtcaggttttatcagagagactaccatttgaatcaggagcaggaaattcatttagcaaggttgaaataccagcaaagaatagaatggttagccccttgttggatcttcatgcagattatgacgaaaacagcttaccctcaccaactcgagatagtaaaccaccttttgatgtgccaaagcccattggatatggagcacttccaatggcacctgacagaccatcggttctagaaagagttgagcctgcgaagaattcttcgtatcaatcctttaacgatgcactgaaggctgtttgctattaccaacagaagcatgggcagaagtctaactttgcaagcgatgatctaccaagtccaactccttctggtgatggagataaatctggagacaaagggggtgatgtatttggtgaagtttcgagcttttctgcttcaaacaagattgcgttgccaattgtgaatcagatgccctctcgacctagcacagttagcagcaacagtgacagttttgcaggtggtccaccaggttatgctaaacagattgaaaactctgtttcaggatccaaccacctgctaaaagctacagctaaaagtagagatccaaggcttaagtttttaaatcgtgatactggtggtgttgcagatgcaaaccgacgtgtgaattttgcagaaccaaatccttctaaagataggaccatgggtggtggagtatcaatcaatagccgtaagaataaggcagttgatgaacctatggtggatgagaacgcgttaaaaagatctaggggtgtcattggcaacctgagagatatgcaacctacaggtcgaggtgggtgggctaaagatggaggtaatattagctcatattctagtgatgggtttcagccaaatcaaaatacaagacttggaaataacacaactggaaatcataatatcaggacagatagtacacttgctagtaacttaaataatacgacaaataatagtggaactagtcctggaattgtacaagcaccccaaactaattcagctccgcaaaccagttctgctcctgctgtttcattgcctgctatgttaaaagacattgctgtcaatccaacaatgctcatgcaatggattcaaatggaacagcagaagatgtcagcatcagaacctcagcagaaggtaactgcttctgttggcatgactagtaatgtaactcctggcatggttttaccacttggcaatgctccaaagaccacagaagttgcagcagtcccttctgttagaccacaagttccaatgcagtcagctcccatggtaactctcttactagtgcacctgtgttttctgtttgtacttacaatttatctgtttgcttcctaatgggttcaaatacaattttatataccatatgatgttaatggcatgtgctttgcaagtttgcaaaagatctcaaataaacatgccataagttagaaaaaactgcatccacaaagtttatattaaacacttgcatgcatagtttttgtctcgtcaatgagtcatggagaacttttgagatgcccacgcaaaaatccattaacagaatccaccaactcaatttgttgtgtggagacagtgatcatattgcattattgccaactctttttatagaagtatatatattatatgcatatcaagggacataaatgaggtaaaactaagtttttattatgagtaggtcgtattagcttgtgcgtcataccacggtgaaccaccgtgttactaatgccaattccaaatccttttgttataatatttaggatctcgtactaatattatgtttaaaaatgcttttttgtgtagcactcacaaaatgatactggagttatacgtatgaaaccacgtgatcctcgtcgcatactccatagtaacatagtgcagaagaacgatacagttcctccagttggtgttgagcaagccaaaagcaatggaactgctccgccagactctcagagcagcaaggaccatttgctcaaccaagaccaaaaggcagagcaacttcaggctattgcattgccttctctacctgttacatcatcagcacggccagtcaccatgaatgcaaatcctgtctcaaattcacagttagctgctacagcacttatgcctcctcatggcaatacaaagcaaacttcaagtagtgtaaataaggcagatccaagattagctgctggacagaatgaatctaatgatgatgctgcaacaagtactggtcctgtaacagcacctgatgctgtgccgcctgctagcccatatggagatgttgatcatctccttgatggttatgatgatcagcagaaggctctcattcagaaggaaagggcaaggcggatcaaggaacaacacaagatgtttgcagcacggaaactttgcttggtgcttgatttggatcacacgctcctcaatctgcaaaggtatttggttttgtatcctataactttactttttgaaactttgttaacacactacatgcttcctgttcagtttatagaagtggaccatattcacggggaaattttacgaaagacagaggaacaagat

SEQ ID NO: 39317 - DNA, 3372 bp, Oryza sativa
ggtatgaatctgtctaatgtttcttgctacatgaggtaacagcagtacaacaggttcatcttactacgcccccttccatttttttcctctagatacacctatttcccctgcagcaggcgtcagtttgggcttcctgggccatcacttcttgaaattgatcgagatgaaagaccagaggatggtactcttgcttcttcactcgcggtatgatggtttctgctacatctgaacttttaagtattgtaatacaacttgattatgatatacatacttgttgaattcttgaaataggttattgagcgcattcacaagaacttcttttctcatcctaatctcaatgatgctgatgtgcggagcatactagcatctgagcagcagaggatacttggtggttgccgtattgtctttagccggattttcccggttggagaggccaatccccatatgcatcctttgtggcagactgctgagcagttcggtgcagtttgcacgaaccaaattgatgatcgggtcacccatgttgtggccaactccctcgggactgacaaggtgaattgggcgctatcaacaggcagattcgttgttcatccaggatggtgaggaatattgataatccgtttgattgaatcctgttttatcgcatgactcaaactccttatcatgtttgctatcaacagggtagaagcttcagctctattataccggcgtgccagtgagctctactttgcggttaaataacacgacaatgaatccctgtttgccatccaaagtcgtgagtaacttcctgggaccatccgaagtcgtgagtaaacttcccggggacaggatccggtcaaggaaaacctaacatgacaacaaaaatcaaacaacataagtgaaagaaaaaaccggaccgtactaagaaaacccctaaaagaatctcaggcgaaaaacaggtaaaggaacgcttcatcatacaacaaagcctgaaagaagagagggcaatccacattgtttctgaggtgctgagcgtttgcctgacaaaagggttccagtgtgaaccatgaaagaaaattatgccaagcataaaaaatggcaaatgctcaccaatctccccttgtgtaacatgtagtagtaaatctggtacatttttggttgcagtcctaggtccctgcctctttgctgcagtcctgccaggctcctactactagccacagactactccgtggtggcttgctggtagcagtcacccatcgagaccaggtgagagtggcatgtcgactggcaagagcagcaggcaaggagcaggagcgatactgctttggactgtgtctctgtgtattcatgtggctgtaatactgcagctgccgattccttcctcttgtgccctccctctgatgaaagccacatggaaaaggacacctgaggatgctcctgcctctcttcatcaaaagagatgaggagggttcagggagagggcatatgtactatgcaggattcatgttgcgacagcggagaatttcccttgttggttgaggctatacctttcttcttgtgccaacttgaggagtcaatgggtgtggcagaagaagaacgtggaagatgtggttggtttggtgaacaactgtaagaggagggctcacagggagctcatgctgaaaattactactactaactcggatgggtgaaaactgaaaagattgggatggtgagggatgcttttcatgttttttgtttttctttttgcagggatggtaattctttttgggtaaatatttactatacttggtaaaaaaaacacgacaacaaaaccgaacacttttttttaaacatcttctgggttaacctaaacatgacaacgctgtttctactctactttatctggaaatgaagggcctcattgtttgctctattacttataattcgttgccaaaatttgaatttttaaatttgattttgtttttttgaatgaattttttacattggtttctaagttggtagggacacacgtataaaaaaatttacctacaaattattttttattgctaataagtcattacgacataatcaaccatcagcaaccgatgaggggcgaaagaaactttttcgcatgaacgaactgcgccgtgcaagcgtggcaacatgcgtgaaggtgggaactaagatggaacaagacaatcaacagtgtgttttggaaataagctttggcaataactaatggtggttagttgcttatgacgaggacttgaaccttttacttatggctgacgttttttttttttgtaaagcttgcttaggcaagctattgctgaccatgcacgactaaaccacgattagacgagctaattagtttggcgacgacaatgcgtacgtacggcgtgcatggtttgtgagattactcgtgattcaatctgtacttgcatgagaagcccatggtgatctttgtacgtcacgaggttggacagaaatgatgggtcacatccacgagagcctaaatgcacgtgctttattatagatataaaaaacatgtactcccttcgtcccatattataaaggattttaggtggatgtgacatatcctaagactataaatctgaacggagtctatccagattcataggactagatgtgttcaatccacctaaaatcccttataatatgggacggaaggagtatcataatactatctttgttgtaaaatataagaagtttttagcttagatatagatattaaaaaagtatgtgaaaaatttaataccgaagtaaaaaaaatagtttatctatactccttttaaaaaagtagaaagtattatatcaaataaataaaaatatattttcatgaaatatgttacctatcttggaaatattcacttattaattttatatgtggacatctatttaaatttggttgtttttaatataaaaaattaagagataatttgtaaaatttataatggggtaggtagagtagtactccctccgtctcaagaaaagtcaaaccctgggtttccgtatccaactttcactgttcgttgtatatgaattttttttataattcgtatttttattgttgttagatgataaaacatgattaatattttatgcgtgacttgttttttttaatttttttcataattttttcaaataaaacggacggtcaaacgttgggcacgaaaacccgggtttgtcttttttttgggacggagggagtagattcaatactaccgtcagcgcagcatacactactatacatgcaacaccagactcgcgagatatttacagactcacaccctcacaaatacacccctaacacatgctcaaatagatgaaaactagtgacacatctatgatcttactaaattcatgtagaaagcttacctatataagggtaat

SEQ ID NO: 39318 - DNA, 6137 bp, Oryza sativa
agtcttgaaccgtacgtgcaagcatggtagtactatggctctgattggatccggagggctattaaatagccctccggaatcttgctatttaggagtattaaacgtagattagtgacaaaacccattccataacccataggctatttcgcgagacaaatctaacgaggtatattaatccatgatttgctacagtaatcagtcgctaatcatgaattaatatacatcattagattcgtctcacaaaataacctaagggttatggaatcggttttgtcggtaatctacgtttaatacttctaaatagcaagatttcagagggctatttaatagctcggaggatccaaacaagacctatatacgtacgtacttctacgaggtgagctcatgattgggtaaagtcccttgtactcagtccatttttcgctctgcacaacaatagcggttgtttttcaccttctacatatgttgtagtgattttgtttgaaatgtacgctgtttttctagaataatacttttgcatatttttctaatgcagatactttctctgtcctaaaatataaggaatttaggttgtatggacacaatctagtactacgaatttggacagtcttctagtccaaatttatagtactaggatgtatcacatcaaaccaaaaccctttatattttagggcggaggaagtatcatttaattaggtccataaccatggaactgggcctacttaataaagcctatgttagccaaaaatcactataatagcggtgaaaaccatcgtttatgatgtatttttggttctaaatcaaaagttagaataaaaaaccagtcctataattcaagatgaaaaatagattataacggcttgttcgtctatcacagttatgcacgtggatttttttctatcacacttagactaaagatcaatagagctaccagccattggctcgaaaataatcctcgtcagaaaaagatgaatgagaagaaatatataattattaggcaaattttgctacataacacctgaaatttgtgtaatttgctgatagacatcgaaaaaacatatcacggctgaaatatattcttaaaaactgataattttctagaggactgttttgattcaattgacaagataaattcttgagaaagacaagaatgcccctagaatcatatgcttcaacacaacattagagtaaaagtttagaaattatgtaattctaaatttaccattaccccaagtacatcactagtatacatcatattttatcttcactccaatcttagctcaaaatcttttgaccataggggtattcttgtctttttgaagattttcaatctacaattgagctgaaagtgttctccagcaaattaccagtttttttaagagtgtctttcagctttgacacgcttttacgatgcctagcagcaaattacacaaactttaatgttctataataaattttacctaattaataactagctgtttgtatattgttattttttaatattttatttaaatcattgagctcatcatttcgcttgtaccccgtttcaattgggctggctatgcctgccaccagtgggccccactatgctgcactagaggatatacggcattctccatatatattaccaaaactgaatattaaggcttgtttggttgcacgctacaacttgccacgtctaaagttagtcataccacagttttttagctacttatttagttgatgacacaattgtgactagctatacattttctatatatggctccacatatcatacacttatttttttttctaactttggctaagttgtagttaacattttgctagccgttcatttttgtctaacatgtggtttggtaaattagtaagcaaccaaacatcccctattggtaatgtgaatctagctgcatctttgacgaacaccacgatttccctgtgtcggaaaatactatgcatatgactaacttatttgcttgctttggatagtactcttgtggcctcgtacttgtactatttatcgcggtcacgatgattcttatcatgtagctagtaatgacttactatatatatatctggtttttatattgggaatgcccttaaataataaagcttctgttttttttcttttctctctcatttccatctcagcaacaattaatatggcgataaactcttatactctgttatcatattgtggatatatataagtgtttttttaaggaataagtccactttaggtctcctaatttgtcgacgtcgctggcgtcggtaggctgcggcttcatgcgcttcttcttctcgtatctgaagcctcgataaaccccgtgcgcgggcggggcgggtcgggcctggtgctctgctcgctggaggtagagcctcaccgcgcgggctgcgaccgaacggagccagccgaccagcgtactccctccgtactcatgaagaaaatcgtttagaacaatgtttaagttaaatcttgggaatataaatcatgaataactcccaagttgttgagtttgaaaatgtaaaaactatatgtatagatttgtctcgaaaaatactttcataaaaacatacatatatcattttttaataaatatttttatagaaataagaagtcaaaaatgtgttttggagatcgtgtcgctgtcctaaacgactttcttttttacgagtatagagggagtacgtgtacgacactgaccagctacgtacgtacgtacgtactcctgcatgcatgcactccctgtcgtcgtcttctcgatctggtcctcgatcatgcgaggcggtacgcggtagaagaagctactagctgagcttattggcggccgtacctctcctaatcgacgcgcatgcatcttaataaactactctctcctgtatgacgtcgttgacttttttataaacgtttgacctatcatcttattcaaaaaatttatgtaattataatttattttattgtgacttgatttatcatcaaatgttctttaagcatgacattagtatttttatatttgcataaaattttttataagatgagtggtcaaatgttggttaaaaagtcaacggcgtcatacgagggagtaatttgtctccaacgtagggggacacgcacaagtacagtagtacgccttccagtctcgccgccgccgccgtagttctcggccggcgaggtcgtcgatgtgggggggggggggggtcgggctcgggcaccggcgcgcgtgtaggcgtacgtcaggccagcctagctcgtcgcgcgcgacgtcgccgtggcggacgatcgagcacgatgcggccggcgagcaggtggtggcgcggcgccatatacaggtcgtgacgagctccagcaaaggaagcgttgcgcctgcctgcggctgcgagagagctcgctgtcgtaggtgggacgccgcgagcagcagcggatgacgatcgaggagcgcgcggtggcgccgacggtcacctttgtcgcagcagctccagacgatatactccctccatctcaaaatatttgacgcgttgatttttttaaaaatatttgaccgttcgctttattcaagaaatttaagtagttattaattcttttcctatcatttgatttattgttaaatatagttttatgtatacatatagttttacacatttcacaaaagtttttaataagacgaacggtcaaacatgtttaaaaaagttaacgatgtcaaacatttagggaaggaggtagtatatacttcctccgtcactaaatattttaacgccgttgactttttcaaaaatgtttaaccgcttatcttattcaaaaaagattaagcttttcctattatttgattcattgttaaatatatttttatgtatacatatagttttacatattttacaaaagttattgaataaaacgaacagtcaaacatatttaaaaaagtcaacaacaacatcgaatatttacgagctgagggagtatatccgataggtagaaccctagctgtgaattggatcgatcgctggcctggccttatcgtagttgtaacaactgtaatttctttatttttaattgaacactcactgacacgtgggtcccacatttttttaaagtttaagtgccctgtccatgccacgtcagtcaaaaccaccatccaaactatcttgggtttctatttacgttggttttgggagtcgagggatgcattatagtatctgatattgtgattcagggataaagtttagactcggcgataattttcagggatctaaagtgatctttgatttggttggtttgtggtggggtgttgcggctgactggtttatgggcggtaaggccatctccagtgtgacgcggaaagaaaccatgaggagaaattaatcaagagaagatagtgacgacacttaacaaaaaggtagcgatgccaattaccagaataggaacacaaaattttattgtggagatggcaatgatacggttggtgattgttcaacctcacctacactggacattgttaaggcatctcctcaatatttgttgtaaaactaagtgctaggatggactgtgtcagataataataacagattagagagataataatatatgcatgtgcaaaatgggtaggtgggatccacctaaaagaaatctctaaacatgaaatctaaagtgataacaaagatgtatttaatgattattatctgcaattccactgcattatgaataccctaagtgaaccaaaccatgtagtagtagatggacaatgtccaggcctatcttccagcctgtctcacttacacttttgcttcgcttttcttgttttgttccttgccatcacaacacaatatgtccatggttaatattggaccaatgctaacaagaagataattaataaggtttggcatcgttccatacaccacagttagtttctaatttatttttaaatcggaacaaacactctcaactatcgcaaaattccaaattacatctttaacaactgaaggtaaccttagtctacaaaatgcgtacaattttcatatcttcccctaccatccactgtagattatctaccctcaagaagttttgatggaactaatccaaggacaatgcacaaaaaatgataaattaaaatgaaaacagagtgatcggcaaaaagaatgatacattaaaaatgtatccccccttacatggaaattacacttgaccaaataatttagctcaagaaaaaaagaataataacaaatacaatacaacactatcacagggccagatcttcctggcatttagatatgtcagtaaatacaaatgaaatacaatcagaagactcccacttccgatggccttggcatctgatctgaggaatatgatctgatagtttctgtacaatgcacaaagagatacattcctctcgaacagcgtagcacaacagcttgcttgcatttagagaagtctgagatgagcagtatcattcagcctctttatttgccatcctgtttttagtgaatgctcaagaactgtaatggaggaatcttcaatgcaaattctctgggatatcataggattgcaatccagcacgccagcaacgaggcatcggatgggagttgcgtgactgaaaattgcaatggaggtgaccgagggtgctagatttgcttcatgaaggatatgcctttgatttatttcttttggtgagaagtcatcctcagtctcattgtcgcctgaagtgacaaactgaagccggcttttcccagattttttcctttggaggctatgccgattgagcctgtaaagcaaatcccaagggggaccatcttggacagaattggtggaactttgccgagacagacccttcgcctcattttgttgtgatagtgagtcccccattgccaccttttctggtaaccgtacgactgtctgattaaggaattccatcatccgaaactgtacctgcctgagagactcaccagcaggcgctgagaaatctggctgagtgctatccatcaggttgaccatttctggagtatatacttctgatttcgggcagccttcccactgaccttgactcatctcagtcagagcatctgatacttgaatctgctcctctggaaaatcaagttcctgcagattaacattgccagatgtcacgaactgcagtgctgaagaccaatca

SEQ ID NO: 39319 - DNA, 5887 bp, Oryza sativa
attccatcatccgaaactgtacctgcctgagagactcaccagcaggcgctgagaaatctggctgagtgctatccatcaggttgaccatttctggagtatatacttctgatttcgggcagccttcccactgaccttgactcatctcagtcagagcatctgatacttgaatctgctcctctggaaaatcaagttcctgcagattaacattgccagatgtcacgaactgcagtgctgaagaccaatcaaaagaaaacgtaaacagaggaatgcatatatataaaaactaatgaagagggaaaataacatctgctgtagttcctccgcttccctaattaataattaaaacaagactgcacatttgcaggaccactacttgtcaaatgctacatgttccagatatagtttcagatataagtttatacctacatagcacaaagtagcttgggaggtatagtttccaaaaaaatccgggtgtctgaataatatgtggacctgggcccaaaagctaagagcaatgaatgacatataaatttcagttacatttacatcccaggaccagggaaaatccctatcccagatagtagtgtcagaaataactggcattactagggaagtactaggtttggatagaattttgtaccagcaaaatattatttgtgattttttgatagatatgtgtgatttttaaaactaaggctgttgaagccatgacattgatgaacacccagcctgcccaacagtaaagcagcgagttgatgaaatcctgggtttgaaccccagcttcttcaatctgtctttcctgacttatggcatttgggtccaagactgacagtgacaagtctacaacacaagaatatgtaagtcaccatttgatagcgtgagagtcaaacttgtatagcagattagcaggcacatgtcccttgccagtgtccagtagacaccaggatagttgcattcatttgtttacataatggataaccagccttaccagtgattaacaataaaaaatttcaaggcattgggcttttctgcccaggataaatctatggaataatggattgtaatctcaaattgaattcaatcctagaggctagaaatctaggtgaaacttttagggacagagcagaaaggatgcaggcaggtaaaaggggagctaactaatataaaaacatccagatactaaacttttagcatgagggtaaacaattctgccttttccacttactagagtttgcaagtcaatctaaatctatgcaaaataacgatatgagtttgagacaagggtatttatacatgaaataaatacacctttttattttgctgatttattctggcgggaaacacgtaattatggcagaacctctatgcgtgaactctcttatgcataagaggacagtttgtatgttcaccagagggtgtgctccagctcccatacaagctgcattccatggtcatgagttgtgaacactggaataacggaacacactttcaaaggaacagataaccaatgatcatagacccataattcagtggctagccaatactaccatagatgcatacggcatgacaattgtttcaaatgaaatgtaattgggccacccaatccaacaaacatactaagatgagacagttacgcccactaaagcacaaatacacattaaataagtgcctaatgatcatgatgtcaggttacaattgatgatgaaggcataagaagccatatgttctgtgggagcaagaaaaattacgtgcacaagaataactgctctcatagcaaaacccaattaaagtccagctgtagctctgccagactgtcctcacaactcatagccaccaattttatcaaaaataaagtcaattgagcatgccttgaaagcattgttttagcatgcagagtatccccatgtcactattttgtaatgttcgcaaatacaaaattattccttttctttgacatcagtccatgtaaaagacaaacaaggaatattagggctgttataagacaagaaaaaacagagacagactgcaactgcaagggtggaaatgcaatacacctgtcaaccggttacataaaggcaataagagatccttcaaagctgcctaccttttactactaaagaataggctcatctcatctagagctagttttcattaatgcccctaattttgtcttccaacatttgcacagttaaatatttaccatttcaaagtagcagacccagggtactcccttcagaagtatatcaagaaggttgcaatgaaatgactcactcctatttccttcagatgtttattctttcgaatgtctttttgtacctataagtggaactgtcaggtcctgcactgttgacaagatcgaaggtcaccgtaactcataagtgctttcatacttcacatttaggcttattgatggccatggtgtagaccaaaagagatcaaatgactatgatttgagctaatttcaccagcaaactttgaagagactttgacccaagacagcatcaattttgaacggacgccctttacatactgctaaatgctctattcagaagcatgtatcttatggcccatgcactcctatgctatccatgagaccatgatgagtaacagagtaaggatgcactgcattactgcataacacaagcatttagcaatttttgccccatcacatcacaaagatcccatccccacaccaagcccacaagtgctttgcctgaaggctaaccgaaatcacttcattaacgctaattttcaagatcacattaggtgaaatcccccattgctaaagggcactgatttcaaatgcatgatatgttgcaggcttgcagctttgctacaaacaatgctgccatctttgagacaattcctccgaatcgcaatatcgcataaaacaatcacaaatcagaatggagaaaccagaactaatattttctgttcaatcctagtacatgttagtgccacaaaatcctacacctaaactgaacaagcgcaatgcagaagcatggaatatgctagggagggaagccaaagaaggcgctcacccgacagaccagtgcggccgtggcgcgggcgcggtcaagcggggacgcgtacgcggcggcgaggcgcgcgccgcgggatcgcaggaacacggcgagcgcgcgggcctgcctctccccgcgcgccgtgagcgccgcggcgggccaccgcccgccgacgaggtcggggcgcatcgccgcggcgcactccccgtggctgaccaccaccacctccagcgcggcggcggcctcggccccggccccggcccgcgccgactgggactggtgcggcgacggcggggggaggaggacgtggcacgggtcccacaccttgatggtggggcccgcggcgagcaggcgcggcgtccccgcggcggagggctgcggcgagagcggcgagtcggcggcgcggcaggggagctcctcgggctcctgctcgagcaccttggacgcggacgccgggggagccggcgcgggcgccggaggggccggagccgcggcggacgcggccgatggctcgtcgtcgtcgtcctcgtccatgtcggcggccgtggacaccgaggagtgggaggagtgggcggagcccatggcggcggcggcggcggcgggcggcggcgggatctgagtgcgagatgggggagtgaagagctgaacaaacaaaagtctggtcggatttttctccggcgctgcgcacgttgagattggtgctggatcgatgaaggtacacgagaaataagttcaccgaggtcccttaacttatcgatgaatccgattttcaaccaagatacaacggatcccttgactgtccctcagcagtttggatggcggttttagctgacgtggcgtttaccagctaatttgactcggtcttggcattgacgtggtgcttacgcggcaattcggtatagaaaaataataaaccctgtgggacccacatgtcagtttcacaccaaaattaataaaaagtggtggggcccacgtgccattcccactccacctccccctctcccctctcctctctctccaggcacgacggagagttagcgaccgcggggggaggggggggagggtagggggtgggatcggcaccaccaccaccacgcaacggcggcggcgattccggaggagagcacctaccgcacaccgccgcacatccctcctcctctggccggggagatcacaacatagaaagatctgttagcaaaaaaacccgtaacgcacgcgaacgtggacgcgagagagaagaacagttatcacacagaacacaaatgtttggcactgcgaacaactgagcagcattttctgtttgtcttcttccttttattctgcgaatacaagatcatgggcacgttggcccggttgatgcggacacgatccctcaacggcgactgccatcccaatcaccaggatcgtgcctgcgcatgacgcgctcccgtgcgaactaaacgcacacgacgagcccaacgtcgcacacggccgaaaaaccagcgaggtcatgtgcgtgactctaacagaatcaacagaaaaacaggggagggaaaaactaccagaaccaaaaacacaaagcagatcgacacaagtttatttgtaacaaatctccccctaaatcttgtgaagttcaactttggccttttgtgttgatcacaccaacaagctcgctcagctcctggaaacgctgccttcccaaggacttggtaagcagatcaactactgctccactgaactggcaaactcgatgatgatcttccggcatcaacacactctcgaatgaaatgaaaacgagtttggatgtgcttacttcgatcgtggtgaaccgggttctttgatagagcaatggcgggcttgttgtccaccttgagaattggcgtcgtcgctggcgctccaagtatttcgctgaggagcccctgcaaccacaccccttgacacgcagccgttgtcgcagccacatactctgcttcacaagaagagagcaccaccaccttctgcttttgagattgccaggtgatggggatctgagcaaggaaaaacagcacgccagtggtactcttgcggtcgtcgacgtcgccggccatgtcgctgtcgttgtacccaatcagcttcagctcctctgtcttgcctcctgagtacgacacaccatgatctcgggtgccggcgatgtacctcagtatgtgcttgaatgcagccatatgatcctcgcgcggctccgccatgaaacggctcacatagccaacagagaaagccagatcaggccttgtattgacgaggtatcgtaggccaccaacaatgctgcgatagtatgtggcatcaacaagagctgcagtattggatttgctcagcttcaacttggcctccataggagcgtgacagggattacagtccaccatcccagtcttctccaagagcttcaaggcatatgcagactgagagagagagatgccgttgtgatcttggcgtacctcaattcccagataataggagagcatgccgagatcgctcatcctgaattgctgcagcatctccaacttgaactcttttatgtcaccagcatcctggccagtgatgaggaggtcgtctcccacgattagcggcttgtgcgcatatcgctgtgtgtacagcgcatgttcgtggtcgctacgggtgaagccgagggagacgaggcatgcatcaagcttcgagtaccaggctcgcggtgcttgccatagtccatacagagccttgttcagcttcaggacttgtccttccttgccgacggtgaatcctggtggctgctgcacgtatacctcctcttgaagttccccattcaggaacgcggatttaacatccatgtggtggacttgccagacctgatgcgcagcaacggcaaggatcag

SEQ ID NO: 39320 - DNA, 2010 bp, Oryza sativa
gttgcatcgtcgagtcgtgttgctggtcttagcgtttagtccgtttagagtttcgagttctggtcacgttttatactacagtcgtcgtcgcctccgtgtctctgttgtcgtcgggacctacgaaaacggaatcagctcgctgccacgattctatttttgtagttttcagaagtttttgtcggttagtttttgagttcttgagttgcatagcttctgttcggtggctgtgccgtgcatgtgtgcgaggaagaataaaggaatatagtagatcagtttggattcggtggggtggaaggaaaaaaaaaggaaagaaaagaaaaggaaagtttttttttattggatttggtttccacttgtgaagggccaggccgaaccctcccacctaccgtacccaccaccaccgtgacagtccgactccctcctccctctccaaatcacgttatctcagttctgagttgtgtcaaacaccttggtgaaatttcgtttggtgtcggtttcgagatctgtttgaaaaaaacggaaccggcataaattcagcattccatttttgtataattttaattttaggtttagacttttacatttgagtccctgtaaattttatatttacatttgagtccctgtaaccttacattaaggtccttgagtcagtttttgttaaaaaaaatcaagaaaaaaagtgagaaaaaaaaggcagaaaggtgcataaaaagaagaaaagaaaagaaaagccgcaccaaaaaaaacaacagaaaagaaaaggaaagaaaaaaaaagaaaagaagaaagaataaagaaagaaaagagaaaatactgttatgtttgagctgaacttcatatatcagagttgtgcatgagttgttactattgctatcttgtggtatcgtttgtgtctaggctcgcgtctctagtacgttctagcctaggaccagcacggtacttgactttgaaccattattcaactttgcattctctgatttgagcatttgctatcccttggctacatatttaagcctacccagagctccacagatctgattgcagccgtacaacaagtgtttgccaaggcatcgatacatccaacctccattggggtgcttggttaagtcggtgtacatcaccattccgcttgctttggtaaaaacttgtaagagcttgagtgtgtgtgatatttgagctgccactacctagtagttgataggagcgtgcatatttttgtgtgtttcttgtttcatactaaccatgcccggattgcgtaagggaatacgagaacatcaacttctacaccttcgacgagatatgacgacttctccacgttatgcatatgaggtacatgactataattttgaacaagttgcatctaagttaccattctatgatgggaagtatgattctgttgcatatattgattgggagctagcagtagacaatgaatttgatatatatgatttttctgatgctcaaatgattaaggctgctagtaataagtttacctcttctgctttattttggtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaatttaaggtctgtatcatctacagtggtctcaaagagtgcaatgaaaatacaacgcgtagatttttcaatgggcctagttctgaaattcaggttttgcttcatagtgtgacatataatcatattgggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcacgaagatcagcacatccaagaaaaggtgaatggtatactttagaagaaa

SEQ ID NO: 39321 - DNA, 810 bp, Oryza sativa
cataagcattgcctttctctccccccatcaggtcctagtacgattaagcatacagtcagaatagtgatcaatttaaaaaataaaattcaactgattgtcacttgcctggctttgtgggtacaaattgctggaaatatagatgtatatttcttcacagagaacaataagatccttatcaacagtatcatttgtactggagttgaacttgaaaattaggtttctcattgcacatggtagttgatcatctaagcgccgaattatagatggaagcaattcatctgcaacaaacagcttgcacctctcattgtcggtactgcctgcaagtcggaccatagcaaggcaaaaggaaatagcacttgtagttgcttcatcatccacccaatacccaaacaagctcatccttgaactcccaagacaatcatgggttaaaagataatgtaaaagcccattgtttgattctggagacgataaaactcccagcaaatgagacacttcacgggtgaactcaagaagttgagtatcttcaaacttctcaatgttttctgttggcccagagagtttcccgaagtataaggaactttagctcggccatggtgcataaggctgaaccacgcaaagtaaagtaaatcctcacagtgatcaagtaagggtcgtagtaggttcaacatccacttcttccagaatttggaaggacaatatgttaccaaaggaacgaaaacaagattgataagtttgcttaaatgcctaaactccattgaccctaaatcttcaaagatagcatcattgaaagatgaaatatccaatagatca

SEQ ID NO: 39322 - DNA, 2035 bp, Oryza sativa
tggtgtgtttcgtgtgaaaattttctatataaaaattgttctaaaatatcatattactctatttttcaagtttgtaataattaaaacttaattaatcacacgttattactacctcgttttgcgtgaaagacttaattttcatctttatcttcatcttcatgagattcaaacatcaccagctgtgattcaaacaccacctattgaatgactctcattcaattggaaaaaatagcaagggtagtatatgcctgacgtctttcatctatttaagaacccaagtaaatagaagcttcaatctaatagggcgtaaggtgaggccacatcgcttgctcccattaactgaggatttgatcgcctcaggcgatgaaacaatttcaacacgcggtgttttacggaacactcgctatataggaatcagatgcagaagtggttccaatacttgaaatggtattggatgttcaatatggacctggacatgggtactgttgtagttgtaaatacacagtcttttttagatccattgtaatctagaaattctataaaaatggaaacaacaactttagtcgccatctccatatctggtttactcataagctttactgggtatgccttatataccgcatttgggcaaccctctcaacaattaagagatccattcgaagaacacggggactaattgaagtggggagacttcttacattttctttctaattctaaaattggatattggctaaaagacaatcagatagattttctctttagcaggcattttcatatagaacttgttataataaaacaagcatgttatagaaaaaaaactctttttttattatttatcaacaaagcaaaaaagggtcttatcaaaccaacccatttagcttccttattcgtagacaaagcagattcggaattggggacatttgcaaatttgccaacggttttttcaattttgtaaggataccactggaatgacagttcgagtggtatttttataattttttagtagcagtcttgcaataatgattcaaagtagcggtaattttgcaattgccaataaatatttttggctcaaaaatatactgaatttcaacctaatcttttttagccagccgagcatttccaagatacagttcttctatttttagggtttatttgacacggttccagctctagccctacctctcctaaccagacagaatcaattcacctaaaataggaccataggagtggagctgggtaaagcgctctcacaaaattaagctagaggggttttggttgctccacaactccactctaaatccagctcttggagttaaatttaggtgttagagctccaccaaacaattccttagaccatactccctgtctcaaaatataagtattttttatccgagatgctactttaaccaacaatatttataataaaaagagtaacatattacgatagtttgtttaataataaatctagtaacatcaattttacatgattaaccttttttattttttattattaatggtcaaaattaaaaatgttaaacttgttactagctaaaaatgtttatattttggtacggagagtaatattttgattgttggcagctagtgggacctgttgttttattgaccaatcttttttcagtggccctatcgctgctattggccctctgtcgccatacgtctattgcacaatcaatctgtacgctatatgccttaatcaatctgattattagttgcttagttctgcaccttgtattttctgtctaaaactcccttgttgtctgtagcaagaaaagaaacaaagatttctgagacatcatttgtaatggacgatagcaatatggctaaagtgaaatgtttccccgtgttttctgcctataagcaggacacagtgcagagtagcacaaagcacgctatcagaagagtgggaaccatgagcgatattgcagtaccattacatatgttgtttaaattcaatcatttgtaaaccaaactataactattactccctccgtattttaatgtatgacgccgttga

SEQ ID NO: 39323 - DNA, 1353 bp, Oryza sativa
acacatatatatatatatatatcaataatacttacgctcggacgatcggcgcgggggaaccggatcgggcgctccccctccccccctccccccacgtgctacctactgggcccatcacttctccctcctttttttctataaaagatgttttcacctagtgtatttagaatgtttcactttttataaatttaatgttgcagtgaattaaaatattgttttgcaaaagaaaaacccacatattttggaaactctatattaagggaatttggtttattacttgttccacaaaaaatgtttcacctagtgtactcataatgtttcactatgtctaaatctaatgttgcagtgaactagacattccattgtaaaaaaaaacacatattttggaaacccctattaagggaatttggtttattttccattctaccgaaaaatgtttcacctaatgtactcataatgtttcactatgtatagatctaatattgtagtgaactgaaacattctttctttcgctatttactgaaacattgtttttatataagatgaaacaacacccgatttaaacaaatgaaacattttcgatctacttagtgaaacaattccgatatacctggtggaacatcgtgcaacatttaaaaataattcaataataagcttttttttcatcggaatatatccatgtgtggtcttgttttgaagatttaattgcaatgaatttaatggtgcaatcggataatgatttggataagtaatttaggagaaaaatcagtttaaagtagttttccacgtaaatcgggtgctgacatcaatgcccgattttgttccaatcggatcggttgcctgagccgtaggctcctcctcccatctctctctctctatatgtgtgtgtatatatatatatatatattacagtagttaatgttaatacctaaacatttaaaaaagtttcatactcattcgaattgggtatatactcaatttcaattatggtgcccgggcaccatggaacaccaaacaaatttaatatatatatatatatatatatatatatatatatatatatatatatatatatatatatatatacatattttaaaatactttcatatgatgctaatttcatatttgagggagtactttgtatatatgtatattgtgtatacgtcaatttattttggtatacataaaaaatatatatataaatacacacatatactttgtatatctacgtacaaccattgtagagtatttgtataacgtatgtacgcaactacgcgaggagactataaagagaggtgcgcacgcaacagccaaccccgtagacttgtactagttcgttccccctaaccccac

SEQ ID NO: 39324 - DNA, 1408 bp, Oryza sativa
aggaggctcccgtcaacaccaacggaggcaatactgcctcaaactccagcggaggaccattcttggggtataaccttcttacattatttcaattagaagttttactgttaatgttcatcgcaatgtcaacattgtgttattatgtgattgttgatgcttattctacattaagcatgctcatgttgattacattcaccactatcactggatcaaatcccattgtaaatatcatgtttattatcttgttattttgaattaaaatatgccgaattatgactaaatttccaacagattcactggaaaaggttgttgctgctgctatcctacaatctctagctaccaagccaactgatagttctaaagaattccatgaagaagattctcagttattgctaaagggtgcagtgcttgaccagacagttatgcatgagagtggtaatctttcttctacattggggttgcatgttagtgattcttcctgtgatattcagtctgaccataaaattgatgatactaatgatgcttcagatggtttatctatgatggcatgggaagtacacagtgatgatactcctgttgatgtgaaagggcagcgatctaatatatttcagactgcgtgcaaaattcaagataaggtatgcagagtaattattgatggtggttagtttcacaaatgctattagttcaaatattgtgcatgctttgtctttgtctacgcggaggcttccaatgccgcgtaatgtccaatggatgaatcaaagtggtacactcaaaattactcataaggcgagagttaaattctccattggaaattatgttgatatagtggactgtgatattgcaccaatgaatgcttgtcatttattgttgggtagacctcggcagtttgatctcgatgctactcacggtggtcgttccaataatttttcttttatgtacaagggcatatatcatgtgctcaaaccgatgccggatactgctattagggcaagttttatagtaggggtagttgtcacatctaattttatccatgtaagataagcggtgatatatacaatacaccacatctacaccacctctctcattataacccaaataattttattttatttgtttgtccaatcccctctttctttcatctcctttttcttggggtttgtgtggaggttgccccttgcatgagaggtggctcacattctctttcctcaattattacttccacctcatcattcaatcctacatgacatttttaggggcaacacattaagcatcatagtacttgcccttaaggctgaggtgtttgctgctttgaaagtgaagaaaaaggctattgctcctacctcaaagccgaggacggctttacttcaagagggaaaaaatgatgggaccgtacgttctaaaattattg

SEQ ID NO: 39325 - DNA, 3052 bp, Oryza sativa
cgttctgtagtcaaacgggctcatgagatacaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacatcaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatatacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctaaagaacgtgcagcatgtcccttctatcgacaggaatcttgttagtggctcccgtctgactagagacggatttaagttggtttttaagtctaataaagtagtcgtgtctaaacatggatattttattggtaaaggttatgagtgcggaggcctgttccgtttttccctttctgatttctgcaataagtctgtgaaccatatttttggcagtatggatgatgaggctaatgtttggcattcacgtttatgtcatattaattttggcttgatgtctcggctttccagcatgtgtttaattcctaagttttccattgtcaaaggtttaagtgccatagttgtgtgcaatcgaagcaacctcgcaagcctcacaaggctgccgaggagataaacttggcaccactagaactcctacattcagatcctttgtgaaatgaatggggtgttgacgaagggtggaaaacgatgtttcatgacattgactgatgatgctaataccttccgcaatgtggacctgttgaagaacgaaatacgaggctaaatgatacattataagtgataaggcagaaggttctcacctccccccaataagaataaaggctatggttttatcctggtgaagagttattgtagacggagtctgacgtattatgtagagccacaaggcatcttatcatcagagaatgcctgcgtattataccatgttcacatgggattggtgaaaggaagaaccgcacactgactgacttggtgaatgccatgttggacaccgcgggactgcctaaggcatggtggggggaggcatcgttgacctcaaatcatgtgttaaacagagttcctaacacaaataatgacaggccaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagttttttcccaatgaaggatacacatagtggttcgaaccaaccctctgaaataattcccaattcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtaatgaaatggattccattatcgctaacgggacttgggaggtgacagagcgaccctatgggtgtaaacctgtggggtgcaagtgggtgtttaagaagaagcttaggcctgacggtactattgaaaagtacaaggctcggcttgttgctaagggctatactcggaaagaaggcgaagatttctttaacacttactcacctgttgctagattgaccacaattcgtgtgctactttccctagcagcctcacatggtcttctcgttcatcaaatggacgttaagacagcttttcttaatggaaagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacatgacatctgcaggctttgtagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattgctaggaatcaactagaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaatgtactgtggaattg

SEQ ID NO: 39326 - DNA, 1336 bp, Oryza sativa
ccggggctaaagatgaccgggatctttagtcccggttggtaataccaaccgggactaaagtcccacccctatatatatatgtcttctccagttcttcctcctccagctgcccgaacaagctttaaaatttcttcaaaaaagaggggaggtcatgccaaaatttctattgaatttattttggtgattacatataaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtatgcccgttaggactggaagttcataagattcacgcatgtccaaacgattgtatcctatatcgcggtgaggagtatgagaacctagaagcatgcc

SEQ ID NO: 39327 - DNA, 8125 bp, Oryza sativa
accaatcctggcgaagaagtaagaattgacaggaagcactgaacgtgacaatgtgtggtactggagttgtggtacatgactctacttctccctgcgtttcatgttataaatcttttttttttcggggaaggctataaatcgttttgactttggttaaaattaaatttagttaaacttaaaacagtttgattttgaccaaagtcaaaactatgaaacggagggaataatcatcaggctttaaattttgaggaccacgtatattacacataacctggggaggaggacctttaatctaggttgtacttctctaatctttaactaaatcctatttttcactaaagcatatcaagtggctggttaattttctacattactaatgttaccaaaaataaataattcaagtcagccaacacatcaaactgtcaatatctacatttgtaatctcgaatattttgaaattactaaaaaacaattattttactaaaaaacaattattttaaagggtgtactgtgctcgacaatggtccgggttgctaagagaagagggtcgtgatgtcatgaaggaagggtgtactgttatgcacttttgttcagggacatggctgaaaatttttacccactaaattataagataattttcgcttaaacggaagacccattattttgttctattattttcgaataacacgctatttgaaaataaagtttacactgttatattctatacccactaaattcattatttaagatctatattgactaaattatatttaaaccaatagaccattactttagactattatttttataaaaaatatttagtgattgagcatgagtatgtcctaactagaccgtattaactctcaaccatgaaattactcaaaaagtcttattttaattttctataaaactcctatttactcatctatatactgccataatactatttacccgtctatataatgccagtatatactggcaatatattgtaccgtaaaagttttctaagtattaccaatatttgcaatatcatctttattcttcctgtgcaggggtgaagctggttgagagtatcattggggtaagctctattggtcggcatcataaaccctggatttttcaccttttggtctttttaatacttattctacaaataaatcactaaaacaacttattcgactccttttcgcggcaccaacgtcattagtgttgtggtccaacatgatgattggaataacattggggccatcccctcgcctccaggtgaaagctaagtcactgtagtgtgaaagggacggcgccaatattgttggtgccaagaacctatttgtaaaataattaaaaataacctatttgtaataaaaaaatatttacaaatagatcctcagtacagtgacgctggcacagtcacttgcgtcaaggatctatttataaatatttttattacaaataagtgcttttctataaataggtactttttcaaaaaaacatacaaatatatcctagtcgtcaatgatgttggcgctatcccctacacattaatgacttagtttctatttgggtgctagggaatgacgccaacgtctttgatgttgtcatgttgaaccacgacgccaatgttgtttgtgccacgaaaacgattatttatagaataagtttgtttaagtctatgaatacgtttactaaaaagataaaaaaaaagtgaaacatccctccataaaccttgaattgaatcgaaacaatggcttactagaatattttggaatttttcgggtttaatatttttgaggatgctggttacaccaagtatcatatttttgtcatcacttttgcaacgccgtgatacatacggcttacaagttgactggtccgatcaaatacatgacgtaggttcttaatcaatagacgaaagcatatactccaccgttctcaaattttagtatttctaatatttggagtttacacaatataaatatttcagggacattgattaattctaatacacaagaatccgagtattttttttaattcaaaaaaaaagatttcagtattcactaccggagaaaccctcttctctcccggttcgcaaccccctttactcccgggtagcgaactggaagggagaatccgtcactaaagatggcggtctttaatgccggttcaaatacccgggagtaaagatgcatgtttagtcccggtcggtaagatgtagccaggccaggaccgattgctactttattttattgtttttaacattgaatattgatttcactccatccctaaatagatcatcacagatcacaaatccaacagatcacagaacaaaagatatctccaaatcctcaaattgataatctccaaatacatcataaattataaaacattgcatcacaagttatacaaaaatcaccacaaatacatcacatgaatacatcacacacaaatcaaatacatctcagatccaatcacaaattcaaaaaaaaaaacgctagcccgccgccgtctcccgccgccctcccggcctcctccttcgcgcgcgcgggccgccgccgctgcgccccaccgccggcctcgctggccccgccaccgcgccccgcccgcaccttgccagctctgtgagaaaaggagaggataagactgtgtgagagaaaggaggaggaggaggaataggaagataaagagaggataagagtgagaaggaataggagatagaaatttttgaggataagtgcaaagggattatataaggtatattgatttttagggattaaagatctataaaaacttttagtcccggtggggaacaacaaccaggactaaagttaggatcgatctttagtcaaccgggattaaagatctctgaggacctgacagcctttgacacaaggtgaaccgggactaaagatcaagtctcagttggtgttaccaaaccgggattaaagatcgcatagtcctcttgcacaaataaaccgggagtaaagatctttactcccgatttttagcaactaggattattgtggaaatggaccgaaccaacaaacatcacttctccagtagtgatttcagccaattaggtgcttatgggaggcatccaaacaatttaaaaatcaaaatttaactaacaagataattgaaaatgagaatcttttctctaagaactgcatgtattaagaatggaggagtatgtactaatgtacaacgagatcactatctacaagttacgtcgctgtcaagtgtgtcacagcacactcattcaattccacctggaatttgcgattcctgctgacacaccatgagtcatctacccttgaaacttcccattgccaactagattagcgtaggatctacaagggcaaatgacaaaagcgatcgtcggttttggcccgatcgaattgaatgatatcggtagcagccagctgccgctcgcgcgcacggtttcgacgtccacttcgaccggccatcgtcggtgggcggcagcaattttccccgcgagcctgcgtgacttccacgcgcgagggcgggcgagcggcacggccaaccgctcgtgtacgtctctccgcgccgcgcacggcccacgagcgggcagcacgcgtgcgtgagcaatgatgggtgagtaattgttggcttattctctctatctaaacataaacaaaataaatataacacatcgatatcagttcagatttaactcgtgataataaaaggtatcgtactcccgccgtccttgtaaaagaagtcgtttaaaacagcgacacggtctccaaaacacaactttaacttttttttctataaaaatatttattgaaaagtgatatatatatatatatacttttatgaaagtatttttcaagataaatctattcatataatttttatattttcaaacttaacaacttgcttgagagttattcatgatttatattcccaaggtttgacttaaacattgtcctaaacgacttcctttataagtacagagggattatagtataatactccctctattccataatataaggcacagctactttttctaaactaggaaggtagcccacgcattcgcgcgggcatgcatcgtacgctaagctggggacacttatagcagcaaaatattaaccagagaacatctgctacgatttctccataaattatttttgttggcattaattgcttttataattttctaacctatgagctttatcttatatgatattttagtaatatctacaagtaattatttataatcttctccatcatttgaaaagtaggtagaattattttctttagaaaacatgtcaaaaaaaagataaagtaaggttttttttaattgcatatatattatcatggtttaatagaggagaattgggtgggacatgaagctccactaaatgtatgggtttatatagcctaatataactgatgtatttgagaggtgatccatctataaacatttcatgtacacaaggtcagacactccacacagcctaacatgaatactataatgacaacataattgtgctgtattaattttgaaatgttatagtattcatattactatagcatgaatacacatttgttttttatataagatcgatccaacgataagaaataatggttccaccgatttaaaaggcataggactattccaaaaatatagcttaaaaattatgtgtgattaaaattcaatattattgtaaagtgagtgtagctcaactggttagtttccttatattagaacttgccaccgggttcaagtcctatactttgacatgggtgctcgcatttacgactaattattctttcagtggtgggtggcgtatccatcgacagcgagacgcccgtggtgatttcttaaatctcaaaatatgtcgtctaatcttttggagatacacaaatgggggtaacctatgtgtttgggagttaataggggtgagtgtgcgtccattaagttgtgagcgcctacgtttgttgtgtgtttcaaaaaaaacattcataggggtaggctatgtatttatgcattcataggggtgagtgtgcatgtgttgtgagtgcctatatttgtaatatgtttctaaaaaatatcaaacattattgattgtttttcttttagtttaatatctaaacaatatgaaggggatgggcagtgttgtgcgcatgtgagggcgaggaggaggtggaagagattttatttttgtaatttttctaaatgatttaagtgatagccgatgatggggtgcttcacttttttttaagaatttctaagatactttctttgctttataggacgtggcacaccacaattcaagattatgtttaagaaatagatctaatagttaaaaataatggatacatcaatttagttgtatttttaacttaggacatgatagagagtgacttatgaacgctcgcgagggagtttaattaatacatatttttaataaatttttggttgttaggatattatttttttaagagatattatgggtcctagttttgagttatatatttttataaatacatttaattttaattttagatcgattagaaaatactttgggtgttgtattttctaattaaaccacttagattgttttaaattgttctagtcgaagtacatgttattaatcagaaggtttaaaaatctacttgatattttcttcaaaatgtatgaatcggtgaacaatagttagtccgtagtatatatatgacacaaagtaatgaatttctttaataatatacttaacttagatcttcagttttaaattttatagtaaataatctaatggtgtgcaccaattaaaaagtagctatatgatttagataatatagttgtttaaaattagttttcataaaacatttttttccatctaactaaaagagaaaaataggggagaaagaaaataggtggggaggcacgtatgtactgaatgggaggggtggatatgcggggcttgttttcttatccttcctttttctatttgataaacaaatctaatgatagaaaataatgggttataaatattttttccatctaacaaattgatgaaaataggagaaaaataggagagaaggaaaattggtgggactgggaaggtacatactggttggagtaagtacaggagaggtttgagatatgggggccttttttttatccttatctatttggataaataagtctaatgatagaaaacaacgggtccactgcatgttagtgaaaatcgatggacggatgttttgtttattctcagatttttttgtgattttcttaaatttattaaaatgccacgtggtggcataggagcatttaaaggagtgccacgtgacgacttgagagcgtttatagcacatgtgcaggcaccttacttatttagtgatgattaaaattttattataaatccttatgtggaaatgactttttaaaggaaaaagtctgaattacacccttaaactacaacgacggtaagaattgtcccggttatatataaactcatttatcatcattgtttgtaaacatatgagttcataattttttgtttttttttcttttattatacatttgattcacctatgcatgttcatgggtattataagatagaataatctatattgtcaaaattatttgtgctaattattaacattatatagatgagaatgacataattaaaagaagatatgatgtggttccataagacactttcattgaatgtgtatatgttttttctggcaaatactaagcacgtacttgttcctctcttttggagacaaattttttttctcttagtgtaggtgtgcgtatgtgtatttatatgatggatgtgcatacatttatatatgcgctcgtgaatgccttttatataattagtaaaaaaaatattgtcagggttatggataccacatacctaataatagttgactgaatctcggcagggcccaccacatactatgtcctatacggaaacaaccttcggatataggaggagttccggataaggaaagacacccagagttctacatggaaacgataaggactacccggattgtatccatattggtttcattcgttctgcttggacaaggggacacctatgggtataaatacaagcccccctaggaggacagggggacacccaccatggaggatcaacacccaacacaatcgacatagaagccacaatatagaagcctacatacgccaagacacgccgccggatatcgacttcagggataagcacggctagtaccctacggtgtctctggatactgtcaggagagacgaaagcgctatctctgatctcgccggcacggattcgaggaggaaggctaccctgttgtcgactacgagtcagatcgtcagaccgccatgtcgacaacagttagataggctaccccaaatattgtactggtgtgattatcatgaataagagcaatactggcttcggccaaaacgatgtagggttattacctgacaattcaggggcccgaacctgtataaaaatccctgtctccgcctcttttacctcagtctcgcgtataccctagcaccaacgatccccataccatgcaaataccagaattgtgacatcaaacatggacaaatactttttagaaaattagtgagatggcgtgaagtggtgctgtggcgacgtggattcttcgacaatctcgtcaggagtggtcgctactcatatgcacaattcgaggaaaatctcatagctgcaaagaaagaaagaaagaaaactacttgatgcagctgatcgtatacacactcttcttttttttcctttatgataactctggtgtacgtacgtagtgagggattacttgaatagatatatataattgttgaaataatatatccacgggttttgtataaataaatagctagattctacctttttatatatttttcttatataagcacgggttatgtaatatatataatacttaattaatcttacgccgatgatatgctttattttgtgtgtcctagatatgctcatccaatgaggtagcccaaataattcctaaaagataaaatgacatccacatgctgtaaatatatatatatatatatatatatatatatatatatatatatatatatatatatatatatatatatatatat

SEQ ID NO: 39328 - DNA, 20597 bp, Oryza sativa
gcgttatgcggataatgtgataattggtcatgcatgttaattaattaggggctatattaattcaactttgcataatttctattgctaacagcaatataattaaccacaccgataatctcttggcattttatattgcaaggcgactcgatgtatataagcacgtgtgatatttcgcatttcatgtctccgcaatactttttttaattacatgcgttggcgcgcacacacgtgaaaatataactctctaggacattcttaagacatacttcctccgtttcacaatgtaagtcattctaatattttccacatttatgcattcattattaatatcagtatgaatgtgggaaatgctagaatgtatctatctagatttattaacatcagcatgaatgtggaaaatactaaaatgatatacattatgaaacagagggagtaaatgataattaaaagatagatccatgaagtaattatactagtgatgctgttggtaacaaaattcagaaattaaagaccgtaccaggcatgaaagcttagcattggttggaaagatgtctgagccgtactattctagccgatggaatcaaaatcatgttctctctcctaagtctaaacagctggaggcacgacgctctgtcctttgtttcatggatcatgccaagattgttcgtcacgtgttgcttaactgaattcaaggccatggggctagaatttgttgctggcaactttgaattcctgtgtgtagggccgaatcaagtctatctactgcatggaagaacaatctactgccaatattctaccatcttgataaggtattaggaggtatcacattttctattataaaacttatatcacatccttataaaactatgtatttcgagttatcaaaatttgtaaaattttgttacgtataaatatttttaatattttccaaggaccgtaaaatttatccccttttaaacctctgaaggtacatggattttaaggccaagccaaagaaattaaaccttggagttacaaaataaggccatatattaagaaacaacaatagcaaaaatgtaatgtttgtttcgttacataaatgcaaatgtaacactaagaattgcattaagcattcgtcctaaaagagtattaagtaaagatattatgtaaacacttactgatatcttaaaaagtctataatacccttgtaaagaattcttcaatgttatattatcttatatgactaactacttctccattcttattttgatcaattcctagttcccttcctaagttaaaattggccatttggtaattaatcttctcctatttgaaaaatggatttatttgctttttttaaacaacttctatatataattttgttaaaaaaacatatcatttaatagtttgaaaagcatgctaacggaaaacgagaaaattaaaattggagttgaagaatagaaccaggcctttgtagtatatacttataactaaatatttggggtcctgttctatcgccatattaaacatgcttatacacagcttaaatgtttttgtttttcacttatggtacaaataattataaatattctaaagtatgccagaatacgatatacacatggagaaagaaaaatatcagattagacttgaaaaaacatagtcacatttgcaatttgaattttttttgtccatgcatattgaatttgattttgcaagtttatagggacgtctacaatcaataatccaagttttctaatgtttctagaaaaaaaaatgtaagaaacgagggcttaaaatctccatcctattatcccagtatcaacggaaaaccatctagaaacattaatttgaaccatacaatatgctttcattaactttgacatgaaccaaaataaagaatgtaagtaggtaggtaggtaaaccaggacaaataaaggaatatatgataattataagctgcaagaaacatgcacaccggctcttctgatagggctgcgctgaaaacatgtcatcaccggttcctatcatgaggtaatcgatcatattcggtacgtctctctcctctcctggagtaggcagacgcaatcttacattcttacctaaatcactttctctaatccgccattacagccatgaattggagtaaagcagcttggtcagctagcactcatcagcaaaaggtcttatgctttcctacaggaagaagcagccacatgaaagagctgaaaaaaacagagcaagaaccacttcctttcggttttctagtgtagcactggcaaacatttttttcactaaccaaactcaagattagtcggctagctagtgattattgcagaatggttttgttaagaccaccctaatctataattaggagttaggcttagccaaaagtttgatcatggaagcacaatcacttcatgtctgcattcgtgttacaattttttttagataatggaaatggattacatctccggtttctgtcataagacacacagccataagtttaatagtaataaaaaggtaagataaaagtaaatcaaaatgagaaataaggtgatgggacaaatccccaactctcctttattattgactagcgttaaatcacataaaatattttagctagcaattcttatagaactacgctacccatagtggaataagagactcttggctaccgattccaagagtgtagcaccattgcgcatagtattctgctcctcctgtggtagcattgtagaccagaagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattaccgaaaatgtttttggtgttacggggtgggggatattaaaagcaaaaaacacacatctccaaacaaactaagcgacatgacactcaaagaaaagatgttggattgtctcttgtgcatagcagaaagaacattgtttgtctccccctccccccaatttcttttagccaggttatctttcgttagaattactttcttgtgaagaaaccacataaagaccttgatctttagtggaattttcaagtcccacagaattctctttttatccaaacattatagttcatgatcgcggcatatatagatttgacggaaaattgaccattcttatggagcgaccatacaaagcagtccttttcatttgacagagttatattagctagcctgaggatcaaatcgttccactcaattagcttttggccaacaatagcccttctaaaagaaatatttagcggcgttgtgctcatgacctctgccacagtagactgcttctttcgagccacattatataatgtagggtattaatctttgaaagcacgcgatcccaaccacatgtcttcctaaaatcttatgtttaccccattgcgacatctaaaagaaccaaacctaagaaattggtctttgactttcattaaaccagcccagaactgagaaatacctatcttgctggacataccagaaagaggtttaccctttaagtattaatttcccaaaaggtcttgccataggccttcaccattaaacaactagaaaagccatttgttaataagtagctattacgataacagagaacttttacgatgatctctactggtagtatcacggacggcacaatcaacggcgggcgcttcaaaaacgtgaagggaagtgggagtatttaggacccttcccagcaatctcacccatccctccccttcccctgcttcggcagctgctggtgtggtgatacactcgcctagctttggccaccactaatctctgctctgctttttctcctctgctccactgatcatccaattcttctcttcctgattggccattctgattggctggtgacatgtcgaaggtgagcctttcttgctcttggattctgatcctgattagctcgtgtagaatcaggatcatcatcttttcttcttcagatcccaacaaccttttttcttgcttgtcttcctgaattgtatcatgttcaggtgtttgtgattcacacattgccaaccttaaccctctgtttcacatgttgctctgctgcagaaaattgtggtgaagctggacctgcatgacaacaaggacaagcagaaggccatgaaggccgtctcctcggttatcggtacgaacaatcgtctcgaatctcgatcgatgcatccaccatttctgtctgtgattctgtgtacatcaacgaactctctgaagtctgaacatatgtctgattgattgttgtgtgtgcgtgtgtcaggaatcgacgccatttcgatggacatggcgtcgcggaagatgacggtgatcggcacggtggatccggtggacgtggtgagcaagctccgcaaggcgtcgtgggcggcctacatcgagtcggtcggaccggccaaggagccggagaagaaggaggagaagaaggaggaggccaagaaggacgccggcggcggcggcggcgacggcaagaaggaaggaggtgacggcaagaaggaggagggcggcgacggcaagaaggagggggaaggcaagaaggaaggcgacggcggcgggacaagaaggagggcgaaggcaagaaggaaggcgacggcggcggcgacaagaaggacggcaacggcgacggcaagaaggagggcgacgcgaaggccgccaagaaggaggaaggcggcggcggcggcggcgacggcggagggaagaaaccagccgcggtggcgccgatgccgatgccgatgccgctgcaccacctcccaccgcagtacttcaacatggagtacatgaaccagtatcaccgccgccgccgccgccgccggcctacccgtacgtgccgccgccgcagtactactacgtccgcaacatgagcatggaggagaaccccaactcgtgcgccatttgctgatcgaaaaaaaaaaacgccatggcaaatgagcaccatgaatgctttgcatctcaatgcatgatctgtgtgcacttctgcagcaggtaggcgacgcgtgcgtgcgtacacgcttgtgttcttgatcgatcggccgtgatgtgtatagtataagatctcagtgtttatgatgagaagaacaaattaagtttgcgtgatcgaaccagtacgtacatagtagtaagttcgttttttttttcttttcgacaaattcaaccaacctcttcatcggtggatatatccggttaatgaaatatatgatgagaccaacaaagtttgcaagatcaaactagtatacatagtatgtttacggttttttcgacaaaggaattcaatccagcttctgcaggatgtattttggccgaattaagtactaccttcttctcaaattttatgggtaaaatctcttatattttaagacagaagatttacgtacaatttgtaattggaaatttgtgatgctacgttctgtctgacccaggtgcatgcttcctactataaccacaccatcctttttctctaaaaaaaaccacaccatctttttctttcaagcaaagagaaccagcagtaggagagatagagagagatgggcatgagagagtggggaatatgcagcgcatgatagatgagtggtcatgcatgtggtgggtgctgttcagactttgctttctagctaggagcattagaacatcaccaataaaactttggcattttctctcccaattgtagctcgatgcatgtgtattaccagcctagagatatggagcatattaatcatgtttctacagtttcttgagaagaaattctcttggcaagaccagtcatggaaaaagttagcatctgttggcctgaaagatctctgggccgtacgatttatttttttttgaaacctaagttggaactttgttccacttttatatttagaagaagagaattgacccagtttataaggaaaaccgggcccgaaaaccatacagttgcacggttaattacgggaaaccggctaaaacccaccacacagaagaaagcaagagacctaactacaactagcatcgacggcggagcccaattgtaccacatcattgtcaagctaaaacacagaagcggcctaaacagctctaacatcacagaagaggtgttatcgttgccgagctggccgcccaagcgacccagcagcgccgacttcacaaccgcagcgacactggagccgcgaaagtcaccagagcgaaaagcagctccgacatctaacaatggacatcagccaagccaccaaagagccacttccttcacacggccagcaccaaactccttggaagagactgcaacttgtcatcgtcgccaagcatcgccgcaccccatcagcgagcagctccgacttcatcagcagaagcaaccgaagagcgtgtcgcccaccacaataacgaagcggacccaaggaggcgaaggcctcgccgaacgccaaggtatgaaagtttttgaaccgaaaaagaccctccacggtcatcgatgcataggaactcctccgaagcgacgcccccaagaaggacacgacgcgtaacgtcgccgcctctcgtccgaaatcggaacaaggttttcacctggagatttgtgggaaatatgaaagaatgccatgacaatgcctccaaggaggtttacggtgcccatgagcgtcgtcgtcgttgaaccggccaaaggcacggcaaggctttcgccagcgtcttcacatcacgcacacaagcaccccacatcaacgaccatggaatagtccatgacgtctcacaagcagtcatacctcgacgtaaccaaacacgccaacgcatccacatccacacatcacgagcaggaggctcgccgccagcgagcaaccctgccggagcccgcctcgacttcgcgcagccgctgagcttgccagagccctcttgagccgtgcaacgccgccacacgcaaccgccgcccacgccacgcccgctcccggtctcctcctttccagccgcccaactccttccccgccttcatatgctgccgctaacgtcgacacgccgtctgtcgcacggcgccaccgtcgccagccaacaccaccacggccgccgccgtcagccgccgtggtccaccggtcatctccccgccaccatcaccagccgcggccgccagccgccaccatcaccggtcgctgccaccagccgccgcccgtgcagatccggccggggtggcgcggatccaggggacggagcacgcctcggtgccgggctggagcgagacgaccaggacgacgcggcggaggtccctgccgtggcgtcctggtcgcgccgcggtccaccaccgacgtcgagtcgtcgtggtccgccgccgacgttgccttcagtcgccgaggtccgccgccgtcgtcggcaccgtcaccgtcaatccccccgccggccacccccctccagatccggccggatgtggcgtggatctggccgccaccgccgccgccccggacagctcccccagccgccgagcgtggggtgggcgaggcgagaccccgccgccgccgtccttgcggctgcgcggctttgccggcacccgctcgggcggcggcgaggtggaggagggggcggtgggaggaggaaagcggcggcgcgcgcgtcgcgccgcgagctgcccgggggagggcgacgcgagggcctatctccctaataagctgttcgccgtacgatttatagctggtaggaatcaaaatcatggtctcctatcagctgaatgcactccactttgttctttgtttgctgaaccataagtcaaacaccatttgtttaagattttgacagttcttgctctttggagagctgaaatttatgtgtaaggggagagtttgtgtctagttgacctatatatactccctacatccataatttacaattgtttggccttaatccgaaattgatgtactagttatctcataatcaactctaattctattttctatacgccttgccccccaataaacattccactcaccactgtggaaaaatctaatctaattgttgtattcatgttttctctaatctattacattgatcctcttatggggtatatatagaagtacataagggatagagagtaccccctccattccaaattgatctacatatagttttttgaggttattgctaaatgatctacatatttgtgttcattcatgaagtatattcgttatttgtgcattggagtaaatggatattgatgcatgcatccatgcacataagtatttataacccacatgcaatatcttggtttgctattggctaggaaatagtggggatggtgcatgcatagagtttgttgctagagtaaatatagtatgagagagttattagctttttttggttttggtgtacctatgaaatatgtagatcaatttagaatggagggagtacaatacaagtaagagtcgatttatctctagaattctatctctaggactctatcttatatctaggattctatctctagaatatatcttatctctataatttgtatttgactcttatctttaaccgtcatatttatacttctaacaacgatcacctcttgtttaatgagacatcctagtttttttctttatccttgatccctcaaaaaggacaaaatctcttcttatattacaggaaagaggggagtaatatatggtaaaactcatcggaacgcttgagtagcgcgtgcgcacggtggttattatatcctactcctgatccgtcccagaatatagcaacctaaaaccgtataggacatatactagtactatgaatctagacagagagatatccagattcatagtactatgatacatcccatccggtcctagattgctatattttgggacggaatgagtatattctgggacggaaggagtataacgttagcagtttgatcctatcggatgctaccattagaaaattgtcttgagccaaatattataattcttttgaattaatttaataaattgttttgcaatttcaaatatttttaactgattttctgtaatttctctcaaattctgaaatttcagaaatcttaatttccagcccccatctgactgtttttatcatttccttccgcaacatctcgtgtgaacatagcacatactctactacgatgacacattacacatatatgttactgaatttaatttgctaattcagcagttccatctatgatgtcatcgtttagcacttaatttcccacatgaaggatcacgctaattaaattgaagattagtagtgcgcagctaggctgtaggaccacacactaattagtagtacgtgtgcatgcactccctagaaaaactgcacacggtaaccacacatataaactatgcatataagcttcctaagtagggatgtaaacggtatgaaaacttttcggattccggacctattttaaaaaacagaatacgtcggttggaacttttcggaaatggaaacgaattcggaaatattttctcggaaacgaaatcgaaaatgataagggcagtttctgtcggaactcgaaatcggtcggaaaactttcctgaaactttctcagaatttctagaaattttgtgactgaaataccctggattcttttttcttaagcactgaatagtgaataccatggtgattggttgttattttttaaaaaatatttgttatgcaaatctaaaattacataagaatattttttttcatgcattgggatttatcaacagcattactctcttaaacatagataatttattccatagattgtgttttgtaatgtacgattggtacttaacaattggatttatataattgtgttttacgatgaattgttgaccgttgagacttgagaattggatttatcactttaagagattttttattccgataaatttttgttaccgtatttgcgccgattcatttttgctccgttttcggtttcgataatattcgattctgttttcgtatccggggttttcgattccgaaaataatatgaaaacgaaaacgataaagatggtttacgtctgtttccgtaccgttttcacccctattcctatgtataccttgtacctaccaattaacaaatatcccagaaaattctaaaactaatctgacatgtactcttaaatagtattacacgtatctacaaattcgtatatttaaattcattatatttttgccgtcaaaaaaaagaaaaatctaacggttttaagagtgaaaatctatcagaattttatcttttttttcgtctaaaatatattgagtttgaatatgacatttcacatataggtataatactactgaaaatattatctatttttttcttgaatttttccttaaatttattagttgatgtgtatgaaacatgcacgagaaacttgtgtcatgttccatgtatataagacttatggattgcaatctaggtttgtttaatttaataattatcacttagcaaagaaagatgtcatgtcatcacaatcaccagggcatcaaaaggttggtaggttttaatttacaacaaaactaacagaataaaatatatgttttgggggaaagtcatatatatgaatgcattcagaagcgagcatgcaaggttgtgatttgtgtttagcgataaaagtgttcatgaaatttttcgaatgttcgattgtccttttctatataaactaggaagtagcctgtgcattcgtacgggcatgcatcgtagactatgtttgagaacttataatgatgaaatattaatctgaacttataaaagatcattttatttatttggattatttgagcatatttagaaaaaaaaattaagtaattggactattttctctaattaaaggaactcaatgttttatgtagtggctcagactattcatattttagttagttattttttttacgaagtgtacgtttaatttagctatacatgtttcaaaacatagcatggtgcgactctatgttgttgagttatttctttttcttttggcaaattaaatatgaaaattttattctggtactatattgatttaatttagctatgcatgtttgtagaatttttcataatgacataatatttattgtcaaaattttaaggtatttagatgtggtgcaaagtgcatgggtggactgtgcccaaatgctataattcttatacagtaaaatataggcatatataaatattacattgttagtttaattaatagatagagaataattagatagaaatcagacatgtataggttataaaaaattgtagttgtttcaacattgattgtttatcgtctagattagtagctacaaaaataaggaatgggagggcagtgttctctacatgtggaggaggtggaaggattttagtgaaaaccaatgagagatgtttcttttttctcagcatttcttttattgtttttatagctggtaagacatgacacgtgttgtcttatgtttttttttcccaaaaaatagatgacatgtgtacttatggttctttcaaaaatagatctaattgatgaaaataatgaaatccatcgagttaagttggatcgttttctattttttgagacatgatacatggttacttacaagtgcaatatgggacgtttaatcaaattttatcaagtagactgatttaatataacataatgcatatagtcaaccttttcgaaatgtctcattcctatttggtttccatgcaaaacataggtgccaatgttcaaaagaatttaaatttataataaaaatatggataatatggaacttgaattatttatttagttataaataaaacaacaattgaaactaactaaaaataagatacaacttttaaaattataatcattaatctttctaattattgttttttcacataatgttgtccattgaaaaaaagagaggatgtgaagggagagaagcagagataatgtacgtatggagacgtcacttgaacacatacatgacgtgtgaaggggtaggaagtgggtcttttccgtttttatattgttaagatagcagtagaaaataataggtacaccgtgtttaaattaaaataattgatggttaggtgtattatgtaatttctttaggatttctaggatttattgtatactactggagaaacaatctttggtcggtcgccaagaaaccacaataatcctagttcgaatagaaatcgggactaaagattatttttagtcccggttaaaaactttttgatctttagtccccagttgatgttaccaatcgggactaaagatcatttttagtcccggttcaaagaagttattgggtcgagttaggccccaattatcttagatctttagttccggttctttatatcaaccgggaccaaaaatactcccgagcgcacgtcgagtcctctcttatcaataagaccgataaaaaccatttgcacttcctctctcattataaaccatctccactctccagcctcctcgatcccatctcaatctcaggcgttctccttctcgatcggcctcctttgtccgatccccctctcctctccccttcctcccacttcccctctcctccccctccccgcctcctcctcctaccacggcctctctgggtcagcggcggccggtcgaggtcggcagcggtggcggccggctggccgggctggggaggcgcgcacggcggccttcggaattgattttctttttttgaggaattgtgatgattgtttttgataatttgttatgtgattaaatgtgggaaaaaaatcaattacacagtttgcgtgtaaattgcgagataaatcttttaagcctaattgtgccattttttgacaatgtggtactacagtaaacatttgctaataatggattaattaggattaataaattcgtctcgcagtttcctagcggaatctataatttgttttgttattagacaacgtttaatacttcaaatgtgtgtccatatatccgatgtgacaccccaaaacaaatttttttgggaattaaacctggccttagtagagttctttgtggaggttcagtcttttatctttatgaatttataatcggatgaattcatattgttttaatttacttaatactatcgttctaatttatttgtgatggtttttcaaaatttgtgatgtaattttttttagaatttatgatgaatttgatttggggatttatctgttaggggatgtaatgattagtgaaatccatatgaaaaaaaaattaaaaaaactgccaaccgccggttctagctctagcatttttagtctcaattagtaacaccaaccgtgagtatagggggttacaaaccgggaggaaagaccatttctccaccagtggtagtgtcacatggtggcttaggtgtgttcgtaggagtcccgcgtggtggtttcagagtattttgtgggaattttagttgacttttagcatataatagatagatatggcgcaagttgtcgaaatgtgcctaatatatatctacatgtttctttagggaatatatttctacaagtaaaattataccggtgtaaactacatttttctgacattgtagaactattttagttacatgccagtgaagttattatatagcatgaaacaatataataatggtcactttcttttcataatttttacaagctaaattatagttaagaggtgtattaaattctaatttgtgattttagtcataataatgacacaatagaacatgtaatttcatccgatagcaaaaaaaaaaaacttccttaaaagaaaaacggagaggagttatgtacatgcatatgcacgggaagaggggatgcctctttgtaagaaatagaaaaatcaatctaatccaagtatccaacggcttggagtgatgggcctattaatattaattttagtgaaatcaaaagctgggtttttttttcagatttttcctaatttattggagcgccacgtggcattataggagcatttatataagcatcatgtgacagcttagaagcatttataaaatttttcacggactttactatataatagatagattgaatattatcgatataatttagtgaaacatatttgtagaattatttaaggtgacatataatataccaaccggagatgaggggagagagggagtatgtacgtacagaaggccaggaggggaacatacttgtggtggggaccggtgtggagaggaggattttatttattttatttgatctaatggttaaaaatgttagacccaccaatttaaaagaaaatcaacggttagatttttagactgccacttggcgtcttagaagcatttgtaggagaacacgtggcggcttaggagcgtttttaagaagtttaatggacttttagtatataatagatagataaatggtactgtttaagaacttttagctatctgtaaaatttaaatgttctattctttttagcatcgttttgatatcaatataaaacacgaatattagaaaatgatctaatatcatattgtattatttcgttaaatatgatcgatcgccgatcgaccgaggatcgttgaggctaccgattctgacagtcttcatctctagttgtggtgtccaaatttgcatctgtattttgcatatcccagctgctcgatctcctagcccaaatcaaaataatcaaaacaaacagatggtgttaatcgcttgtcaatttttgcggtgcggatgagtcggatgatcccgacgtctcgtcgtcccctgacgacagccagtcgtccgggccggcagtgacagcttatagctctttcaacgcctcatggacctaatgaaaaaaaagctgatgatgaggtaaaaggcgacctatccttttcgtttcgataaagaatgatagctttcagcctgatccagatgtgtcactgaactaggcgttgttaattgtgaatttatgtgggtgatgcaggttttactattaaagaatatgatgatactgtgaagtcacgttcagcttctgatcatccactcgcaatatagtactatataatatgagaacgggaaattagcttagctcgggaaatggagcgacgtgtggtgcctgcgtgcgtgcgtgcagtggactggtcggtgacgatgttgactgaagaaaatctcagagacgatggagttgaaaattacctctagctcatgcctgcggttttttcagccgcacctgcatgccgctttcattgtcacacttgcgagcgtggagataggccggtaagaaataacagcacgaagaaaaattgccatatatgagtgtggtataagtaggtggctagctgaaaatatacaacgttcagtcaatgcccacgttaaatacttttgaacggagaaattatatcttaggctctgttccttaagattattcacactgattatttgttttatgttttgaaaatatgttttccaaatgatctttcttctactatatcgcttaattagaccactcattttaaactatttgtatgaagtatatattttaaaaatatttgatttattcctatagtcaagtagataatccattacaataatttgaaaagaaatggcccttaatatatcttaaatgtattaaaaaaatagacctatccaaggcatgaccttaaatacctagtcttgtttgtgaatgcattgcagagccagaaaaatatcgagagcttaggctaatctaagcatatgcatggacatggacatatgcatattcagatttgtaccaggattggattttttttttacatgttagatggagtcacatgcaaaagagtatatagagttcaagcatgtaaaatttcttgatccgtgctttaacctcatgatactgcgaatcaactactcctatgaagttagcggacgttgacaattgagtgtcccgaggcagtctatgtcagaatgtcagatgattgtagtgtaccgactcaggggctcagggcgatatcactgacagacagcaacaaagcagccactgttttctgctgttaaatcgtaaccaccggctggcgtctgcatttcagatcgatttctgtcatcgcactcaagcaaaagccatttttgcagcgtcggattcgatgttagtgtttcacgggaaggcgtacggtacttctttttgggacagtaaacatcggcatttgcagcagtgttacgggtacgtcctgattcctgatggctaactggcctttttcgtcagtaatcgcaggagtcaccaacataatgatggtgcacaccatacgtaccagtttaccatgggaatgtgggagtcgcatccaaagtatttccccattattttgaagttgtttggcggaaatcaaggttgggaagaaaagattttcctgtgtataccctaattaaatgatcaatggattaagataggagaatagttgagattaagatagaaagaaatttgaacgaaaaataattggtagaataaggagttatttgaatgcttatattggtggataaattttaatcccttaacttatattgatgaacatatgaagtagtttgacatattagtttcagagggattttatgggtgtgtttagttcacgctaaaattggaagtttgattaaaattgaaacaatgtgacggaaaagttaaaagtttatgtgtataggaaagttttgatgtgaccgaaaagttagtagtttaaagaaaaagttggaaactaaaccagccctatgtagcatgaacgaatcgaaacggcaacctgcagatgtctcattttgattttaaggaaaagctaccggcaggcacatccatgactgaatattggttcagactgaattcagtagtgcagatcattggcattatactaggagtaccaatttagcaacttgcaataccttgaagaaacaggacaatctgcagatgtcaaagataaaattgatctgtattccgcggagttgatgctctggaaaggttcagtgaaatgccaatccaacttgttagaatgtagattatcaccagaaaattagttcaggttaagtcagtcaatttgctttatttctgcagtcttgctttaacctttaggatggtaagtaataataagtacggatcgaagacactatggttggcagctcaagtatcctctggaaactaaaagagtaaaaaaaagttaggtgcagatggaagcacgcaatattcttagctgcaagatttgcaattaaaattcaaaatcagtctatactctttagaagcacattaattcctctttgtttaaaaaatagagaagtgtgctttcagaaggaatcgagatggcaacgtactctgcatttctggaacctgcagaatgatctggtaaactggttctagatattggttacacattaaattcagtagcgcagatcattgattcatctagccattgagataaggggctccctacttatatattaggtcatttgcccttccacaaccaatgtgggactattcaacacatccggcccaggtggcgttggccgaggcccaataaattaaggttgattcatcattcatgggcattgatatatccggcctaggtggcgttggccgaagcccaataaattaaggttgtccggaccccaacagttcttaggcacacccactcgggaaaatgaccaatctccctaaaatacagtccaatagaggaatggtggctctcccttttaaggtggcttaatcctcccaagctaagcaaggtgggattattcagaggctcacacggtcgccgcccaactacaactggaccacttggccccttattgcgtctttgccagcggttaatagtggaggatatcctcatcaggcatagtacttcttcagataataatgacaatttgcagatgccaaatatacaattatcttatctgtattccacacagttgagatgctctacaaaacttcagtgcaatatcaaagaatgttggcatgcagattattattagggtaagtttatcatcattgagaagatacctagagatatcatattttctagtgtaaaatttgatacttctatatactaattcccaaaagtaccaaaatttaagtatctgaaggtactttcttaatgaccataaaattcctcttattattaactcttatgaacagaatatgagttcataacttcaggttaagtgggttattttgcttcgtttcagcttgaaaccttcgatgtgttgacgtttttttacagagtttactcagagaactcggaacatggtgaatcaattaaggcccggtttagctgtttagttcaggaaaagaaaatttttgggtgtcacatcggacgtttgaccggatatcggaatgggttttcggacacgaacgaaaaaactaatttcataactcgccttgaaaccgtgagatgaatttattaagcctaactaatccgtcattagcacatgtgggttactgtaatacttatggataatctaatcatgaactaattaggtttaaaagattcatctcgcgattttcatgcaaactgtacaattagttttttattttatctatatttaatgctttatacatgtgtccaaaggtttaatgtgattttttggaaaaaaaaatatgggaactaaccaagccctaaaccaaggtagagtatactgcaatatgtacagtaaattaacgcattcaggtttcttgccgccagtaagtcaaagtatgataactccatcgatcaagaaagacgacgtgggttagccacataaaatccaagcagaaccgtgtattagtacatgtcttcaattgtccattgaaacaaaaaagagtgaagtagcacagtaacatgaatcatgcgaattccgaaagggtaaaggaataatacctcagatatcatataaaaaatgggcgatggaaagtacaagctaacacacatactagtatttcttagcgggagctgcaagcctgtaagtgatttctgcactataggaagttatgcttcggtttacaatattcaggattatacagctatctcagcagcacagtaccatcaaactctccctatcagccactcacttcattgtaaacatgatagaggactaaattaaatacgcataaaaattaaattcagcagtgaagatcataagcactataacatgattaacacgttagtaacttagcagggtagcagtcataaagaaacagaataatctgcagaacaaagaagcatgaactgaaatgcaaatctgttgacacgtgtataggaaactaactgaacggcaattcatcatcttcagaatttcttcactgaattaaggaatccttcatcagcttacaccagcaagaaacagtttctacacgagatcaccatcgaactcagcgagaagcttgaaagaaacaagcaacacacagaactgatgaaggcatcaagcacattgatctctaactaatcacctgatctggtgcccaaacttgccgcctcacttaagggagaatcctcaatggttggtagctcaagtatcatctggacaaaggaaaaggataggtgctagatcaaagcacacaatgttcttaggtgcaagtgattgttttctgcggagggactctagaagagtgactctagacagtgcgttgcggcttgcgttgtgctgggccggtgatctccaagacaggcctatctgaaatctcatagcaggccaagatgggcttcttttgaagcgagaaagatccatcggagcattttgggctggatttcttcaggtccattaatctgttccaagccaattgcacacaacacatggtgacatggagcagtgtagctgggttcgttttgagcttttttttttttactttttaaatttttaattctaaaaacaaactctccaaaaacttagtttcaagtacgaatctttttgtcatgccagtcgaactgactacagtgacgaaatgaagcttccatgctgacgccctcttgggggtgtgtattgttgtttaacacgcttggcggggtggcatggtcaaaacgtttatgaggatttatttttaaattaaaagtaaaataataataaacattatcgttggaatgttttagtagggctctaggtcctatattctggtcttatatagcaggccggtgcttaagcaaatggcagtccatttagaacattttgaagaccatctcatattcattgcaaaaattaaattcaggagtgcaataaccgcactgcccatcaatccatacgaaattattcataagcctctgatccactatcctggctgatcaatagagccatgcccactcacccacacgctttttattttttctatctttttaataatggaatgaaacatcttggcttttgctcaagagctatagccaattattacaaggttcacacaaaaacaaactcacacagtgagtatgtagccagtagccaaagtaacaaaaccaaaagtagaagcaaactaataagaatcaaacaaggtaaagacctcataactactgaattctattgatgaatctccacttgaagttggcaaagagcttcatgatcgtcgactcaaatatacgacacgcatcttttattagcttgatatgatcatcatgtctttgtaactgagcccattcctagagccaatatgttatcctgaaaagtgcctacaaataaaattttgaaggtgatctatcaaa

SEQ ID NO: 39329 - DNA, 3500 bp, Oryza sativa
gggagaggaagaaggaagaaggggaggaggcggataccgagactaagtctcagttgtttttaaggagagaaaaaaggggaggggataccgaggagatatcggcagtttattttggtcccggtagatataaacaaccgggactaaaaatagatctttagtcccggttgtttataccaaccgggactaaagataattggagcttaactgtacccaccaacttctttgaaccgggactaaaaataatctttagtcccggttggtaaatttttttaaccaggactaaatatcatctttagtcccggtttttattgcaaccgggactattgtggaatttggtcgaccgacgtttctccagtgtgcatatatcttaatcattgttaccccgaacagaacatcaaacctccttctgatctttagtcccgatttttattgcaaccgggactattgtgaaatttggtcgaccgaccaaagatggtttctccagtgtgcatatatcttaatcattgttaccccgaacagaacgtcaaacctccttcaaattgaataaacaaatcgcacaactaaagaaacgtgcgtacgtatccatttttttaactttccaggctgaaggtataaagcaaaatattacgtgaatttgccctttgcgtgctcgcagtagtgacgccccactgaccactgtacagcttatacctctatatatatacatacacacatgcacacacactacacacacaaagctcttggagctgcatctgcatgcaaacacctactatacaatattacacacagtgacacacactatcggagaacgtaggtaagtaagggcttacggccagcaacgatggcgccgcagaacaaggaagacaaagcatcggccgccaatattgatccaaaactgccaatcagcgagagcgatgaggcgagggcacacgctgccaatgtggcaaccgacaaggtgcggtgttggcgaacttggcgcggcttctgccgacggggacggtgctggcataccagtcgctgtcggcgtccttcaccaaccagggggagtgcttccgggccaaccggtggctaagcctcggcctcgtcgtcttcctctccgccgcctgcgtcttcttcgccttcaccgacagcgtcctctacaaggggaaggtctactatggcttcgccctgccgactaggctcaacctcttcaacctgaacaagaaagaagagcagaagctgttcaaggacctagagcccgagctcgattagcgggacctcggtacgtcgacttcgtgcacgccttcctctcggctgtcgtcttcctctccgtcgtcttcagcgacgtcggcctccagaaatgcttcttcccgaacaccggcaagaacgacaaggagctgctcaagaacctgccgctggggatggcggtgccgtcaagcttcgtcttcatgatcttccctaccaatagaagggggatcgggtcccattgctccaactccgagcacatcgacgactcctcctccaagtctggtaagaaaatcgatggctcctcctccaactctgcaggtgagaaggagaaggcgaacaagcccaccgcgaagaacgtgtagcaccaccaactttggggtggtaattgttaggaaacgataggcgaacaaacgataaaaaacaatagatcaatcacaaaagacacgagatttaacgtggaaaaccctcccaaaacaggagagaaaaaaccacaggcgccagccagcaaaatatcttcactatatctgaggtgaggttacatcgccgcacgacggcttacaagaggtatatatagtggaacctaaaagggatgatgatccgtacattattaggagctggcctttattaagtgcaaatgaatttggatcacaactcaacaaactccaccttgagacaaattccttcttgtagcgtgaatcaatccttcatcctgaacacaacaaagacaaaaaaaaacactttcggcgtcaaatagcctctcgggctaaaccactataccaactaagcttgagcaaagctcaaacttagcaacaggaacaggctttgtcatcatatcagcaggattatcatgagtacttatcttgcatacctttagcttaccttgcgcgactacatcgcgaacataatggtacttgatatcaatgtgctttgtcctctcatgaaacatctgatctttggtgaggcatatagcactttgactatcacaaaacaagttaatgcaagaatcaactccacaaagctcagcaaacaatcctttcagccaaactgattctttacatgtttcagcaatagccatgtattctgattcagtggtagactaggcaacaacaggctgcaatgttgccttccaactcacagcacaactaccaatggtaaacacataacctgtgagtgaccttctcttatccaaatctgcagcaaaatcagaatccacatatccaataagccccttatcagtcctgccaaacttcaagcaagcatcagctgtgcctctgaggtacctgaaaatccactgaacagctttccagtgttctttaccaggattagtcatgtatctactaaccaaactcatagcatgagataaatctggccgggagcaaaccatggcatacatcaaagaaccaacagcactagaatatggaactctagacatgtattctacatcctcatcagtattagcacattgtaaagctgataatttaaaatgaggtgcaataggagtgctaacaggctttgcatcatgcatgttaaaacactgaagaaccttcttaatgtagctttgctgactaagaaataacaaaccagaatttttgtctctagtgatttccatgcctagaattttcttagcagcaccaagatccttcatatcaaactcactactcaactgtttcttcaatgtagtaatttgttccttgctcttggcagcaatcagtatatcatcaacatataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggtactatgaacccttctggttggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccaacaatttgactgaaaccttttgctactaaccttgccttaaacctcggaggctcgctaggagataaaccctcctttctcttgaagatccatttacaacgaacaggcttcttctgttttggcaagtgcacaagctcccatgtgccattcttctcaagagactgcatctcctcctgcatagctgagatccac

SEQ ID NO: 39330 - DNA, 4493 bp, Oryza sativa
cacttttccctctctctctccctcggattcgttcggaaagtttgcccccgctaacttcgccggcgcatcaatggcggccggatcttccgtggccgattccccctcatccggccgctctctccctctcccaacactatataaacgctccccgtgcctccctccaccgtttccgccactcgctgctctctctccccgtcggaatcgagctcgcgccgtcgttctctctctccgccgtcgccgccgagctccggtccgccgccgtcgtcgccccggaccctctcccgtttcggcgtcgccttcttcaggttcgccgcaacctcgccgacctcgtccacccctccgtttcgcccgccgaccgccggaacgccgtcctcgtcgacccgagccgcgccgccgccttcctccgctccggtcgccgttcccgtcgtcgccgtcgacccggggtgagccgtggaccgccgtttcacttcccccttccctcccctctctcgggcgccgctccgccgcgccggtggtcgccggcggcgagcatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccacgtgggccccactcccgtggacccggtccgcgcgcccctcccctcggctgacgcaataaatccgattttaaattaaaatttaaatgaagaaattcgtaaatatccatttaaagagcagataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcgttatcgctttatttaaattcccgcgttatcactgttttatttagccatgcctatttacctttgttatgaccttattattattgttattattattattaccttgttcaccctagaataaacaaaaccccaactagtggaccctctactcatggtaccactagtataattttaggtagatgcttcgcttttaattaggtaacattaggcggttttacaactctagactttgggaatattcatatcacctggacactatggaatggtttggttattgtggaattggctgggctcggggtgcatggttttgatagtagcacctcggccatataaggaccggtcttcgggcctctgttgaaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgctcagagtataatctattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtttgggttcacggccttgataaataatattgcatagtactagaatcgtctttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctaggacaaggattaatgcacgcacgtaaggaacgcccgttgggttatttccggtcgtgacatttaccaactgcgttgaaaggttctgcacgttcatggctgatgcatcttcctccctactcaatctcttcgtgggcagacctgtggcaacagttcgtcgccaatttccaaggaacatacaagcgccacgcgatcgaagacgacctatacgcgttgacacagaactcgggtgaatcattgagggaatatgttcggcgcttcaacgagtgcagaaatacaatccccgaaatcaccgacgcttctgtaattcgcgccttcgattccggtgtcagagattgctatactacccaggagttggcgacaagacgcatcacaacctctcagagattgttcgagattgttcagcgatgcgcccacgcagatgatgcgctaagacgcaagaacgataagccgaagaccgggggagagaagaaaccagccacaaacgcatctgagtcaagcaagaagaaaaatcgcaaaaatgggaaaaggaaagctcaagcggaagtcctcgcagcggaatacgcgaaccctcctaagcgaccagacccacaaagtagcgacacaaggaaagcatggtgccccatacacaagacgaacagacattctctggaagattgccttgttttcagaaaatcgctcgagaagcacatcgcatttgaaaaaggcaagcgagtacgcgtggtcgagaagaatgaggaggcagttcctcacgaatcggattcagcatttccagactccgacttccacgtttcacacatcttcagaggctccacaacgtactcctcaaagcgagaatacaagaaagtggaacatgaagtctgttcgacttggcagggggctgcacccaagatgaagtggtctgagcagaagatagagttctcggaaggagaccaccccaagaccgccgtcatcctaggacgatatccgatcatggtcgaacccactattcggaacatcaaggtagcgtgagtcctcattgacggtggcagctcaatcaatcttcttttcgccagcactttggacgcgatgggaattccgcaaagcgagttgacaccaaccgatcaacccttccatggaattactccccaatcatcgtctagaccattgggcaagattacgttgcttgtaactttcggccaagccaacaacctccgaacagagcagatcacctttgatgtcgctgaattcgatacagcttacaacgccatcatcgggagaactacgcttgcgaagttcatggccgcatctcactaagcgtatcaagtgctcaagatgccgggaccgaagggaacaatcactattcaagggaacgcaaaactggcggtgcagtgcaacaagcggagcctcgacatagtcgagcaaacgcccaacccacccgccacgactgagccacccaagaaagtgagcaagacaaacaagacgccgaaaccagatggcgccatcaagatcgttccactttccagtgccaaccccgacaagactgtcaagatcggggcgacactaaacgagaaataggaactcgcgctcatcaccttcctccgcgataatgctgacgtgttcgcttgacagccgtccgacatgccgggggtccccagggaggtgattgagtacaaactcatggtgcgacccgatgccaagccagtaaagcaaagactgcggagatttgcaccagaccgaaaacaagccatacgagaagagctcgacaaacttctcaaagctggcttcatcagagaagtactttatccagagtggctatccaatccaaccatggtgtggaaggccaacggaaaatggagaatgtgcgtcgacttcaccgacctcaataaggcatgccccaaggatcacttccctctccctcgaatagaccaattggtggattcaacagccggttgcgagctgttgagcttcctcgacgcttactctggctaccaccaaatcagcatggcaaaagaggac

SEQ ID NO: 39331 - DNA, 20343 bp, Oryza sativa
aagctgctcggattccttgtttttggcagaggaatagaagcaaaccccgagaagatcaaggcaatcgagaacatgaagtcgcccacaagactcaaggaggtacaaaagctaaccggatgcatggcggcactgagcaggttcgtcgctaggatgggagaacgaggacaacctttcttcgctctgctgaagaaacaagacaaatttgtatggacacaggaagccgaagaggcattcgttgcactcaagcgctacctatcaaacccccctgtacttgttgctccccaacctaataaagaattattcctctatattgccgccacgccatattccgttagcaccgtcattgttgtcgagagagagaaagtacaacgaccagtctattacgtcagcgaagctctccacgacgcaaagacaagatacccacaaatccaaaagctcctttacgcggtcatcatgacatcaaggaaggtatgccactactttcaagccacagagttacagttgtctcctctttctctctcgacgaagttgtgagaaacaaagacgttatcagccgcattgcgaaatgggtagtcgagctgagccagtttgatgtccactttgtgccacgaacagccatcaagtcccaggttgtaacatcctcaaattttaaactaaaatttgacggcatcatgctggcttttgattaaatttgtttggttcaaaaatctatttgatttttatttaaaattggttcaagtattagagcccaagcaatttactctaacttattccctttattctaaactctagtgaatttgagcaaattctctcaaattcaaaccatagattatttctttagcttatcctaatattagtggagatttgctatactctaaaccctagtgaaaccttttcaaactcctagtttgaattcaaatcttttctaggaaatattcaaaatttctgaattctactattcattgcacataaggtgttcggaagaatgtctagcccacctagagcagcccaactccatccaatcttgcacaaagtttagatttgatcctagggaccacaccccactcaaaaaccgtggatttcattgcttcttcctccccttgcacgcgccgcactggcatctgattttgccgcgcgccgtgtcaccgcgcgtcggcctcggggccgtttgcatgtgcccgactgccttggcgcgccgtcgcctgtccgccgccctcagcccactgtcgtcgcaccaatattgacgacgacaaagccaggactacgaccgctgcaagaaatcaccgctcgacgccatgcgcacccgtccaagccaccgccgagttcgatttcgcttctacccggggtgaatcgcgccaattcttgccgcacggtaggattggagatagacggtggtatcccctctcacaattcaaaccattcacccccgagccagccattttcaccttcgccgccgccacgcgtcacgcccggattggcgccaacacgtcgccagcagattccaaccgcggtcaagtcaatccttcgctggtaagtattcgaacgtgacctcccgcctctcaaatcgatcttgcccgccctctctcagcctctgccacctttgcctcatccaaatcccgagctcatccaaggcgatgaaggtgcccgagctcatccgttcctcctagccctatgaataggaccccaatcccttccctgtccagcatcgatcatcaacaaccatagccccacaaccccgaagctctgcttcaccaatccatctcatcaaccaccctcgcccgtcggtcgagcaccttgtgcgcgatcgactccacccctctccatccatcttccgccctaaataacccttagaacacctatatcctaccatgttctagcataataagccctaaccaaagcactgcgtcgagttttacctcgccgcaccaaaccaagcaccgccgcccccacactgctctgttcttcgccgccgcgaagtttttccggccgcaatccgtcgtttcaaccaatctcggtgagttcttctgttacaaccatctacatactacctagattccattttagcaatccctttgcactaacatgccaccctctgagctgccgacgtgagcacggccgccacctatggaggcgctcgtcggcaactatgctccgcgccttgtcaaaggttggcaagctgtcggaatccctctggacacctcgtagatgctctagaaccccttccctagccatgtctaactcttatcaccttgatcactatctcggcctaaccgtgccaccgccgccctagccgctaggccgtccacgcatcaaattaactcctccgccgccgctcgccgtcgacggagatccctagccccctcccctcctcggcgcaaccactttcttcctctaacgctgccgcaatcctaaaccctagcgccgccggcccgacttggggaacggccggaggtagaagaagagaagagagagagactaacaggtgggacccacacacagtgccatttcacatttatttgattttcaaactttagaagcccatatattttaaaatatagatccaatttcaatgaaacttggaccaatattcttctaaaatcattctctatcttttggaccccttttcgctatttttttcattttattttattttctctatttttcttatttttggattttatttaaactcctttttgaatttgaattttatatgtctaaccctaggtcttgaggattcctctgacattctagataatatcaatcaatctcaggacatcgagcaaggcaagttaccatatacctgttgatcatttaagcctatattttataaattatttatttatagccttctattcaatattccattttctatgcataaattaatcatagaaacccaaataatttagtattgcttattttgcttacaatctggttaaaataccctatacttagattgagacaatacgtaagatttggatgatttccgggtggctagtattgtctcaatcgatataagttttactaggtacttatgtcgaacgaacgagtacgaccgcagtttctaaaatggggacagacctatttattaggttaattggcattatggcacctatgtatagtggttcttatttctaagtcctcgcgcaggaggcaactatagccgcgaagggcaactttaaccattaccatgtacaggtaaatggtttgtgatactcgagtataaactatatggtatatttctaaaccctgatcgagatgacgtggtgtcatacgatcagttcccgttaaatacctcgggaacgccataactcctcttactgctgttaacattacgttcagaacatatgaggatacaagttcatggaacaggtgccataactgttaatgacttaatactgggccatgactaaagctgataattatcagcaaatcgtggactgcgggtaaagcgtacatcatctgcagtagaatatctttgaaactattcgaatagccgtactcatggagttgagtaccgggactcatatggtactctggttagaaatataaagtttatatgttttataaattctgctataacttttccagattgtccaataccgctttttgcaaagaaccctattatatgtcaattcataacatatttccatcataacttgctgagtattgtgaatactcatccttgctcttataacccctttttcagatctgggtcaagaggaggacccatatgactattactacgaagaccccgataacttagaaaatccctgagggttttacctcactagtcagaatgtatagaacttccgctgtgtactaattagataggtgagtacctattattgtaaaacccttagtattgtaagactttaacatatgcaatgaagaaccagttatattgtatgtatcaatttttactgatccagggattgatacattaatctcagtcggatccaagttgttagttttgggctccgacacaggtactcgccgatttcgttgccgattggactatgcctgataacaaattaaacaaccaagtcgacaacgaaacatggacaatggctttcgatggcgcactcaacagccaaggagcaggggcaggattcatcttgacgtctccctccggagatcaattcaagcacgcaatccacctcaacttcagggcgaccaataacacagccgaatacaagggactactcgccgggataagagcagcagtcgcacttggggtcaagcgactaatcatcaaaggggactccgagctagtcgcgaaccaggtgcacaaagattataaatgctctaacccagagttatccaagtatctcgcagaagtcaggaagctagagaaaagattcgatgggatcgaagtccgacacatctaccgcaaagacaacatcgagccagatgacctagcacgacgagcgtctagacgagaaccgctcgagcccggcacttttctggatatcctgacgaagccatcagtgaaagaggttagcggcgaagttagcccggacacccccgacatcagctcggaggtcacaaaggcagaacgcgctgttgccgatatcgagaccacagacgactggcgcatcccactatcaaattcatcatcagcaaggagttgccagaggacgatacagaggccgagaaaataacccgtaaagcaaagatctactgtatggtcggcaacgatctatacaagaaagcgccaaatggggtacctctcaaatgcgtctcgtccgacgacggcagacacctcctcctcgatatacatgaaggcatttgtgggtcacatgccgtcggtcggacattggtcaggaaagcttttcacaaggtttttttctggccaaccgcccttaaaaatgcatgcgacatggtccagcgatgtgaagcctatcaattccacagtaaacacacaaagctacccgcgcaagcactccagactatccctctgacttggcagttctcgtgctgggggctagatatacttgggccattcccacgaggacagggcggctacaggttcttattcgtggctatcgacaagttcaccaaatggatcgaagtagtacccatgggggaaatcaaggccgacaacgccatcaaattcatcaaagggatattttgcacatacagactaccgcaccgcatcataaccgacaacggctcccagttcatcagcgccgatttccaggattactgcatcgggttgggggtcaaaatatgcttgcctcggtctctcaccctccaagcaacggacaagtcgagagggcaaacggcatagtactacaagggataaaaacccgcgtctacgacagactcatgtcacacgacaaaaaatgggttgaagaactcccatcagtactatgggccgtacgcaccacaccgacaacgtctaacaaggaaacacccttcttcctcgtgtacggctctaaggccatgctccccggcgagctacgacattagagtacatgagtacagaagcactccgacgaggaccaggaggaacagcgagacatcgatgtaaatcttctcgaggagcatcgtgaacgagttgccgttcgagcagtcagctatcaacaggccctccgccgttaccacgagaagcgcatccgagcacgcatactttcgatcggcgactctgtcctccgacgggttcaaagccaagcagggcggaacaagctctcacccaattgggaaggaccttacacgatcacataagtcttgcagccaggcgcattcaaaattgcagacggcgaaggtcgtgagttagcaaattcttggaacattgaccaactacgtaaattctatgtatgagtcaataccatccgtacctgtaagacagcttacagtatcaataaagccaattcttaggcccatgttacaatcaaagtgtttttgcccaatgatcccttaccctgatgacacctagcgttgaaacctgtcctcatgtccctttacgctgtcttgacaaggcctccgaggaacctaagggatcttcggctggggacgcccagtgccgataaggccttgtcagatcctgtagagacgaaagactatgtaagatctggtcgtgtaagagttctcaccgtgcgtattaaccaagccgtgaaatcggaaatcaactttccaacttcacagctgggggctaggatcagagcttattcaaaggtccaagagccttatcctccgagaaaattcctccgacgacaaggctgggggctagagagagtgtacgactcaaacggctaactaaagtcgtgaactgagaacgcactcttacacacaacatccagagtaagaaacatttgttaatgatagatttcttttctatttcacaaaatacttcttacagtttttacacaaatcttttgctacattacacctttttcctaagatatctgtcacagggtacgaatactagcaagaaggccaacgccagtccatagactggaagatcttctcggccaacggcgacatcgatctcgccagatggtctatctccgccgaagtcctccgagaacgagcaaaaccctcacggagaaattcgaggtctaagcgcgggcgatgatctcgtaggcaagccaacaattgccctccggcgtatcggctcgatcgacaacactcctgcttcaaggcctcgtcaatacgcttgccaatgccatcgagttgagcacaggccccgttcagccacgagatgtacacggccgccaactcctcaggatctccgtggaccactcgaagttctctacagactctggccatggatgtgcagcaactcttcaagtacgagttaaaccacacctcacaaccttggagcgtttccacagcctgctctttcttcactgccagcatggttctctcaagttccgctacttcaaacttcgtcttccagtattggatacgacgatcttggccagcaaaggcaccctcgagatctgcttaatgtgataacaactaattcaagcggtacacctgttttcgagaacacaagtgatctagtcgggagggcgtagaggtgtgaatggactactaacctgaggaagtcgtcgccatctccgtctccgtaacaagggtctggtccacattgtcgggcgacacgtgtggttcaaactcgagaaccggaattatcgccggtgactcgggctgcccgcgctgctggacatcctcgtcatcagcatctctacaaaggacaaaagttcccgaggtcaacatacaaaagtaaaatgataattgcacgcacgaaggtggtcagaattcaaatgttacacatcatgtcttggaagtacaagaagtcctactcttcaaataggggagaatagactctcccagatcaccgacttcttccatcacctccttacgcgtgttgcaggccgccccctgatccaagatctcgcgtagatcgtgttcaggacgcgacagcttcacacacgcgaggacatggcacgccccggtgtaaatccagttcgacgtctcctccacgatcctggccgcatgcttggaggggatctcccccatcaccgtcgccagttccgcaagggaggatgttagcgataactcgtcaagattcaccaggatggtagacttgatgccgcactccccgacgagctagtgcaggccagtgtaggtgacccgcagcgaacccagatttccgacaggttgttcccgagttccgacatgcggtccttgagcccctgccgttgtcgctcgttgccggccaccaattccctcatcttcgtgaggtcttcacgggcttcagccaactcgcgcaccagccggtcagcacgcgcgttcgccagcactgcttccgaccacgcctctgcaatgtcgcggccgatgtcgcaagcaccagcttcgaggaggcgccccatctcgacttggagctcctcccaggtgaggacggcagctggtggatcacgacctgccgcgggatcgctgactgggccgttgggcgtcgcctcccggctgcgagcacgacatccgtcgaggccgcgcctccgtcacgacatccgtcgttcaggcgatgcgctggaagtccctccgacttgtcttgggcagcctttgcccgcgcctccctatgggatgaccacgaatcagacaatgttgaatagaatcacggaaacctaaaaattcacctacttacttctcgctaaccgtcacaagacgttgtcgtcgtggaggcaggggagacgcgtccgaggcctgaaagacaaccaatgcggagtaaggcagaatccttctggctgcaggatctgacgacaggataacttaccgagggggtcgacgccttgcgacgatgtccgcttacagaggagaacttcctcccctttgtcggaacattgccaccgctagtggtggcagcagcagcatcagacgcctccttggctaccttctcttttagagacgccgccacctgatggtccgcgagcggcccgatgatgtcagtcagaggaagagcctacgcttaatcaagtcataaggtgatctcgaagggaaaatgcaggatgccaatcgagtacacttacgttgatagcgtcattgcgttcagctgcccccttctcacaaaggggcacggggatgtcactcgctgttgtcggaccactgatcatcacctagccgacacggcgctccatggcttcgctgttcagacctgtgaatcgagaaccaaatttcgataaatcaagaggaacgcgaacataaacatgccaggataaatgcgagaaagataccccgaggagaaacccgggtcgcgtcctccggtccggaatagttaaaggttggatgggcccgagcctgcagcgactggatccgcctaccaacgaagtctgcaatgacttcataccccgacaagccccgtactcggagatcgtcaatgatgttgataaacgactgaagagaggaggtcaaagggggctttgcggtccaagacgaaatcttgtctggttgctctttgggaacaacgaagacagggtccaagtctttgatctcaagatagaaccacctattccgccacttgctgcgagaagaagggcactggaaggggatataacgtgacttcaggccatcccgaagtcggaacccgacgcaaccagataccctgttggactccatccaacgcagctcgtagtagaagcgaaagagatcaaggaaaggctctaccccaatataggcctcgcaaagatgagcaaagatgctaagaaaggcgataaaattggggttcaaatggagaagagaaagaccatagaagttcaaaactaggagaataaattcgaaaggcggagggagaaaaccgcagagaatatagtcttcgatcgcaaccatgtgacctaagacgggctggggattagtacatcctgcttccctctccatggttcaagaccaggaggggcgtcgtcttcctgaagcttcttcagcgacgcactggtggaagatgatttgccgaggtccatcgctgatcgaagatcgctagagaaagggcctaggttgatgaactagggtttcttgtggcggcgaagaaggcgaagagcgcttacaggcggaatgttttcagcacggtgggcggacttgaagatggacccccaaaattcctttaaataggcgcactaccgacggtgcgaattccaaggaatagagagagatgcccgccggaaatttctgggtccgttacgcgcggcagttttttggacttcaatttaaattcgctcgtgaccattgggcttcaaatggcgtgctcgactacggcctgtctccgcggtcctcgcaccgggaacgacaacagtctcgacacccgaagtcgcgaatggttacgcgagctcattttaagcagatgtcgagggctactgtcagggttatggttaggcataccctttacacttcgatatacgtcacatatcagtatggtatacccacgcgcatacggatacttccttcgtattccaaggaaatccttcacggaatctacggatgggaagaatcctactcggacaagactgggtcgttgatgtatcgtatagggtctgatatctccgagttctacttggagacctccagatctgcaatataaaagggaccccccgggaagggcttaaggcatcgaatatcagagccaacacaacccacacagcctatgaagtcggagcatgcaaggagccaagccatcgggatctagtcgaaccaactcgactacgatcttgccggatccgacaagttccattgtcccctttgtaacctgtgttttccaccatataatcccacatcaactggattagggctattacctatcaaggggcctgaaccagtataatcctcgtcttttgtttacttgatgtcgtattacgtagatccttgtaccaacgtaccccaataccctctatatccggtctacgggtaccacctgtcgacaacactaatgattggtctaagtaattggtccaccaatttaataaaaatcagatctaatctaatgatctaaaatagtgggtccaccaattaaataaaaatcgattgtgagattaaatagtgccacgtggcggcataggagtgtttagagtgccacgtggcggcttgagagcgtttttaggatgtttaatggacttttagtatataatggaagatagatagatagatagatagatagatagataatagataatagatttttctcggcttgtgttttagagaaactgatgtataagcaaaccgaagaaaccgacccgagtctccaaatgaaccgaacgcccaccccttaatacatcgatctacgactgaaggaatatttgatacgtgctaaattcagtagtgcagataataggcatggacgtattttcaggaatacgtggcattgtatgttctgagataatataaaccgagtaaattgcattgaagatacaagaacataacttgataggtgggtgcagtttaatgcataaacttgaaaactgagtaattggtacaccaaacttggttagatggtgcgcttttggtcaaagtgattgccacatggaatctttttccaggtttgcaagacacgtcgtcatttttgttacatgtttctactggttccttggatcggaacagcagtagactgaaggtccatttcagcaaatatccccggtttaatgttaacaacatcaaatcaaaagcactaaaaatctagatttagcaatgatacagggcaccgtgatctctttgatcgatacatgaaccaattcatagttatactgtcaattgaacaatgaagctagatggcgtctaagaaaagcagcatgaatgcatgatctacattcagaagctttatagttgaccaaaagcaatggatcaacctaggaagcacgagttcctgataaattgaaggaagccaacattaaatatacatcatgcggaacaaagagaacataaaaagtggtaggaagtctgtttcaaatttattggaatgcgagagaagcgatcttgtgcacctgatgtcccctgctaatgtggcaaaagaataataatgtgatattcactttgcctaaaatgcactataaagctaagttaatgcaccaatatgcttaaatttcaagttcttatactagaacgcacccaccctgacaagttcttatatcgtgagtgcaatttactcatataaaccagtacaaggtttatgacgcgtggagcgatgttgggagcagctaactatccgaaaggatgctgtgtatgcaacgttccttttgtttggctagtttggctctatgcaatggtggtggcaacagccagcacagcacagtcgagtgcacacctgtgctcgacgcgtggtccggcgttcgtggcggaagcttgtgctcatcatcgccgtcctctgtttcgggcatggccacggccgtcgagctccaggtttgacggaggcaggacaagccatgtacattggcagcgtaccactgatggtggagtgactgatgtgaggatgtctggtgagcatggcgcacaagaggcggcaagcgggtatccgctgcccgctggacgctggtggccatgaacgaccgattggcgtgtcatccgcagcgagtcagaacaaagcagagtggcgccgagcgcgtgccaattgccaattgttcggtcggcgcgcggtctcggttcagcaggtcaacaggaaggaacgaggcttgggcgcagtggaggggaaggactacggcgatgtgttcaaacggtgtctcacacgcacgagaggtttgatcggtggcggctacaaggcaagtagaacagtggtcatggactcacggctgatcttggtcttgggcaaatttttcttcatgacaccgtgaagtggtgtggtcatggactcacggcttgtcatggttaatgataagggataccttctatcctacaacttagagaatatacaagtatggtatatattcacgtacacgggttgtttccttatgtgttgtaggaatccatcacgaattatggaaaatatctttacgggtcgaatgatttacaaagtcctacccggtatggatagagtttctattgtatcgtacgggatccaatgtctccgagtattacttgaagatcaagatgatccactgtataaaagggaccccctgggggtgcaaggcatcgaatatcatcgcatacacacccaccacagtttacgaagccagagcatacggagccaagtcaccgggagatttcgtcgagtctattgactacgatctcgtcggtatcgtcagatctatctactctcattgtattacgtggttcctccatattaatcccatataaactggactaggactattacctgataaggggccagaaccagtataatccttgtcttctgtttgcttgatatcgtattatgtagatccttgtacctacgtaccctaatacccaactcgttcggtctaagagtatcactcgtcgacacggcggaccttagtcttcagcaaattttgctacaggacaccgtgacttttacggttttagctgtacgacacgacacaaaataacttttgggagaaaacactcctaaaagttggatatttgctgatagataccgcaccattaaaataataattttcggttgaggatgaaagagaaatcgtgtgaaatgtcaaaaatgtcccagggtccacatgtcaactctctctctatcccctccttctcttctctccctatcccacatgttagcgacgacggcggcaggcaaggtccggtggcggtgggagggctaaggcggagcggccgcgacgatccgtggccgagggtgaggtccagcagcggcggcggcaggagggcgagggcggagcatccgctgtgccggccagacagcatatgaggttcggcggtggcaactgcgagtggaggagcggcggcgcggctggacagcgatggcagcggcgcgcggagtgaggaggcgtcccacgccggagcgcagaatgtggaggagccggcgtgtggagtgaaaaggcctccagcgctgtcgccgcggccgctccgtactagccctcctgccactgctggacctcgcctgccgccgccttcgcggacatatgggatagagagagaagagaaggggatagagagaagagagatagaagagctgacatgtgggtcaaaggacatttttaacatttcacacaatttctctctcatcctcaaccggaaattattattttaatgggtgcgatgcacactagcaaatatccaacttttgtgagtgtttccccccaaaagtttttcgtgtcgtgtcctatagctaaaaccgcgaagtcacggtgtattatagcaaaatttgtgtagtcttaatattgcgccgtctttggcctcctatggcatcaagacggaatgggccgaggtttaggggggccacacgtcgctcgacttgcggtgtgatgatacgagatttaagcgtgccaagtgtttaacaagtggcaccaccgcgaggttggattgatgctgatgggctcatagtggccaacgcgagctaagagaaggtataatagtgggctataagaaggctgaatgctgaggtggatgggagaaaagaggagagagatgagaagcgggctgtaagtttacaaccggcttaggcacaggaaccaagaaaatctgtgagacagacatgtggaccatatatttatagtaaagagttaaccactatatgagtgagctgatagataggctataagtaagcagctggctgtattattatcctcgctctaacggctgggctggaagcctgaaacgaggttgcgaggtggcacgacaccagtggttaaccagtgcaaggatggcgtcgaagtcgcgggtcggcgaggacgcacagtgccactgtggaggagctgcgctgtggcgtgtggctgacgcggtcacaatgcgtctgttggtggcgagtgtcgtagtgtgcgtcagcggtggcgcacgattggcacacggacacgggtgtggcgcgatcgcgcgactgtatcgctcgttcagacacagcggtgcgtgcgagatagtgagaggggccgaagcacggtttggcgccatttggcatgctggcggcatggacgtcggtggtatacaatacaagaggtgcactgtgcacggccgatacacaacgctgcgcgcgtggagcgtgcttgtcgggttgactggttgcatgcaagatgaaatggatcgatcagtgcgacctccgtgtggtgtggcaacacgacgcggccgcctggccagttcggcctattgagcagctggcgccgcttggcgcttggctggtcctggtctgctcggtttggctgcagttggaggttacctcgtgtaggtgttacttggttggtccaggcctgtatcgagcaggctcggctagcctcccatccagcaatccagcttgtggactgatacatgaagaacaatgccggctgggatttacacggaaaaaagaggattttttatattttattaaaatatctaaagatatattttaaagaacttttacaaataaatacccccaatgctttagtgggacaacttttatgacttgttaaatagccattggcgcgagctctggctattttactagcgaccccttgcagccctaccaaaaataacgcctgcccattttacaggacctttgcatgcaaaactagaagataaccctctaaggccatgtacaatgggatgcttaagtagacgcttagagaaaaaaaccgggtttttttttaccaggccggcgctacgcgagtcgcccgtcgccacgcgaagcggtcgtcgcttgggagcacttgcgcgaaaaaaggaggagcgtagcaagccctggcgctcagtaccaactaactaatcttgttttaggcatatggatcacacatggaagtattttagtacatcacctttgtcataaagatgacaataaaattaaaaattggttgacaatgagatagtaaaataaaaaaaattggtagactcattcactaccattgtagcacctagatgcttagatagactcttaaataactaagcatctgtggaatggattctcttcattggagattaaggctcttcaacagatgcttacatacttttttttctaagcatgtatctaagcatctggaccattgtacatgccctaagaggatggcaaaatgaccagctctcgccattagcacacgtcgatgattgtttgctacatcatagaaaacgccataagaaaatatgttttttttaaaaaaaacgtcctccaagaaacgtgagggatatagatttgtaaaggttttaaaaatatatattttgcaaatatcttaatgtaaaaatataaaaataaaaagaaatcgaaaaagagaagaagtaaaaggccaaaagagtgtgtttgatccctgcataccgtccagcctggttcgtatcgttcgattgagcctgctcagaatgtgcaatctcaatgggaataagtttatctgaggtcccttaacatctcgacgaatccgattttcgtctttcaaccaaaaaaaccaaatataacgggtccctcaactattaaaaccagtgcaaaataaatccaaaggcggtttcagctaacatggcgcctacgtggctaatttgatatggtcttcatctaacgtggcattgacgtggcacatgaatcaaaatttaacaacttaaaaaataaaacaaaatatgtggacccactgttgatgaaaaaacacactagcctgggagatctgcttagctctagtgcaggtctaaatcttgatgagatgcgggcgtgccagtcagtttgatcctgcaattgacaagatatgcaaatagtagatcaatgagccgatcggcggacaagcctatggagtagttctagccgatgccgataccagccgataacgatagggttttgagccatcggctatatgtccaatgtagataatgatataaaggcaatcggctgatgatagtatagtataacaatataatcgagtagaaaccaatcggctagcagtatgatataatagaattagcactgatccgaaggttaaagcatacatcaactggagatccgatatcataaaatccacaatattagataacaataaagtctttgttgtcatcggctaaatattatatatatatatgtatatatatacaatccttaaaagccgatgcaacgtccagataacttatcggctagcaccccgataaaacattagcatgaacctatcggcttaacatgatttatattatcaacaacaatctagtaggtcgaacctaaccgatgcagcacgagattgtatatgataatataatactcgatgagccgatagatctgtctaacgtgatggatatgacagatctatttacaacagcattgtgattgtagagagatatcggctaagatagaagatcagacctaaccgagacagttccaactaaaccgatgcgtctccaaacacaacacaattagagatagaattgagatatcaggtaggcaaatatatcaaccaaaccagagcgatccaagagatcgaagcgatgcagccttgaacaacactaacgtatccaatagattcaccaaggccggcggaatgtaggacttattccttcaccggagatagaactgaaccgatgcagccccgcgtcaggtgccaaattccaccagatgataagtaaaaacctaaggaaagagggtggcgattcgccgagagtagttgtattgatcgagagatatcttacaatgaccccgggtgtaaatatttatactcatggggagatactagtccttatagaacaagaatgaaactttcctaaagataaaaagaaaacataaagtccttacatgacactaaacacactttcctaaagataaaaggaactaacaaattattcctaattaatatataaacttgccatgccgcatccttcttgaactcgaactcttctgcataaatttcctttaattaatccgactccaccaagaacacaactgctggcgatttgacgactcccatcgccgattccaagactctaaagccggtactaactctaagcaaataataacttcgggcttaccaaattttggcattaacacccacatgtgattcaattaataaaataaaaaaaatagtaggacccacatgtcattgggccccacttactccacctcatcccctctcttctctatctcctcccctgctccttctcctctgtttcccttcttccctagattgtggaatttggacacctgcaggatgtcgcaacaacactccacaccccgtcaatctccgccaccgcaggccacggcgccgtcccccttggtgggccacgacgctgtcctcctccgccaccgcgggcaacgacgttgcctccctcgccgctgcgggaggctgcgggccacagtgtcgttctcctccgccactgcaggccacggcgccgtcctcctctgccaccaaccatgccgtcgtcctcttccgacgccaacctcgtcgatttctccctcggcgctgtcttcctccaccgccgcgagacacaccgccgccccttctctgtcatcctcctaagccaccggtcacgtcgccgtcctcttcctccaccgccaccggtggcagagccctgggatggtggtcgtgtcagctcgtgtattccacgatgggatgagggggggagatagagaagagagaggatgagttggaggaagtgggtctcattatttttaattttattatttgactgacatgtgggcccacatattttgttttatttttaaaattgttaaatttggcttcatatgccacgtcagatgaagaccgagtcaaattagccacgtaggcatcacgccagctgaaaccgtcgtccaaaccgccttgggacttgttttgcaccagttttaacaattgagagacccattgtatatgattttccagttgaatgatgaaaatcggattgatcgacaagataagggacctcatatgaacttattccatctttgtttggttatctgcacggagatttttgggtcctaaccagttagcagaccaaggctttcccagccaaccaaagcatcaaaatcctgcaagcccaatgacctcttttgcaggcaaccaaatggctgcttttgagtttaaattaaattcggaatttaattgtggaacttcccttttattcagaaaattgaaaattcaaaatattaaatgaatatggactttcaaatttcatttaaaacgaaattcttttatttagacgatttgttgatttttttttcttgaactcgtaacctggaatttgataactgaactaaaattttattgttttagtggagtattagttactcctactgcatgtttcagaacaaaaataattactcctactgcatattaatgatatttattgcactacaaatcattttttccctcctaagtggtatcagttttatttacaatcgtattgatacagggctcgagttcatgcatttcattattatttaggagcttgtgaattaaataaaaatttcattcccatttaacatttcttgtttgtatcagatacactcttgatccatgaattgtactatggtgtactagataccaacttattatttttcttttcacatatattgagtttgctttagctgagattaataaattggatttatgaattgctttaattacagtttgatgttcttatatttcagaacatatataaggaatgacgccatccttcatcctaaaaattttcagcactgaatacaatcggtttatagatttcaaggagaaaagaagaaaactcttggggtagcaagccagacacaaagggatgactgagccggtggtaatgggccaacaccattagcctatggggccgatctataagatgcaaattctctgtagtactgctgatacagtagcagtggctgacatatgggtccgggcccacacgtcggtgactgctactgcatcagtagtactgcaggcaatcccaactggttgagctgaatttcacacatttattttactttagctaacaaagattgagtgggcaacgaaaggatccgtgagttgtggcccattactgttgagttgtgatccaaattcatttgcacttaataaaggccagcttctgcctatatatatacctcatcatcccttttagggttccactatatatatacctcttgtaagccgccgtgcggcgatgtaacctcacctcagatatagtgaagatattttgctggctggcgcccgtggttttttctctcctgttttgggagggttttccatgttaaatctcgtgtcttttgtgattgatctattgttctttatcgtttgttcgcctatcgtttcctaacaagtggtatcagagctggttcccagattagggtttcgcgatggcgtcgatgaagtatgatctaccgctgctagactacaagacgagattctcgctgtggcaagtcaagatgcgagctgttctagctcaaacttcggatcttgatgaggcgctggaaagtttcgggaagaagaaaacgactgagtggaccactggggagaagcggaaagatcgtaaggctctgtcgctaatccaacttcatctatctaatgatattttgcaagaagtgttgcaggaaaagactgctgcagaactttggctcaaactggaatcgatctgcatgtctaaagatctaaccagtaagatgcatatcaagatgaaattgttctcgcacaagttgcaggagagtggttctgtgttgaaccacatatcggtcttcaaggagatcgttgccgacctagtgtcgatggaggtacagtttgatgatgaagatttaggtcttttactgttatgctcactgcctagttcatatgaaaattttcgcgacaccatacttttaagccgggatgaact

SEQ ID NO: 39332 - DNA, 6819 bp, Oryza sativa
gtttcttgttttgtgcttattcacccaaaaccaaaataaataaacctatgaattgtctatataaattaaggtacataaacatgagaatctttgtgtcaattgaaaattagaacacctcataatcgtaacacataaaacaaaatccatactaagcctttacttagtagtataaattaaaaaaaatgcatgaaaaactcacctacaaacataatctttcgtaggagaaaactagtctagaaatgtaagacgaagaaacgactttcactacacattcaaacgtgctagtttattttgcaccatgccgtacaggcgtacaagagcccacgtgctagtttattttgtacccatcactataaaatcgatgtaaaaatatggctaaaattaactttgaaagtgaagtttggcttagatttttagtggcacacaaaataagacgagtcactcgcacatgattaattggatattgattattccaaacttgaaaaaaaagtttatttttctttttttgaaaaaaaaatggcaacgcttattagtttgggaaacatgcatatggtaaacgagcggtagcaacatgcaaacccattttcaaactccggcttagtgggccacaagtctgcccacttgcatccctaacttttttgcattatgatagaaaagtttttttcctaaaaaatcaaaaccacaaatcagtaagaaattttcacctaaaacataaatactccatggtatattgtccaatataaatgatcaacagcagaaccatacttaaaaagaaattttacatataacgatataaagagaatctgcctatttcgtgatggaaagatacaaaccttcatgtaagtctatcaagttcagcacaataattttgatgccagcccatactcctgttttatctacaacgactataatttaggtatatcattgcttcgtaagaaaactttgccttcttctcactgtacttctttattaccacgcacttttcttccttagttttatttacagagctggacgttgccattactatctcattgccttgacagcctacctatctccttaattataacgggagggaaaccctctcttgatcttcactcaatcaccttccaattcacactacttaattaacttaggccccgtttgatctctcttttgggagttggatttttgttgcacgcaaaatgagaaacctcattagcacatgattaattaaatattaacgatcataaatttgaaaattgaattatttgctttttttaaaacaacttgtatatataaactttttttgaaaaaaaatacactatttaaccgtttgaaaatcgtgctaacgaaaaataaggaagttgaagaatagaactgagccttagtgtcaccgatcatttcccattcacaactttgctgattttgtttttattttagtatcgttacaggtgctaataatgctgcagattattgtttagaaaaatactgacttaatctcactatggtattttctgacgaaatagtttgggagagcagtataactgatttttctttatccctttgcatgcctaatctgattcataatctatattctttttctccacgtgactgaaatgccctccgtacttaaaccaccaaacccgaagaccaacctatctacgagaccaaccaccaaatccaccaaccgaaaccgctcacccgttagcccgttaagatcgcgcccagtacaagttgccccacccgcctccacgaaacggagttcgccgacgagccgaccgttgcgtccgcgtgttgcgactccgccgagccctagtttccgccgccgccgccgccgcgccctcgccgccacccccaccgatctcgatccccccaccccgcgggcaaatcgccgccgaatccggcctcggatccgcggaatccgggccgggtcagccatgatcttggagcagttcgacgagtcggcggcggagaaagcggatgcggcgatggtggtggcgccgccgtccaacttcgggatggtggacacgggggtgtaccggtcggggttcccggaccctgccagcttcggtttcctcaggggcctcggcctccgatctgtcgtgtgagcggttctcggggggttgggttcgtttagattggattggattgctgttggtattattccttcggtgtatgtgctcatgtggtggatttcatctggatttaggtatctgtgccctgaaccttacatggagacgaatgccgagttcttgaaggcggaggggatccgcctcttccaatttgggattgaggggaacaaggtgatcacgctgttcctttatttattttcttcctaattcatgtttgtgtgatatatgtggcaatttgggattcaggggaacaaggtgatcatgctgttcctttatttattttcttcctaattcatgtttgtgtgatatttgtggcaatttgggattgaggggaacaaggtgatcacgctgttcctttatttattttcttcctaattcatgtttgtgtgtgatatttgtgggaattttctctttaggtttgttaacttctatgtttaatagatgcatgttgtttaggtgcgattgtgctctgatgggtgtggaatcctgatgcaatatgctgagaagggcgtgtttttgttctttaaatatacaacaacattccccaatcagagttggaacacatcgaatattgatttaaacctcacaacctaatgcatgattaagtaattatgtgtcataaaatctgtacactaagtacttattccagagagtgtggggtcctaagctttccttgtcaaatcgtagggatcatagaatttacaggcatttctggaaattggtgctaatttgatgattgaaggttgccttgataaatgataactatagaacaattaaatgtttagtgtcaagtgatgtttgtagtaacaatccacaaacttcaaaaggaagttgatttagaatttctctgttgcaatttatactggttgatgcttaattaggagatgccttttcagttattgaattgaagttgatcagtgtcattttcaccattgtaactgctaatattaggcagtttcataatgcatccggaatgtttcttgtaaggaaatttcttcagtcatacatggtctgtagaatgaatttttaacataactttctatactcagcaaggacagatagttggacatccgttattttttgacatcgcagcctttttcatggtccttcatttgtattcatttttccttcaattatgcccctgcaaaacatgcattattaaattttcaatatgcctttttttatatttaaacatgaattgaatacaaagttgcttccattattacatagggttatgtgaaattttatgtccaatactccctttgtttcaaattacttgtcgttctatgtttttcttaagtcaagcattttaatttgaccatcaatttctataaactcatatagtttaacatcataaggtttatatttttggatttgcgatgagaaatactttcataataaataattcacatgatgaactgcatggatttttaaaaactaatggtaaaaaatagacatgtttgacttaggacaaacctagaacgacaaataatttgaaacagagggagtagttgtgtccaacatttttgtcagaagaaagtacaatctatttttttccatttctcatggaaatagcctaagccagtaaacgtgatttagatttttttttccttccctcttctattcaggatgcaatgctattttaaaaagaagtatttgttttttgctgaccatttgatagtttttttttgttccttagttatttgatagtttagttgctgatgtacaagaagcctcatgttacatactttcttgtactttggcctaaaaggcttgactaaaatggatttttccacattttctttcttggaagtataggtgaggcatggtctagaaattgtttgaaaaaaaagtttaaatcaaaagttgaggctcattttcctagtctttttacttgctctgaaataaaaatttggcgaccaatgttcaatgtctaattaacgtttacaactttagcatgattttacggttgcaagtacaaactaccgattttttgtgctgaatgaatgattagaaccgcctctgttccttttgtggtagtatccagttaggtactcctatgttggaagagcacctgcattttcttgtcgatcagtagtcactcccttcactttgatgtttgctcattatacctttccactgttgttagttgtgtcttactacaggtgaagaagtaagttttttttagttctgtcagacactccaatagacattgtcgtgattcaccaagtgcttgtgcttgttactctgttctatcattgcttttggataaaataacccttgatgtttgcttgtttcttcattcttgattacatatatgaagaagttcagtatctcttaaatgtttgcatctgcaggaccctaacgtgtccattcctgtggatgccatcatgggggctcttagggtcatacttggtactgaattaggcttcttctgtcctgtttatctttgctgtatactaaaactctctgatgaccatcaagctaataattttgacttactagtactgattcttggtttcagatgtaaggaatcacccagttctaatccattgcaaaagaggaaaggtaccaaaaagcactcatctgttcaaaatccataattgtttttgtccacaccacatgttcttgatattttatctgtttcgaccgcagcaccgtactggatgtcttgtgggctgcttcagaaagctgcagaattggtgtctctcatcagtctttgaagagtaccatcggtatgctgctggaaagtcacggttgtcagatctgaagtttatcgaatcatttgatgtcaactgcatgacggattgcctgctcaggctcatctaccactaccatggttgccttcagaaaagcaagcgcctggcatacagcgagagataaactactgtggaaactatctcctgtgtcatgagtatatccctggagaagaattggtcggactatttttcctttttggaggggaattggtcggagttgtaacacaaagactcgagttaccgggcatctgttgattctttttttatatcttcatgccttggttctttttataatatatatatatattctttgagcatggtctttgacgttaatttcaccaccctaaatataagtctaagcaagtttatgattattaagtgtggtgtattgctatggtagtgcgcatcctcatataacaaccaaacacctgtttgccagtccttacattcttcgagaagtagatccctggcaattaattaatcacgcggtcttaatatatactcccgtttcaaaatatttgacaccgttaactttttagcacatgtgtgaccgtttgtcttattaaaaaaatttataaaatatgtaaaattatatgtgtacatgaaagtatatttaacaatgaatcaaatgatatgaaaagaataaataattacttaaattttttaaataagacaaatggttaaacacgtactaaaaagtcgacggtgtcaaacattttgaaacggagggagtactttctcgtgatactctccccgcggatcacattagatgttgtgatagtctccccgcggatcactagagaagttgagaacctataaattgccagttcgtttgctctgctctttcttatgcaagatgtgtttaattgtactgatgagattccgttgaaacacatgcccatgaaatttactaatttttgaaaaacattttctcaaaaatatccaaaagtaatcctttttgaccaaacttcgaaaaaatatttcctcaaaaatatccaaaagtaatctttttgaccaaactccgagtctgcgaccattctgttatgccatctccagatatattgattcagcaaccttgccccaaccacaagccctgcaggctgcagattctgttttccacttggcgcgacgggcggcaccgccagctaggcgtccaacgtaaggagggggatctccaggaattcagataagggatagggttgctggcatcctccatccaatgaacgccacacagctctcaaccatatctcatcttcagggacccacccaaacacatactccagattttctctcctgcagcttgtaaagatcacaaactttaatttctagggcagttgccaagaaggctgtttcacatccattttttttggccgggagagagagcatctagctagggagagaaaggaagagacgagaggagagagatggccactgcttatgctcccatggcgagccagctgatgaagagcagcttggtgtgctccaagccgagggggctgtctggtgcttcgctgacaaggaggccccgcttcacagtcaaggccatccagtctgagaaggtcagtagagctagctagactgctaaagagcattgagagatttcccatttcgcttcatcaaagctagtgtaaaacttgcatgtttctcaagaacaagctctgttaattaaaatcagatggtagatttcagacataatcgtttttcattttgttgtatttttattgctctgttcactagtttatttcctcaattagcaatataatattgaattgttgtaatccctctgtagattagacgcatcgtagtactatgaaatgtgaaaaatttcaaagatgaagggagtaataagtttgcctgcatagtacatccttaaactttttgccatcgttatttcgatcacaaatcccctttttgggagagagggttggattattagcatgacgatttta

SEQ ID NO: 39333 - DNA, 1596 bp, Oryza sativa
cagcctggagacgccggtgacctccagcccgctggtcgcctggtacctctccaacctcccggcgtaccgcaccgccgtcagcccgctgctccgcggcatcgaggtcggcctcgcccacggctacctcctcgtcgggcccttcgcgctcaccggcccgctccgcaacacgccggtgcacggccaggccggcgccctcggcgccgcaggcctcgtcgccatcctcagcgtctgcctcaccatgtacggcgtcgcctccttcggcgagggcgagccgtccacggcgccgacgctgacgctcaccggccgcaagaaggaggccgacaagctgcagaccgccgacggctgggccaagttcaccggcggcttcttcttcggcggcatctccggcgtcctctgggcctacttcctcctctacgtgctcgacctcccgtacttcttcaagtagatcttttgtttgtaagtgcatgaccgggtgatgcatgtgtagatcgatcgatgatggaacatgtgtgtgttcatgtggtggctgatttgagtgccttctacttgtataaatgaaatgcatctgcacaagggcacaaacaggctgcctgcatggatatatggatggtgtgctgttgtaacttgggagtgttactttcttactttgcagataatttaaaatggaaagaaaaagttttaacaatgataattaatcagtttgttgtaattatattagttaatttgcaagggcgagaatcaacaacagttttttttaaaactaaaccggtaggagtacttcgagaacaaaatgacacagagtattcatgtatcacaactaaatcgttcatactctcaatattaaataatacagtggcggatctagaaatttttttttacctagacaaatctaataagatataagcatacatataaaatctatacaatatatatatatatatatatatataaaatttaatttgtaattgagtagactaaaatcaacgtgaaaggttatatcgattaatgtagcatgagagactagtatattcttttgcattagccttaactactttgctaattgcattgttaattaagcagggtacgtgctagcacagcgggcggagcccaggcacttgcccatggtggccgggccttggctccgaccttgaaataatatagtatatgctatatattcaacagtaatatgcagcagctgccattcttaccaaaactaagatttctagtctggaaattgctacacatccgactggggtgtacgacttagcatctgaccagtacttacctgctccttgctctgacccacatggagagaagctggctcgttggagtaaattgattggcagatacggcagcgtcggacagaagtcgaacaacagggtcggatgtatagcagtagtcttccagtcttcggcttgtagtactaattgtaggaaaagcgccaggatgtgatagatgaagtttcaaaacacacaagtgatgacaagcctcaccaacataaaacagtcaaccatagtagcctataaaaatgaggaaaaatgagaaaaaaaaaacatcccatttatataagaaatggttgattgcacgatagtaata

SEQ ID NO: 39334 - DNA, 15621 bp, Oryza sativa
ggcccggggctcaagcccacagcttcttgcccccttgggcacctccatcctctagcccacattatattgctagggccagatggccacacgtgggcctcacatcctggatgggctctataggatctaaaatctagaaggaataagttcactttagtcgctcaactgttgtcgagtttgactgagtcgtaataccatatatgacgtgtccctcaactctccaaactagtgcaaataaggtcccaacacagtttagatgacggttttcgctgatgtggtgcctacatcgcgcttagagtaaaaaaaaaaacatgggacccacatgtcagtgagtatttggtaaaaaaataaaagcattacaatggaacccacatcatcactctatctaggggtggcaatttccccgttggggccggggagccggcagggaccagccatatggggctgggggtgaggggaaattctcaccacgggtgatgagtggggctgaggccccacaaaaatgcgggggtgggggcggggatgggagttgacccgcggcgctccaaagatatgagttacaaatcaaaagatagtacattctaaggcccaaacgacccattaggtgaaggactatatcggcaaaaccctaatttttcccaaatccctaccaagccaccactctctcctctctgactctcacgtctctccctcctagtgcgccgtcccaaccagcctgcctcttcgcacgccattcctagctgtcaccgccccgacacggcatcgcctcttcgccgccgcctcgtcacagcatgctgccaccaactgccgccgcctcctcatggtccactgcccccggccagcgtcgcctccttgtagcgtgctactcctagctgacgccgccccaggccggcgccgcctagtggccaccgtcctcagccgtagacaccttgtcaccgtcctcaaccgtcacctcgtcgcggcacgccacctccagcagccacaataggtgcatcgcagttgttggccatccgggtggtgcaggggcccgctcacccgctgggtcccctgtgggggtgagggcgggtgaggttttccacccgttgtccaacctaaccccgcctcgcccctctgccacccctaactctctctccccacttctctagtttcattattctctctttcctctcttctctcctttccttattctctctttctctcttctctctcgcgtgtgcaagcatcgcgatagcctgacggagctcggcgatggctagggatgggtccggggaggccaccttgtcctaaagccggtggcagtgaggtggaagcgatggtgaggcgtcgtgcgccagccatgcaccagacctttatctgctccctcccctcgcaccgtctcataaccccgcttctgagctccgcctcaccaatggtgtcttcctcaactacaacggaaacttcggtcctacctccgacttcatcctcttcgtcttcgagcgcaacagctccctcaacctctacctctccattgttctcccaccgcgaggcgctcgaggcggcatcgttgccagtgccacctctctcgcagttgtagccgagccaatccaacaaactcgcgtcaaaccaacagcggcgtggcgaagctgcagcacgccactgcggcggtggcaacggcggcgacatgcgtgtcgagcccgccagccaagcgcgacgcggagtcctccacctcgtcccctttcttggtctcctcataggaaggatggggcatcgcgttcgtcatgcactgtgctactcctccaccagaggtaccgccttccatcgccggtccggtcgttcctggcactggaggaccctaggtcgctgaccgcctcagcgtcctaccagatcctggtcatcgtcattacctgcccctcaccgacaaagagagaaaagaggaagggagaggagaaaaaaaaagagagagaggtgatgacatgggtcccactgcatttttgttatttttaaccaaacactcattaacatgtgggtcccacggttcattctgactttaagcgccacatctgccgaaaccgctatccaaactgccttgagaccttatttgcactagttttgggaattgaaggacacgtcatatgtggtattttggttcagagatgaattttagactcagcgacacaggagggacctatagtgaacttatttttattgagaaacaccactattcattatgggccaaataccccgctctcttcagcccattccttcttttctttcctacgggcccaaatcatctttcctttctaccggcccaaattagtacggcaccatgtagtagtgatgtaggtagaaccatgcgtacatagccagcatccattcatagacatggtaattgggcttaccatcgaggtacagcaatggtaactttgcttaactccatcaattttttttcaaaaaataaaaattaatctgaatttttataaactttacccgggttttcacagtttgtggttacctttcttaacgctaggacagtaaaccatacaacaaagtcattcgtgctctctattagagcatgtacaatagcagactattagccagctataaacatattttaatgagataaaagatgagagagaagagctacgggctacaaatatatagccagctgcagcacggactccaagacgcaatgtgtgtatgacatgtgtgaccaggtattaatagtatagtaagcaactattgtatgaattaactattacattagctatagatgaattgaagctagtagcgggccatactattaaacttgctcttagaccctgtttagatgggacaaaaatttttaagtccctattacatcggatgtttggacactaattataaatattaaacgtagactattaataaaacccatgcataatcttggactgattcgcgagatgaatctattgagcctaattaatctatgattagcctatgtgatgctacagtaaatattatctaattatggattaattaggcttaaaaaatttgtctcgcatattagctttcatttatgtaattagttttgtaagtagtctatatttaatactctaaattagtgtctaaatataaagactaaagttaaatccctgaatccaaacaccaccttaagctgctttcgatatcaaaggttcccaacttccttccctcgttttccacgcgcacgcatttcaaatagctgaacgttgcgttttttgcaaaaaaatttatatacgaaagttgcttaaaaaatcatattaatccattttttttaaaaattagcaaatacttaattaatcatgcactaatcgctgctttgtttttcgtgccaggcccaaccctcacttccgaaagcggccttagatttggaattaacgggagcgaataaccgttctcgctttaacaatattgcaatttgcaaacaggtaaaccgaaactaaccatcaatttgtactacctcgctatactgtagctagtactgttcatggaccttaacatcctacctgtataggtatggacctgatgtgaaaaaaaggttttctctttcagctgaggaaaagaaacacttcgttgagaatgtagcgtagccctttttccgaggcgtccccatccctccaatgctccaatcagaccagccactccttttccattccctccgtcaggtttttcgatctgtcttggaaatccgcctggtcaccctgtccatgcgtgtagcaccaaattattccctcctgttctttcgtgcttaacaaatgaatacattgatgaatgcacacgtttctcgatctcctaaaaataagttttctttacaataattctctctctctctatatatatatctatataatttacctatatatatatatatttgtgtatgtaaatcatacatactgttttaaacccatttttcaactttagaatagttaatttattttttatcctcaaattattattacgaattattcgtcaattcaatccgtacgttaaccattctggagttcattatctaaaaaaaccattctgtagttagagacgtcgtcgtctctctcaagcaattggtttcgtggataggttttgcagtcatcatctctttcagaccgatcgagatgtatagcgtgttgctttgtggtcatctccagtgaccagtgacataaattagctgatgagaggaagagagaaaaaaagttggtgattggagctgacgaggaatgagaacataaactcccttcatttttaatacatgacgttattttatttttttacaacattattattcattttatttaaaaattttatgcaaatcttaaaagtttctttagtgataaatcaagccacaacaaaataaaagatatttacttaaattttttaataagacgaacggtcaaacttgatgtaaaaatcaatggcatcatatattataaaatagagataatatgatttatttactgtaggctagctcaatttatggctaaggccctttttgtgaacatattttttttaataatgaaaatagtttacatcttcaatttctgttataagacacgcaaccacaagtttgttaaaagaagaataaaagaaaaagaaaaataagacatacggtgatgggacaaatccttaagtctcttttattagtacatggtagtgctaaaccatatattttttttagctagtaattctaatggaactacgctatttacagtgaaataagagacctttgactacttattttcagagtgtttcttgttcccctgtactagcatagtacataaaaaataaagctaacagaaagacatgaagataaaaaagaactttatcattaaggcaacacaaattgactaacataaaacactccaattagaataatcttttttatagactagttacacctttaagccaattaacaaaaatatttggcattatgggatggagagatattaaaagaaaaaaacatgcatctcaaaaaaaaatctaagaacatgacgctgaaataaagatattggatattgtcttttttgcatagcagaaactacaatatttgtctcccccattaacatgattcttaaagaagatatattggattgactcttatacgtagcagaaaaattagtgctggtctcctccccaatttcttttagccagtgtttgagaatcttataggagctgtaactactctcaaaatctccatctctcgtagataatgtatattctcatccatattatgattatctatagcaatataatccaaaataaaataaactatggacctgaaaaacctagttttttcagattaagtttatagcgaactctcctaaataggctagtctgaaaagaaaaggctatggatcagaaaaactgtagccagttagtgtcgatgcatatgtgtagggaacaggaaaacaatctcgtgcagagttgcaggaaccatggatctcatatgggttagggtcaaaaacggccttctcctttccaattgatccatcgatcacttggagaaaggcaggcgcacatcaataatggtctcatgtttttccattggacgttgcttatgaacctattagtgcctcacaattcgcaactgcaagctcttgtcttgtcttcggtgacattggctggacaggtcgctcaagcttgcgacttgaaaaaaaaggggagaatgggagatcatatagctaggcccacggggtttacaaaaccgcaggtaaccgtgcttaccgtgggggtacggtgaaaagaaaaccacggtaatcttcttaaattcaaataaattttaaaaataatttaaaattttgataagttttacatgattttgtatgatttcttacggttactacgcggtaaccgtacttattgccggacacggtaaccccggtcccgacagtttgagaaaccctggacccagcacgtcctggttctaaaccctagggcaggcaagaattaatggttttggccagcggctagctgctgtcacctatacctaatttcctatctaccttgaacccggaacagcaaaggaaagacataacaaaaagaagttcacaaatttttgtatataaattctcactttatgccttctaaatgtaccagtctagtatctaattcagtaatagcttattatattttgaaacagaggaaacgctcaacctaatctattgttactagatggacattaatttataaattgttactagatggacattaattctcttttcaaatatatcgctgcaaaagcctttatcgtgattcacaaattagtacctgtgtcgaatgatatatatagacagggtcgggtgattcgttaccgtgctggcatcgtaagtgtaacagtacgtgtttgtgactggcctgccggtgatgggtcaaacaatgaaaactcgtgtatctctatcgacggccgtgtccccccctccctcctcccccccgcccccctctgcactctccaacttaattaacttcctcagagcaaggccaataatatagccaactatcgactccaaaatatctatagccaatctaatagttcattcatacaatagttaactatctaaatatactacaccattaatacccggtcccacctcttatacacacatatcatattacaatccgtgttgcatccggctactaatctatatcccgcttttttctatatcttcttttttcttctacatatatggttatagctggcttatagcctgctattgtacctgctctcagcaggtataatagggggctgaagagccggcgataacaaatccaaaggctgagttggtcaaaaagctaatgatagagagaggatcggcaggcgactaattaagcgcagcatcacactctccaaaaaatgtgggacccgttgcatgctttctactccctccgttccaaaaagaaccaattcctggttatgaatctcatagcaggaactggttcttttttagacggagggagtacaccatatagaataaagatgtgacgtagaatgagagaaaagatagaataaataaataatagactattgcaactaaagaaagatggatagactacttgttgtatgtattaattttttaccatggctatagcagatgtggcaattactggattaagcagcgagcgcttctgttagccttgctctcaacaagcggtggctaattaattaacttacgccaacgacacgcatgcacacacgcgcgtaggataggacgtacacacgagcagttggtcggccctcggccggctgctcgggcgcgtgggaattacgcggctcacggggaaaatcgccgacggccggcggcgacgccagcgagacggctggtgctgcgtcgcacgtcaaaattaacatcgtccggctgctaccgatcattcgctccaagccaccaactgaccaacaatcgcttttgccacgcactcgtaaatcctaagctaataacaatacaaaggtcctaaagcttgatgctttgttgatggctgcttgtccgggtaagcgctcgcctccagtgaccagtgataattttcgtaagaatacttaattaattagatatctatgtatctaattaaaaaatacataaggcattggggataattttcgtttgttgttgtcatcgcattctatgtgatttttttcaagcgaaacgggctaaactttagggtttacttgtttaggatagattttaattccgagcataatacgatgtgggtttgctccgattcttagaaaaatgaaaagagcagataaggataaaaaaccccttgatcaattttgaaatacctccaagggtgcagccgaatttcacggaggggcttcaggcagcattgaacagcgaaagaagaaaatgaactaaaaatagtctagataaaaaggaggatttttatttaaataaatgctgaaatgatgtttgtattataaaaactagcatggtggcccacgcagattgtgcggctatcatcgttataattttttcccatacaatatcatatatatttttacattttattattgaaatagattgaaataaaaacataattttaaattatgtactaacttgataaaactaaccaatacgcaatattcatactgtaatgcatgtgcatgaaagtaattattttttattttaattatttctaaattgtatttatatataatttatactccttttttaatatttcttatttgttaatttcatatttctgttatttttaaattgtattcctatatgaacaatagattgttcttccaatatttcttatttttaattatgagtttatgttatttataaattgtattcctatatggactcaagattcttcgtccaatattttatttttttatttcaaattatagttatttctaaattatatccctatttggaccctagactctttttcaatcttctttttttaatttttttatgaatttcagctatttctaaatatatttttatatggactctaaacgttacttttaatttttcttatttttcaaattcgtctttcaattagctctaaattcatatatagactctagactcttcttccaatattccttatttttaatttttattcggaattttaattagttcaatatagactctagacttttcttttaatatgtcttaatttttaatttcgaattgattaatatgagaatttgtaggtcgtgagagtgattgtggagcctttttttcttattactttaataaatcaatagacatatttctatcttttattttttttaattaatgtttgttttcctagataatttgaacgaacatggaggttccttttattaccaatctaatatgttaatttgctacacacaaatttatttgttagacgatcctttgctataagattccgacattctcgggtgccaatttgttaatgaagtggattctggcggcaaaacttctgtcttgctaatttggtggcaaagctgattgtggctaaaagatgtatggctggatatttgtgctttgtgttttgctttcattgctaagagtatcgatctatttattactatatgaatcgtgtataattcagaagcgtataaactaataccaacatggatgctaattccatgtatgaatctaattacgattggtttgttaactgttgtccgtttcctacactataaccatacatgagtattgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctaaaggcacccggaccccccttatatataggaaggagtccggattacaaaagataatctatgtccctaactgaatacagtcgtgaccgactaagtctcaaggtgtttccttgatatacaagttaggaaacaaacccaggatacacataagatattctatctatactcggtatcctatattcaatccaaatatcatcgccgtatagatatgggatatccataatctccacagtagcccccgagacctttgcagtcaatcgtcgtagccttctcaaaaataataatccgagtgcttcaaacttttcgtgccaaggcctgccgagtagcgaagacaaagactgtaaagggcgaaaagataaaaatatggtgcatcgaatagatgcacctaattaggtgtagcccccaactatgtgattagttaacgaactaaacatatagttgagagaccaaataatagcacgatcgtgcatcatatgacaaaagcacacacagcgcctaaataggcatgctagccgaccgctttttagccataatgaaaagagtccgagtagtttacactctaaaaaggttcacgaatgaacacactggacaggcatccgaatttaaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaaactaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggccgaagtactgttcaggcctaggcccattcgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaaatgcatcaaaatccttcccgtgatccaccgccttaatccctcatttctccctagccatccctcgaatcaaatcagcgcattcggatagaatcgatggcggaagagaaggaaagcttcgaaggccaatgggcgccgtccgacgtaacggaagagaacctgaaggagatggtggcgcacggcgttctcccagccaaggagatcatcggatggcggccagcgtgcggtgaggcttttccgacccctgatacacatgagatcgtagtcttctcgcatttcttctatggcggcttcgctcttccgacctcgagatttttccgcgggatattaagcttctatggaatcagcttgcatcacctaaacccgaattctatagtccacattgccaatttcatccatgtctgtgaagccttcttaggaattaaacctcacttcgccctgttccgccgaatcttctttctcaaaccccaaccaaacaagagtaagccatgtgtagtcggaggggccggatttcagctgaggggaactctgagccagaaatacttctcaatgcccttcaagacttcaaacaaaggatggcatgcgaactggttttatgttcagaatcttgagcctgctcttcccgaatactcttgtcttcccccggtgtaccaagacacttggaactctcttccaatcggagatgaagctgcccaagccttggaattgttggatcgcatgttaaaactcaaagaacaaggcttgcaaggagagcagatcactcggcacttcatcaaatgccgactggcgccaattaaagaaagatcccgtacagcttttgagtttgacggcaaacatgatcctaatcgcgaagaaccagactctctggatttcaaaatcatgaaggagagaatgtataaaatcttctcaaatgccattgtcgtcagctactcacaccagctgccagttgtgccgtataatgcattcaatccgcctccgcaggtatgtatctgaaatcttcaacttatgaccaaaatagtatcttgtcttcatgttgagttaactaaccatggaggcatctcattcaggaatacgtattgatgaaatctgatcccccaattgctcagcgccgatctcctcgccagcacaccattcagggaagcggagggccgacaaacaggtcagacccacaacctcaaacctccaaaccagctggtcagacaggtcctcgtaagagaaagctggtgcttaatgacgacgagggcgatgacagcaacaaatctggggacaagggcacgcccaacaaactcccaaagcataccatgcccaggaaaaaactggctggccgtcaaatgccaaagattagaacatcttccaggtataaacttctcggtaccgtctccctttgatatgcttctctcatagaaattatactgaatatcgaaaggacactttgcaggaaaccgtccgacatagatccaactggaaaagatcctgatccggctgtgacagagccaaatttatccaaagacgctgagccgtctgccgaaaaccaaccgactgccgaaagccggccgactgccgaaagccagccgactggcgcccatgcttcggatgatagagccgatccgagtgaccagccgccaactggagaccagtcgggaacagctgaaactgcaacaacacaagagcccccgactggaaaccagtcggatgtaggtcccgatgaagaaatccctgaagttgaagcgcaaacgacaacttcccaaggaccagaggctggtaaagactcaatgattgggtctctaaatacagaacaaggaccacctcatgttcagccaggaacatcctcaggtaacacatcttctcaagtgatgccgatttaaataacttcagcttactcgtccaatgtcttggaaatacatcaggaacactaggcgatgacgaagaagcaattcctcgcataaaggcggctaatgactcccgtcctcctatcttgctcaaatggtgggacgagaactcgcaagttgccggcatcgttataaatcgtcaaaaagaaaatgaggaagtatgccagctgaagaaagtacttggagaagccactcgcattgtgaatgtaaatcttccgggtgactgcctttaataactttgttctctcttttagcagaactgaatcatgatccatcatgcagagaatccatcttcgcaatgaggccaagactacaactttggaaaagctggttcctcatttgggagctcttgaagcagttagggaccagctgcatgaggccaaggagtatgctaaaaagacagagaaggagttaagggaccgaattgcccagctccaggattcaaacttcgagctaagtggttcatcaaaaggtaaccttccagatctattccattgatttatgctgtcataactgtatcctcaaatatttggatttcaaacagcacaagctaccaggatggcacaaatggagaaacagattgaagccttgaaaagagacaaagtagaactagctgtgcaaagggactcagccttgaaggaggttgaaggtactgccagctgacaatttgaactttcctctctttaatgcagcaaattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaatgacagtggtccgagtgcacttgacgcaaccgaaatctttgacaagctgagagtagcaccggatgtatacttcaagaatatcaagaaagctggaagtatgggagctagtatggcattggcgatgaccaaatccttgtacccgaggattgaaattgacgccattgatggctttgcagacgggacaagcgaagaagctgctcttgatcttatcagtaatgctcaaaatgcagctgacaagattgcaagtgatgttgtagagcaattccgcaacaacgaccttcagccgagcaataataactctgatgatgaaaagactgattctgactgagtgtaaatgtagcaaatggaggcttaatttgtacaatgctggtgtatttatgctgtgcttgatagttctaaccaagtctttgatttcttaaaagcttttatcaagctttgttgagcctaaaacccaaagaagctattaaaaactttcagtcctcgcagactaagtagaaaaaatcaaacaaggtaatgatagaccaagtaagcaaattaaattgataaaaaatcacactccattattatgatgatagcccccgactgacaacggcaagaagaaaacttgatgttgacagtcaagatagggaagtgcaatgataaacttaagcgtagaaacgacgaagatgttcaatgttccaagagttgtcgacaagagtaccgtcttcgcgcttgagtcgataagaacctggccgggtgacttcaaagataataaatgtcccttcccatagaggagataacttgtgccgatctcgtgtagtttgaattttcctcaaaaccaggtcaccgactaaaaaggcacgagaccgaacattgcgattatgatagcgccgcaacccttgtaaatatcgagccgaccgaatcaaagctgcttcgcgggcttcttccaattggtgcaagtcatctactcggtcttcctcgtagcgttcttcacgaaaattacgaaagcgcaaagactcaaattcgacttcactcggcaacattgcttctgccccatagacaaggaaaaaaggtgactggcctgtggcccgactgggtgtagttcgcaaagaccaaagtaccgatggcagttgttgcacccatttgccggcatagggttttagccggtcaaagacacgcgctttaatcccttgaagtatcatgccattagctcgctccacctgtccattgctcatggggtgtgccactgaggcgtagcaaatcttaattccgaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttggcctcaatccacttggagaatttgtcaatggccacaaagagatgcgtgtaacagccaactgcctttttaaacgggccaaccatgtcgagcccccaaaccgcaaacggccaagacagcgggatagtttgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatttttatcttgagggagctcttgagaagttaaaaatcgtatgaagggctctcgccagtcggcttcaaccatagctacgtcatgagtgtccgcatcttgagtagtatctttatgaggtacggtcggtgtataaaggtgttcgacgaaaacatctgagggcgccgcctcgcgcttggatccaaaattggcaagtctgtcggcggcttcattgttgtgtcgaagaacgtgactgagctcgagtccttcgaacttgtcttccaatttgcgcacctcttgtcgatatgccatcatattgtcgtcaatacaggaccactctttcataacttgattgacaaccaactgtgaatcgcctcgaacaatcagacgctttatccctaaggaaattgcatccgtagtccatgaaggagggcctcatactcggcaacgttgtgggacgccgaaaaatgtatccaaagcacatagctcaatctttctccagtggggaaatcaaaaccactcctgctccagtgcccgaaagtcgtttggatccgtcaaaatgcatggtccagtgctccatgttcttcgcgggggtatcctcctggcac

SEQ ID NO: 39335 - DNA, 12950 bp, Oryza sativa
aggtgcacttttcagggttcaatttcatcctgaaagcacggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtgatgaatgaagtcttcaagcagtcggattccttcagtcggatctgatgataccccgagtagcaatccagaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaactgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacgtgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttccccactctttgaaatcttggtagcgggcacttctccttcgctcgccgtggctgcagccagtcggatatcctctcgggcggacgccatctcgcgggtttgagccatgtcgcaactctccttgtcgcatgtgacggcttgcttgatgtcactccgtagggataggactcctcggggaccaggcatcttcatcatcatgtaagtgtagtgtgggacggccatgaacttggctaacgccgggcgtccaagtatggcatggtatgctgtctcgaaatcggcgacttcgaagctgatgttctctgtgcgaaagttttcccgagtaccaaaagtgaccgggagggtgatctggccgagtggagttgcggatagtcctggaattactccgtgaaaaggcgcattgcttggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcagtcaacttttgcttccgtttagactcataagccaaggggccgccgaagatatggttgagctccttgcggtggtcttgaaatcctgccggggcgtcgccgtcgtccttcttcctcgacgtgctttgttcttcgtcggagttcttccgtgcagtcttggtgtattgatccgcgaattgcttatagacgaaacaatctttggccatgtggttggagttaggatggtgcgggcattgggagttcatgatcttatcgaacgtgttgacgcgcgaacgctgtcgggaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagctttggcatactcgttggctttttcaaacatgagcttgactgtcctgggaggcttacgcccaaacttgccgactagttcttcgtggcgaatccctttggtgaacgcggcgatgatgacgtcgtcggtgatgtcggagatcttgttacgttgttcagaaaatcgccggatgtaatctcgaagggattctctggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtctggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggtgtgtggacgctttcggagttaactgggaccgaagccgcaatcatggtcttcgtctggttcaagatgttgacgacgtggtcggatcgattgagctcgttttggttgaggaggatgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctcagcctccttcgcggtctgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgtagcgagaactaaattcgtcgtactccacgatatcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagccgcagtcgtggtggagacggccgctaaatcgtcggggagcttcatcaggactggtgggtaagccccatcatcttgatctggtgtcgttagagaagatgcgatctcggccgggtggtttgaagccgactcggttgagatggtcttgaagtagctttcagccgcgttcgggaatccaaacgggaccgaaattcggttctctcccgactggtctgattccgagtcgaggagagaaatcttgccgaagttgttggtgacgaagtcgaggctgccgaaccgaaacgtctgcctgggcgggaagacgaggtcgtcgatgccggaggtggaacccattgcactgatcggcgaaaagcttgacgcggcccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctaaaggcacccggaccccccttatatataggaaggagtccggattacaaaagataatcatgtccctaactgaatacagtcgtgaccgactaagtctcaaggtgtttccttgatatacaagttaggaaacaaacccaggatacacataagatattctatctatactcggtatcctatattcaatccaaatatcatcgccgtatagatatgggatatccataatctccacaagtatttattgttatatcacatttccaaaaagaatcatgtccgtttgttttttcttctaattttcatccgagtaagagttgtgatcagtttcctaaacctatacaatgcatgagtgtgtttctggtatgtcacatttccaaaagaatacatgtccatttgttttttttgtttttttcttcgattaacgtgataatatctagaccgcgagaatgaacatggtggcttttttttctattactttattaagttaatagactagctattaagctctgaaaattttgagaaaatttagagagtgcaattaatcacggataatttaataaaaataaaatccagccatgttattttatttcccacacttattttacttgtaaattaatttaattatacacacccaagtattttgggaaatttgtattttaattaattgtataatgtgaatctttcttaacttttcctcatttttttttgccttttcttcccgttgcaataaacatgcctgtgtgaacagcgagcttcttctatttacctagtgcctcaaaaatacagtctctcttgtgatgactttgttgacactgtcacactgaacgtgcaagaagagggttacccaaaccaccggagccggggttactgggccccagcagtaagcacagttatcgcgcggtaaccatgagaagctgtacgaaacaatataaaatttattaaaattttaaattatttttaaatttatttgaatttaaggaggttactatggttttcttttaccatatccacagtaagtgtggttttcttttatcatatccacagtaagcgcggtaactacgtggttaccggcagtttaggaaatcaggtcacccctgcattgtagagaaaagtggatcgattactttgctaaaaggaactaggcccggtccactagctaggtagctaggggaggcaagaaagattttgccctgtcctactcctaatttcctatccatcttgaactaattcatcaggaacagagaaaggaaaaaaggtaaatgctgctgcagctgcagggacggacgaatggggctccatgcatacatactgtggagttttgctttaggttacgtgattcgttacagtgccgcgccgtgtgtgtccatagctaggtcgtaggcctcgtcactggtcggtgatggtcaaaaaccaccctcttatccatcgtgttcgatcatctccaacttctcatccacaatgggatatatggcttatttcttccttcctataaaataaataggtgaatgctcacgtgttgcaatataattaaataacagaacctgttgtacgctttaaagtctcaagaatcaaataaaattattctcactataaaatcttcttatcatattatttgttattattttgcttcacttcaaaagaaaattatcatgtttgatggcttgagattggaaaagtatcactggtggagaaaccctttgtagtcccggttcgtaacccccctttagtcccggtttccaaaccgggagtaccaatccgggactaaagatcgctatctttagtcccgggtgaaataaccgggagtaaagatcgatctaccaaccgggactaaagatggcttagccacgtggccggctgagccattaccaaccgggactaaagatcgagctgaccttttttttttgcatggcccttttgctgcatggtttatatataaaccatgcatatatatgtttcaatacatatatatgcatacatatatatatatatatatgtatatatatatattatattatatgtatatacatgcataatatatatgtatttatacatatatatgatatgcaaatgcatatgtatatagatatatatatgaccaaaatatatttacattatagaaaatgtgtacacatgtatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttctttgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttaaatttatttgtacgtacatcgagctctcttgtggtgatgatttggtctgcaaggcagtggcaatactcgcacacgtaaaagccgcacaagttagttccctgcttttgctttgcgcactacaaataaatgacaaacaacgagagatcaaattaatatacacttgtatgtatttgaatcggagaaatataaatgtagagcatgtgtactcacaggaaatttgaacttccgcctaagtctttctctccatttgccgcggaccaaatgatggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagactgtaaaattaaactaactctatgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctcctttctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgcttcgatcatctctctaccggtggcgctcatgtccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaactgctcgatctcctggtttggttgctctccaagctgagggactggtttggactttccagaagatgctttcttcagcattcgctcatagtccgatagcttgatggcctccttgacagatgcagacatacccctaaagaagtttctgacactggggtctataggaatcttcttttctggacttcgaggcttgaattgtctcttgacttctgatgcaacgtaagcgtcaagctcctcttgcgtgcaatcgtacctcgggtccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgcgatagaataatggcatggcatgtgtctcgtagatgcatctcaccgtctcctccagggtaatccagctcgaggtcctcgtacgcgccttcgaccaactcaacttcgaccttcgagtatcctgctggaatcggcctgcagtggtaagtacctaaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgacactacctgccccgttgaggcgcagctgctacggtttcctgacgggctcaccattgcaggaggaatggtcggctggggatcatgggaccgatgtgcggccatgcgttcatcaaccttccttgccatctcctcttgcatgttgagttcgtagcgagatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagtgcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattagctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgagctcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccacaggaagggtgaatgtctcgagcattgtggtccacagcatctctttctccgaatctgggacaaagctctcatgatctctgcgtgcccttgttcttcgccagtacaccgtactgacaggcacgttatcccgcacaacccaaccgctatgacgtacatagttcttggcggcttcggccggggcactaggacgtccatcttcttccacttccgttatgatgtgccgaccctcaagcttcttcgttgcacctcgttgcccacgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgcaccaattccgtagtcaataattacatactaagtctaattacaaataaagtaatcttatattaaaactcaaataatattacatgctaagactagaatagtcatgtatgctaagtgtttcgtgcgtatatgctaagtctaattaagactacaatagtcaattgctacttgtcgcaccacttccgcagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaactcaaataatattagaccactacacaatcttatatgataagtctaattacaggtctaataatcttaattaattgcattacaaatataacaatcatttatattattacgtcacttgcctgctccaattacttctagggctagctcttccactcaggcttgacgaacgacactccgacaacacgtcttttctgcaagatacaaaaagatgtattaggataaatgcgaagtaacatatatatatatatatatatatatatatattgcatttcacgttaacgttcgtcctcgttcgttcgctcgttcacgttccctagctcgttcacgttcgttcgcttgttctccttcacgttcgttccctcgttctcgcttgtcttcgttcgatccttctcgttctcgttcgttaacggcggtgtggcggcatcggggcggcggttggcgcggcggcgtggcggcggcggcggcagcgtggcgacggcggcggtggcgtggcgttgcggggccgtggcggcggcggcgtggcgtggcggcggcggcattgcgcgcgcggcggcgaaggcggcggcggcgtggcacggcggcggcggcgtggcgttggcatgcggcggcggcgttgcgcgggggcgaaggtggcggcgtggcgtgccggcggcggcattgcgcgcgcgccggcgaaggcggcggcgtggcgtgccggcggcggcattgcgcgcgcggcggcgaagacggcggcgtggcgtgccggcggcggcttggcgcggcgtcggcatggcgcgtcgtcgtcgtggcgcggcgtctcgtggcgggcggcgcgacggagagcgatcgagatcggagagatcgagatgaaggtagatctggcggcggcggctctcagcccagagatgcggcggcagcggaggaggcggaggcggcggcgaggacgacgagctcgagacgacggcgagatacgacggcgtcggcgcggggatttgccctaggcagtggcggcgaaggagagaggccgagagagatcgatcggccgaaaacgtctaagtgtttgtgaagaagacgagggcgcaccgggaatatatataccccaggatctttactcccggttgttgagaacaaccgggactaaagatatctttagtcgcggttgttgagaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaattctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttacaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcttccgagtatccaaccttgttaagatcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctagaatgtcgcgatcgacccagacggtcccctcgccaggaaggcaagttgttggttgatcg

SEQ ID NO: 39336 - DNA, 1097 bp, Oryza sativa
atcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactattttcccgctgcgatgtttaggcttcgtacggtggtcggccttatgttcgaagtgcttgcctttcttccgtaccgggtggtttggtgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtagattaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccatcatgaagtactgta

SEQ ID NO: 39337 - DNA, 10226 bp, Oryza sativa
aattacattttagcaaaaggaagtgaaattcagtattcaaatccactgaaacatccatttaactcatactgcagtattgcacacttcatcagctgaacagatgaaaatatccatcggctgaacagatgaaaatatcctggtagagcttatatctcttcgatgaacccaaaaaaatatgcaatctttgatgcataaaatcagtaaggtaaagggccaatccacatagcataatacatgttctttctcataaggtattcatcaagaacaataaccatgctcagtgaatgatggtaagaaaattctgagaaaatagaaatcgattaaaagaagttctgaacatgccaaatatcaaatatataacagtgcgctgttgcaaatggttatcagttgcagtctttcttatgcttgatcaaatcacttgatgttattatatcattacgatgaaaaggaatgatattgagctgaaagaaatggaagatagagcaaatccttgaatcttctgaaagcaacgttataatattctttagtgacgaacaaatgaaataggaaggtagagagatagtggtagcatataaggggaggccaaacttcctcgaggaaccatccaggtagaaggtatctttgagcacctcagcttacggagtatactaaatcttccaaacaaacccctggctttctgtttaggggaaaagagagaaagattaagctggagtgagaggacaatggctagcaagtgataacaagaatgaatggatgagaaatataaaagataatatcggcttacctgtagtgagaggacaatgtcactgctgtccagctggtgcagattcatacttttggacaataagttgatctagggcaagcagcagaagctctaaaatggatcagtagttgtcgaggcaagaagacaacgatttcaaccatcagaataaaaaagggcagcctcaaactccactcctgacttggccatgtccaaaatcaatgtataaaggaaaatggtacacatcggccttctttttgcggattgaagatcaacaggagtagcgcaacatacagaagaagctgtagatacggaatcaccaactaccattctatacatatgaaataggtggcgagtgctagtagggatcgtagttacatctttgtcatgctccatgtaaaatccaggcttcagttctatcttcttgtctccatcagactgcaagatgattgttatgtgtgttagtctgtcccaggaatgcagcactgaacatgggttcagaaattttattacttactggcccgccaagatactgaaatccagccagctccagctccttcagaatcccgtcctctccaatcacataaacctgaacaattaaaatgttaaacatgcacacattatttgccaaaatcgctgaacatgaacagtataaatggtaacgttgtgcacgtatcttcgtaccaaaacatgttaacttctgaagatggtgatataaattagatactcctaccttcttgtctttggggaaatcgatggactgcaggtacgccacatatgcgaacgacgaagcgaagatctcttcctgcatagagcgttccaggctcatcagaccagattggttgcacaaagaaaatttggtagttcatggcatgaatcctacctcattgacgtttagtcctagcgtctcaaacttcttcccgtactgcttcctcgacttggtcgagttgttcgtcacgaataccagcctcttgccctgcaacaccacaaccccatcagcttcaactccaacagattgataatgctaagttggaatcggagttcgagaagaccattgcagtttgcgacggacctttgatctagcatgtcgagcgtctctagcactccgtcgatcagcttctcgcccttccaaatcacacctacgctgctacgcaacaaaaagaacgcgacaattcataacaaaatcacaaccaatcaaccatcgagcgaccagcgtgccatctcaccgtcgcagtcaaatatgaacgtctcgacggagtcgatgagcgtggcggcgtcctccagcttggccaccgggaccgcgccggcgccgccgccgccgccgccacgacgggtgtgagcatggctggggaggcgccgctgggtggtcagcacgatgggcgtgctcccttctggcatcaagtaatggagaggaagcaccgaggggaggggaggcggtggaaggagctgttgcgggacgcgacggtcgtcctccctagggctacaggcgcgtggcgtggctgacgcgtggggatggggggaggcagtgcgacgcggggatgggaagcgaccgcatcagaggcgggcccgcggcgcagctcgcgcgcgcgcgcacgggggaggagaagcggcgcgagggtgaaggagaagggagaggaagcgccgcatccggcggcggcatagcctctgcgcgatgcggatgggttaggagaaaccgaaaaatcctggaaagaagtgggctgggcttcacctgtgtgcgaccgtccagatcagatcgaacggctgaggttttagtggtgacgtggcttaatcacagatcagctttgggtctcaactatatagaaagagggattagctcaattagtgtgtgctatggatggtgattcgtgggtaggaataagttaagggtccgaaaactgggataaatgtgtgattgatgatgaagagctatagtttcatcggtattattcatgtgaataataacttactttttattctctatttttctaacaatatgtatctctaatttaattactgaggagctgcaggtttgcgtgaatttcatgagaattggattctttttttctctattaatcctatgctgcgtcgtccagacctttttttctgcttagtcatcactcgttttttcttttttttttttgctcagccgagcgtgcttgctgccatttggagaaaacacatgttttgttttattaggaatgcatcttagaatcacaatttgatcttatttttgcatttgaattttcatataatcaaaatgcaggatatcatatttcatgtataatctcctacagagtctactaaatttatttctcatcgaacatagtttgacaaatcagttttatttattgttaacaaccaatatacttttcactcttagctcaattattaaaaaaacatattaaaacttacttagtaattttcatagcaaaacgcggggaatcacctagttaagtacaggaggtgttggaaaaaaagtatataggaggagagagagagaggtgatcgataccaggaggtgtcgaaaaaaaaagtgtataggagagagagagcgtgtggaggagagagcttgcatgcgcgtagaaagagtggaagagagagaaatgaggtatgcatgcagaggtgctatggagagaaaagtaacttgcatgttgggaaggggcacatcgggtacccgatttatagttgggtctagttttgattcaacaaccggtctttgcaatccatagtgagtttttttttaatatattggcccatgcccttacgaaaatgttaaattggaaaaataccactatgaaaaccaaaatcgggtggatgccactcatacttctataaatttaccatgccattgtcatcaagattttatatcagatatattgtatatttgtggtctcgtatttaaggtattcataatcatactattttgtttctacagtccttttagttttttattacagtactatcagcaatatttatcgagaataaaataccatatcttaatttgcactacttactttactgtttatcattaatttactttttatcatgttagtaatgtttattaatatcactttataaaaaaaacatggtttatagagtatatattgcaaataaaaaggtttagggcctatagaatcaaggggctcttgaaattatagagccggtcttgccctcttgaccatccgccggtggttgcttggagaggaagaaaaatgatgcatgtttcctctttgacggaaatatttatggcgatggcacatttctaattttatgataattcagtgacacccacctagtttcggctttagtagtggtatttttccaatacaacgtttccataatggcacgatcaaatttacccttcttttttcaaatttaccaaaacaactaagatctcagagtcagaatcaagatgggaggaggggggaagggggagttcttcgatttagatgaatgtcgaggtggcggcgacttgatggtagaccacgacatcgtgagggaggtgagacgggcgacacaccacgaagacgtaataggacggtggaggcaaatgggggcatcaagaaaccagtggttaggtgacgacaatggcacatcctatggcggaatacaaaggaaacatcagagaaattaaggtagtgtggggctttagagacaaagaatatatacaggtaatgggaagaattaattgagccagagtgccagagcagaaggagacggtgttggggctagccaaacaacatctctagtgggtctttaacggtcgtagcgagatagacaagtggtggcacgtagaacagaaatagtgatgaaaagacggtggcggtggaagctgtggcatagaggagacgctcatatgagtgggttgagggtgggccagtggaggactggtggaagatagcaggacatggacagcagttggatcttaatccggtggtaaaaaacttgtcatatttaaaggggagtttttttaaatatgatatactatctgtatctcaaaatataacatttttttactgtgtatttggggatctcagaaattgttatattttcagactgaggtacgtaccatgcagtttccaaatttaaaggcgataagctcactgtcatgcccactagtccagacggtgtttaacccatcacctgattaaaagaagaaaaaaaaacagggtaaaaacagaaatagaaaaaaataaaaaaaattctagtggctcaggaccagtgcaagccacactgctccacaaaggcagggtggaaggagtcctccttgccgctgccaccattcgtgccagagaaaatcgctgttcccctgctgcatgcatgcatcgccccgccctgaccacttcacctgcctctccatatatacgcagtttgcagcagatcagacactctcaccgccgctctctcttcctctccaacatgaatatgccattgctactcctcatcgccatcgtcgtcgtctccctctcccatggcaacggggagcagaccgacctcacgcgggagacgttccccgcgggcttcgtcttcggcaccgcgtcgtcggcgtaccaggtggaggggaacgccctccagtatggccgagggccctgcatctgggacaccttcctgatgcaacctggtgagatcgatgatacatgttcaggcaaaactagcaatgtggtatctaaatatacagatcataaacagtttgtcgcatttttcaaataatggaattaacaatgtgttgggacgatccacctaaaaagagaatatgacaacaacaatctaaaaagaattacatagcctgatattgaaatgttgttgcattacggcgcgttgcattttgtacgtctctagtggatgtatgactggttgttgatttggctctgattgttcctttggataggtgtaactcctgataattcgaccgcgaatgtgaccgtcgacgagtaccaccgctacatggtcagtgaaagtctcatgtgtttcagtgcctgttctaatgggtttctgttcctctgtatgactcttgatttgtagcttatgtggctcctctgatgatcttctttgcaggatgatgtggacaacatggtgagagtgggcttcgacgcgtatcgcttctcgatctcctggtctcgcattttccccagtaagttaccggctgaaacatggtcaggcacagtgatgagatcatgggatattcctttcattgatggtttttcttctgcgtgttgtaggtggacttgggaagattaacaaagacggcgtggattattaccacaggctcattgattacatgcttgctaacagtacgttggtcttggcatttcttctagttcttgcccatttcggatttcatgatctcgaattaataggtttttttttggtttgatttgcacatcagacattattccatatgttgtgctctaccactacgaccttccacaggtgctccatgatcaatacaagggatggctacaccccagaattgtgtaagtgttcgtgatcaaagccatctgtttggctgtaaaacttaaaattaaataccctttaaattgtttgacaaactacagaagcacctctgaagattttgtgctaaattatgaaacccatagctctctaactgcgaaatcctgacagtgaaagttctgcaggtgtttaaccaaaataggtttcactgtagcatatccgacatacacaaatatcaaacccagacaatctgtatcctccctttcttacgttccttactccctttttcttgaattaatgtgtgattcatgtctgcgacttcattttgcaggagagattttgtgagatttgcagacttctgcttcaagacatatggtcataaggtgaagaactggtttaccattaacgaacctaggatgatggcaaatcatggctacggtgacggcttcttcccccctggcagatgcaccggctgccaacccggtgggaattccgccaccgagccttacatcgcagcccataaccttctcctttcacatgccgctgctgtcaggacatatcgtgacaagtaccaggctagtgaatgatatccatgcccctactatccaattcaacatttcttaaaatctccaatgtatcagctcatgttcatgataccttgcgattttcaggctattcagaaggggaagattggcatccttctcgattttgtatggtatgagccactcaccgacaaagaagaggatcacgcagctgcacatagagccagggagtttacccttggctggtgatacatcttacactgttcatcaatcattgctcttacacggtgtccgcatgaaggttgaactgaacttccacttgaaacttttgctaggtacctgcacccgattacatatggtcattacccagaaactatgcagaatgctgttaaggaaaggctgcccaatttcacacgtgagcagtctgagatgataaaaggatcagcggattatattgcgatcaaccattacacaacttattatgtcagtcaccacgtcaacaagacatccatcagctatctcaatgattgggatgtgaaaatttcatgtatgacactttcaaatcacacagtattagaccagaaatatttgtaccttttcaattctttgccttcctagctaacacattttggtcctctattcagatgagcgtaacggtgtgccaattgggaaacaggtaagcaacaatttacaagaaaggttgaaaagaatggtagatcatgaactaaattctggtttttaaacatctatgcaggcgtactcgaactggctttatgttgttccttgggggatctacaaagctgtcatgcatgtcaaggagaagtacaaggaccccattataatcatcggagaaaatggtaaataaagataatactggagaccctttcaattttcggacagtgaacagtacaactataaaagtgctctgcagaatgaatctaggagcaaaatctaacaagaaccttttgcaggcattgaccagccaggcaatgagaccctacctggtgcactgtatgacttcttcaggatacaatattttgatcagtacctccatgagcttaagagggcgatcaaggatggtgcaagggtcactgggtattttgcttggtccctgcttgacaacttcgagtggcggctcgggttcacttcaaaattcggaatcgtctatgtagaccggagcactttcacacggtaccctaaagactcaacacgttggttcaggaagatgataaaaagtgaggtttgagttggattattatcactgttggcagctgctggagtgcttttttgttatgctagttttggttgtatgaataataagatgtcttgtactagttgagaacttcttcagattttgtacttctagtattctactttttgtacttcagattttgcaagcaaggatgattttagtttaatagattcaggacatctatatatactggtgataagagaggcagatttcaatttttggcttgaattgcccatatttgtgttttccaatgttttttaacttcaaattttaaactttggaaagaactacagttttttttaacacacaggagctctgtgtcccacttgaatagaagaaaaaaaatccattgccccttaactggtcaagcttttacaaacattaaaatgatctaataatggttaaagaaaacaacatcctgggaggctatctaaagatctagccaatgcactttgctccacccagcctcgattgagtacatgcggtctttgatatcatccaccaacatagatatgttcttaaaagaactattaaagattctaggatttttttttaaccaaatggagtgtacagtgatgaggaaaaccaagttgcaacctttttaaatgttcagaatgaatttgatgccatacggaaacccatcgatctcttaggtgaaaaagaactacaatacaggttgatactagagtatcagttacaagatgattagataacttttatacccattgcaataagattacattcttaagtataacaaacttctagttctttatctattttaccaattaaaaaaaagtatatattgatgaaaatgcctgtggacaccatagcctcactttgtgtactttttttttacgggaaacaataggagaggctactactgtattatattaataaatataatatttacagggtttatgtacaaaagcaataaaaaaaagagttagatgtccccatcatttgatcagaatgctgccaagtggacagaagaaagaatgagaggagaggatccatcacaggatagggctggctgccccatccacacaagccaaaacagtcccagcacctcttttttttttctctcttgctttgttccattagcacacaagactgaaccacaagtttcagacaagggatatactaccatcctgaacaaacaaagcccctcctcttgtttgtaccttgtttttttttataacagctcaagcacagggagaggagggttgaggagagtaaacaagaaaaaaaagagagagagatggcagcaacagcctccctgaagagcagcctcctgctaccatctcctatctctgacttcagtagtgcagcactctccatctcaacccaggtaatctgaagaacagaaaaacatgaaactttcagttccatgaggttcaagcatggcagaaaagctaagagatggttgtgaattctttatcgacaggctaggaggaggtcatggcagccaaggggggcaaggatgcaggtagcagcagctgcagactccaagaacattcttgtgatggggggaaccaggttcattggtgtcttcttgtccaggctccttgtcaaggaggggcaccaggtatgtcagttgtgtagtgtgatattttttcccctgtaagtacaatattttctgtgttttggagaagtaagttaattgaaaaactgtatttgttaggtcacattgttcactagaggaaaggcccccattacccagcagttgccaggagagtcagatgcagagtatgcagagttctcttcaaaggtgtgctgtttcctcctatcttattcctgtgtataccatgtaaaagaggattgtccatttgcagtgtgataaataatactgcagtagagatgctaatgtatacacaaggtattataaaatttctaatgtaggattatttaggaattaggacagtataaaggcctaactaatgaatatcttgttctcaacaattatcatttaagttcagtgagatggcgttaatttgggatggttttttctgtaggtgttgcacttgaaaggtgacaggcaagactttgatttcgttaagacaagccttgcggcaaagggcttcgatgttgtttacgacataaacggtaacacttcaaagccaaaaaaaccaccatagtagccctgcatagatcataaaacatgtcaatgctaatggtcactgtaaaccagcctagcaacttcaaaaaacagcaatcttccatc

SEQ ID NO: 39338 - DNA, 1935 bp, Oryza sativa
ccaaggacttcgatttcgggaagaagaaggccttccccttcagagaccaggttatatattatatccagcaatggcttctctgctaaattgaagaaaaatttgctgctgctgctgctgctagtgttctgaattcgatgtgattgcaacaactgcagcatttcttcgcgtcaatcgagaaggcgaccttggagctcgggtggaagccggagtacgacctggtggagggcccaccgactcgtacaacctcgacttcggccgcggcacgttcaggaaggcggccgacttcaccaccgacgacatgatcctcggcaagaagctcgtcagcgtatgagctcgccgccgtcctttccggacagcggacggattgcttgctgcgcgacgcgagcggctgaccggccgggccgccatggccggtgggcaggagcaagcggagacggtttcagttttgttatcaacgctggtttggtacaatatggatagttggatacacgcgtacaggcgtaagctgcaatgtattgggattgggaaactgtaagatgtgatacaagggagactaaacttcatctaatatatatgatataactagcaaaatgcgtgtgcttcactacgagtgaaaagaacgttgaatgctaaaaggcacaactaaacatgagcataaaacccaatgatattcacggctgatataaacagcagtattgcaaactgatagactcgtatatatgtagtagattttatatgactccataataccatagtatgtacagtaattcatctagctactagttccttcttggtctgcccaaccccggcggaacgagatgaagatggggattttccatatgcagcgaagaggccacgtgtgcctcaagagtagagcagaaaacaggtagtgccaaatcagacaatgtgtcttccttgtcaggtgtcaatgcctccggttttgattcccaaggctcctccggaggacctgtccgactggctgcttcgagaaaccgaggggtaggattcaaaccacgagggattgatgaggggcggaagcagggggaccgatagggctgccagggggcagggccaggggacgggccaatggcttaagggagagatctgttcccagaccaagggacattgctggtggtctcaagttagaacaagaaatctagtaaagttatctcgccgagggatgattaggctgttggggcattggaagttgtcagcttggctttggtaccaccgggcaacaaacctcccctctcaagctgtgggcggaggatacaggtgaaatcgactcgaacaagaagcgagagtgcttcaaccttgatcagcggatcaagcggtggttgtggagtagtctcgccagactcaatgagtatcttgtgctataactgttgtgggctggggtcaggtgtgatagtgagtgagcttcgctggctggtgaagactcaccctcctcatctttctctctaagccgatgttcggcaccccttttttccaacccctctcctcgttttccatacgcacgtttttcaaactgttaaacggtgcgtattttgcaaaaaagtttctatacgaaagttgcttaaaaaattcaatttaatccatttttgaaaaaaaaatagctaatacttaattaatcacgtgctaatggaccgctctgttttccgtgcgtactgttccggttgggaactaggaatggcaaacacaccctaagacgataacaaagcaagaaacatgatgtggtccttaggattctcaagctcttttgccttcagctgcaatataatagcctcaccagggagcttgtcctgttttgatcatcagtttcaacggaaggggccattgtctatagggaaccaaagcaggaattgagacatgtgttctggacccttgttcgccgtctccatcgttaatggatcggcccatgtttttgttgtgggg

SEQ ID NO: 39339 - DNA, 3277 bp, Oryza sativa
  unsure (1)..(3277): unsure at all n locations
attgattattgcaagaatgagcatatgacatactcaacaagccacacagcaaatatgcaagtgcacaagaataccaaaggatggcataatataggctcatttgcgaaagcgcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccatgcacaacataatccattacagcgcacctttcctggatcataatcaccccctcaaaaactagaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcanaaccatgtgctcacaacccaccattatcaagttttagttggcaagtaattaattaaccaatcacgattaaccatcgtgaactgtcattaagccatccttaaataatagtgagtcataagtcatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagatgaaataaatagagaatttaaatataggatcaatatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacaacgaccgacgacggccggcgacgaggaggcgacggcggcggctcgggttgcacggggcggcggagctccgatgaccagcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacggaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaacaaaattggagaaaaagagcaacggggaggcgagatttggaaggaagaggcggcggcactgtgcacggcacggctggctcgggctctgcctgagttggaagatgaacagtagcgcagggaaagaaaatagacttttctggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatctgagaaaattccagagagtataattaaccatgaagaatttaataaaaattaaatccttccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcgtcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtatctgagttgatctcaccactgatgcccaactgttgtgactgttcttgacctgcagaaaaagattcaccaatttggagtggcttgatacgctgcctctggctactaccttgtgcctcctgggatacagtcattttccttttacggttatccatcttgttcttcttgtcttccagtcgaattgctttatcaaccaactcctgaaaatcctcatagtcatgagagatcaacataa

SEQ ID NO: 39340 - DNA, 2667 bp, Oryza sativa
ccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataagaaagaaaggaaaattttcacaaattatgttttcggaagatttgtccttaaggtttgaccatttggcttatcctacagtatgaaagctatcagatgtaagcgggcccggcctgggggaaggcgggacgttacagccctgatcatgttgttcaaattatcactgacaatgggtctaactataagaaggcgtgcagactacttcggcaagaataccaaagaattgtgtggcaaccttgtgtggcacacacagtcaacttgatgcttaaggatgttgggaaaatgccaaaccacgaaatggtgattgcaagtggtagaaaaatttgcagatggctatacaatcataacaagttgcatgctatgatggtcacagctataggtggtgaactggttaagtggaatgttacaaggttcgggacgaactacatgttcctccagagtttccttaggaagcgagatcttttcatgcaatggatggcttcctctgacttcatgcaaagcaaattcagcgggacaacggaaggtagatatgcacacgcatgtctatctagcatatcttggtgggagaacttagaggcagtagtgaattctgtccaacctatgtactcattccttcggtttgctgacgaggacaagaaccccaatttgagtgaggtacttctgagatatcagttgctcaaaatggagtacggcagtatttttgcgaatcaaagggacaagtttgaagcatacatggagattgttaacagaaggatgcacgacctaaccaatgaaactctgatcaatgccagtaagtattggtcataacataatccacatgtcgtattgtgtaactcgtacttaacctatgacatgttttgtagctgccgcattgaaccctaggacgcactatgcgtactatccaagtgccactgtcttccaagacctccgacaggcattcgagtggatgacggacatcgatacagccgccgccgctttgctggaggttgagatgtatcgacgtaagacgggcgaatttggaagggcactagcaagaaagatggccatagatgggaaaacgtctcctggtatgtttctaatcatggaactatgatatgtccaatcgatcttgatgtattcaatattataaaatgacatgttactcggcaattgcagcacaatggtggtctatgttcgcctcagacacgccgaatttgaagaagcttgcgttgcgtttggttggtcaatgttgctcttcaagtggatgtgaacggaattggagcacattcgctttcgtacataccaaggttcgtaatagacttacccacaagaagctcaacaagctagtttatgtgaactacaaccttcgccttcgaattcggcgagcaaatgcccaagttaggacggaggacgacgatccccttcaaagattagcggacctctcattctacgaaactaacaatcagatcaagaaatggatggacactgctcggtcgaatgcttgccctgaactagatgaagattcaaatgagagtgacgcccccttgcctagtccacttgtaaccgacctagtggacttggatgacctgcacaggaccacgggagcttctagttttgttgagtgggctgataagaatgtaggtgacactcatattggaaaaaggaagactcgaaagccaccaaaagcacgtccatctaaaaagacaaagggcaaaggtctacgatcgactaatgttgatagcgatgaagagactcaaggaagcccagactaccaagagtctaatgatagtagttcaagaactgaaaccgatgacggagacgacgatggtcaaggaggccaaggaactactgatgtgcctcctaggggtcacacccaacagttagatcaccacagccccattcaattcactggtgtgatataatttaattgctatttcaaccttcaccatccaattcagtactagttaatttacttgcaactttctcatttgcaggtgaggctgactttactcatgctactcaggaccacgatcatggtgctccaagctctcaacgaactaccattgcatcgagaggccaacaacagcaacaacatgttgacatacaacaggatagctccagctcattcagtgcctctagcattgaaagtggctatccaacgtatgtgtataaccgt

SEQ ID NO: 39341 - DNA, 5118 bp, Oryza sativa
catgtggacatcgttatgctttcaaatatgagattgatgattgttattgttgaattataatgttatgaattattggattgatttgaactgcacaatatagaaaagaaaggtcatgccgaatttttctattatataatcacatcttaagttttcaagtctcccatatatttttttgttagagctattatccccatatattttttgttagagctattatccccaaattatactcacatttaagtgtttctcctttttttttgcattctccttattttctgattcacatatcgcggtaaccgtttacttaccgcggtaaccgactgaaaccgtgtggtaacctcgatcataccgtgtgatttgaattcaaaaatttggatgcggaatttgtgcggtttttggcggtaaccgcgcggttaccgcggggggtcggtaacccaccctaaaacggtaaggtgaaccctgcgtgagagttagccgtctggtaacaaagaaccgtcgctctgtgccgcaaaaagaggaactagcgccgtagtttccgaagaatcgagagaaaaagagagagggttagcgactttggcggactacgttttggacttctgtttgcctcccgtgtgtgtggagctgtgggctgggccttgcatgttcggagagcgctacggctcggacgtccgatatcccaccaaatatcggacgcccagccaacctctgagcgtatgtgcatgtgcatgttgctgcactttatttttcactccacaatcataaggaatcttcccatctgacgtctgatgtccaaaaaaaattggttggtcaaatgttactagttgaccattgagcagtgaaacatcaaattatatatggtgaaaaaaaatcagcaactgaaacatttaaaaattttatgaaacatgatgaagatatacgttgaaacatgtcgctaccacatatgaaacaactagtgttaacggattgaaacatatgtttttcttctatcaaaatataatcatgtgatatcttgttgtaaagatttaattacaacgaatacaacggtgtaatcaaatcatagattggataattagtttatgagaaaaatcattttaaaactcgcaaaaatgcatacatgtatgcatgtatgaggtgcagagagatgggagggtagtggcaagtatttccgtgaattttatgaaacacaatatggatagacaatataatggtgtagaccttattttgaaagagtgcattacttaagagtaatagatcaatgtaataaaaagtagatccgatgatttatataatggggctatcagcttaagtgcacgtataaataagttaatatagatattgtttatttgataagtatacgatataattgtgtaaaatttattttaaagtagtgcattatttgaaaataattgtacaaagtaaagagtacacccgtttaaattatatgatggtagattctttatttgtaaaataatgattatttaaaaaatatatccattaaatatataaattaaaaaaataagaaaaaagaaaagaaaaggaggggaaggaagcgtatgtacgtatgtacgtatatactccacatgccaatgcacgggaggaggataggtgggacccacggtaattagtatgttttaagatcaattttatctaacggtgtataatattggacccaccaatttaagtgaaaatcaaagaatagatgttttgcttttttcttagaatatctaggattttctctattttattagagcgccaagtggcggcttgagagtgtttgtaggaagtttcatggacttttagtatataataactagttgggtggcccgcgcaatcgcgcggctagcacccatacaaaattatatttttaaatatgtttttacttaaaatttattaaatatctatctcgttgttttaagactttgaaagacgaaaccttatcattctcgtgtttctaattttatagtttttaaaagtcataccagttgctactgcttacttatgatatatccttctttatttgcttgctcgatctactgctgtttctattcattctccttagaacctttaaaaactggatcttataatttttagagtttattgtcccgttgggtttcgtttatataatttctagaagttttgtcaaacattgccattatacttctctacggtcgtccactgtattttctctttattgtcattggtattttaaaaatgaacataattatcatttaggttcattttttactttttagaatttctgccaaaacgtcagcgacttagtcattgtactcctttacggcttgcccgctgcctcccttctttattgtcattgagaatttaaaatcaaacatgtttatcattgggtttcttttatactttttagaagcccgaacctttaaaaattagaccttatagtttttagagttcattgtttcattgggttttattttttataacttttagaaatcccgtcaaacgctgccactatactcctctacgacctatctgccgactactatttattgtcattgggatcctaaaaacccgaacataacaatcattggaattcattttttactttctagaagtcctagcaaccattggcggctctgccattgtactcatatatgacccgtccgatgcctctcatttttattgtcattgtcacgaccggaattaacccaacaggcgttccttacgtgcgtgtattattccttgtcccaggaggcaaggtacaccaaaagttgatacatttcagagtttatcaagcggaagcataaatagataatttattacatgggcggcgaaggcccagcacacacaaagacaaacgggaaacagaggaagactagggcgacgaccacaggcgcttgacggcagacacgagctagacaccaaagccttcatcttccaggaactccacttctgggtttgggaaaaattgagcaagactgagtacaaccaccgtactcaacaagacacacccacaagtgcaggataaatgcaagggagtacaagggcattataatataaagggttagggtttgcagtaaacagcattaaaagacacttaggtactcaaagctattttgtaaacacgattctagagctatacaatattattaaacaaggccgtgaacccacacgaacctgccttaacccaaggcctacgatgattcagaccgaactggcaacccgaccctgggtcccagctcgtcctaagccaacccaggccaaccattccacattttagttgttaagcaggttttaagaattaaaacactaacttcggtacattgctcggcttgcccataaccgagggcgcggctattcgaatagattatactctgaccagaggtgtacatctttacccacaagacacatcttcctcacgtgtaaccacgtgccacataccaccacggtatacggatggaagacgtgacatagtttccaacccatcctagccatagacgagagtaccgacccaaccccacctacggccggaacccccgggacaggtaggcaggactgagcccctagctacaggacaccggccctgtgctatgacatctcgactaccgggccgcagctcgtgtagccttcatttgtcctatagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgggggttttgaatagagggggaggtgtgaacccaattccacaataatccaaccattccatagtgtccaggtgatgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgtagcgtctacacgaccaacggaaaagaaaaggcttttactctaataaactccatataacaagcaggaacaaagcacaaaaatgggttcttgacttcttaagaaaaaattagagacttgaacggtccaattccgagttcaaatggccaagttatggtcatttgaagtttatatgctctttaaatgaatatttgcgaatttcttcatttaaattttaatttaaaaagggtttattgcgtcagccgaggggagggggcgcgcggaccgggtccacggaagtggggcccacgcggcagcctcacggtccacggtggaccgggtgcacccgggctcacaccggccggcgccgtgggtcccacgcgtcagccgcacccgagggcacgggcggctgacagccgggccccacgcggcagccactcggcgcgcccgagggcggccaagccggcgcagccggcgggaggcggcgcccgcgcccctatggtcgccagcggcggccataggcacggcggagcggcggccgagagaggggaagggaagggggaaaagaggcggcggtccacggctcaccctaggtcgacggcgacgacgaaaaaaggcggccggagcggaggaaggcggcggcgcggctcgggtcgacggggtcgacggtgttccggcggtcggcgagcgaaatggaggggtggatgaggtcggcgaggatacggcgaagccgaaggaggcggcgcctatgtgggaggtggtccggggcgacgacggcggctgaccggagctcggcggcgacggcggagagagagaacgacgacgcgagcttgatttcggcgaggaggaagggcggcgagaggcggaaacggacggatgaggtgc

SEQ ID NO: 39342 - DNA, 7423 bp, Oryza sativa
  unsure (1)..(7423): unsure at all n locations
ggcgctagggcgcggcccaggcggcggcagctgccaggagaaggggatgacgggtgggccccacccgtcagcgagggtggtgggcgggcccgcccgtcagcggcgcgcgcgcggggagaggggagagagggggagggagatgggccgagccggcccaagagggggagggagggaaaggggacctttagggtttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaatttttggaggctttcacacggattttaattattctagacataatttagaggatgtattttagagtcgttttgggacgtgacaaacctacccccttaaacggaatctcgaccccgagattcggaagaactgacgaagagatcgggatgggctgccttcatctcgtcttcctcagcgtagtagcttcttcctcagcgtagttgctccattggaccttgcaaaaacggattacccggttcctgatcctgcgctccatggtgtccaggattttcactggcctttccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgccgagcaatgatacggaaaggacccacgaaccgaggggcaagcttccctttcgtctggaacctgtgtacaccccgcaatggcgtgacccgaaggtacacaaaatcgtccactgcaaattccagattacggcgtcggttatctgcataactcttctgccaggactgtgccacctttagattatcccgaatggttctgactttagctttagcttctctcaggatatcagttccgaacacttggctttccccaacttggtcccacaatagcggtgtccggcatttgcgtccatacaacgcttcatagggtgccatttgtatgctggcttggtagctgttattgtaggagaactcggcataggggagactcttatccccggtcttcccgaaatctaggacgcaggcacggagcatatcttctaggatctgatttagacgctcggtctgtccatctgtctgcgggtgatacgcggtgctgaaatttaatcgggtacccaactcttcttggagcttcttccaaaagtgagaggtgaattggcttcccctatcagatacaattttcttaggaacaccatggagactcacgatcctagcgaagtagagctcggctagtttgttccctccataggtggtcttcacaggaataaaccgagctaccttggtaagtcggtccacaactacccatatagaatcatatccgccttgggtttttggaagtccggtgatgaaatccatcccaatttcaccccatttccattctggtacttggagaggttggagaagtccggccggtcgttggtactctgccttgacacgctggcacacatcacaaagggccacgaactctgcaatttcccgcttcatactaacccaccagtatttctctttcaagtctaagtacatcttcgtactgccagggtggatggaataaggactttcgtgagcttcctgaagtatcaactgtttaagttctctgtcgtctggaacgcatacccgatttccattccatagggttccgtgttcatcctctgtgaaaccagcggctttaccctgtttcatattcttgaggagtccacgcacatccggatcattcttctgagcctcgcggatttgatcgagcaaggtaggcttggcttccagcgtagctaagaatccacgactaactatacttaggttcagggcttccatctgttgattaagttctggtggaatgccacggacgccaagagtgttgcagtggctttttcgacttagagcgttggcgaccacgttggccttaccaggatgatagtgaattcccacatcataatccttgatgagttctaaccatctcctttgccgaagattcagatccgactgagtgaagatgtatttcaaactcttatgatcagtatatatttcacagcgattcccaatgagatagtgccgccagatctttagagcatgaaccacagcggctaactccaaatcatgggtagggtagttgccttcatggggccgtagctggcgtgaggcataggctaccacatgaccttcctgcatgagcacgcaccccaatccttggcgcgaagcgtcacagtacaccatgaagtccttgcgagtatccggtaagattaaaaccggcgaggaaaccagcttttccttgagagtttggaacgccttctcgcattgcgggctccacacaaatttctcttctttcttcaacaactgtgccatgggtcgagcgattttggagaagttctcgatgaacctccggtagtatcctgccaaacccaaaacgctgcgaatttgggtgactgtcttgggttgcttccaatcagtgacggcggtcactgtttcggggtccacagcaactcctttagcagatatcacgtgccctaagaatttgactttggacaaccagaactcacacttgctaagcttggcatacaattgatgttcccgcaactttcccaacaccagacggagatgctgctgatggtcttcctctaattgtgagtacaccagaatgtcgtcaatgaaaaccacaacaaacttatccaagtattccatgaacactttgttcattaagttcatgaagaaggcaggagcattggttagaccgaacgacatcaccgtgaattcatacagtccgtatcgcgtggtgaatgcggtcttcgggatatcttcttcacgaatacgcaattggtgatatccggaacgaagatcaatcttggagaatacagtggcacctttaagctgatcgaacagatcatcgatccggggaagagggtacttgtttttgatagtaacttcattgagagctctgtagtcaacgcacatcctctttgtcttgtctttcttttccacaaaaatcacaggagcaccccagggggaagtactcggccgtatataccccttttctttcaactcttccaactgtttcttgacttcggccagttcatttgctgccatacggtagggtcgcttgtacagaggagtggttcctggagcaagatctatccggaactcaatctctcgcttcggcggcataccgggtagttcttccggaaacacgtctccgaactctctaacgatggggatttccgacagtcctatctgatgaagttctgaactaccgacagaggttgggggtgcaaagaaaacaaccggttgttccggccctcggtacagagtgacagtgcgtcttgcacaatccactactccttggaattgagccaaccaatttatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaaccgatttctccccacgaatggcacatatataaacgagtgggaagctccagagtcgaacaaaatggtagcagggatggaatgaatgaggaacgtaccaacgatgacgtctggagttgtcagcatattctcggcagtcacgtgattcaccctaccccgaatgacatccttaccaccgttgttggggcggggaggtgcttggccttgctggcgcctcggctttgggcatttatccgcaaagtgcccaggctcgaaagcagttgaagcacagacgctgctgaccttgaatgtctctgtggccttgtccaggctgcacggctggcgtaggaggacggggcgcacgagtcccttgctgactctgctgttgctgcggctgtgggacatgcaccacgaattgaggtcagggcgcggagcgtggctgctgctgctgtgaggaggatccccctggataggggttggtgtagcggaccctttggttagccccctgttgattgcggaaatttgccaagcgacgcttgtgcgactccagttccttgtgcttggcttccaaacggatgctcttgtccaccaaacgctggaaatccggatagtccctggagaccagacgcacggacagctcagggtccattcctgccaagaacttctcttgcttcttctcatcttcacgaacatcctccggggcgtatcgggccaggttgttaaactcatgcaaatactccatcacagagcggttgccttgcttcaactcttggaattcccttttcttaagggccatgactccggcgggcacatgggttctccggaaagcggcggtgaagcgagcccaagtaatatgctgtccttctgactgcgtagcctggaaatggtcccaccatagagatgtgggcccctgcagttggtgggcggcgaagatgactttctcctcatcgttgcacttcacggtgtctaactttttccccacggcatgcaaccaatctaacgcatccacggggttattggagctagagaaggtaggcggacagatgcggaggaactcggcgagtttagagtgttgtgggggtagtggtggagcattatgctgtggcggattttggatgtggtggaggaaagcagccatcatgttggcctgctgggcgaggatttgggtgaggatggcgttggtgtctggtggtagtggtggaggtggaggaggaggtggaggtgggctgccatggttgttgtggttgctaccttcgggttggttgccatcaccggtattagcacttctcctagtcgtcaccatctgaaaatcccacacagaaccagcaaacagagagagctgacaattaaaactaaccacccacgactaccataattcttgaatttattactgctattaagttggttcattaaggttcaagttgcttaagcaaataaaataaagacaggctccgacagttataccacacaccggcataaccatgccccatacgactctagcnagaaaaataaancgagaagaacacanncgcgcaagcctacttaactactcgtctacttctgcgacgggccagggcggaaggtgagcagcagcgcatcctccgtgctgccaacgccagaggctccctcctcctgaggaaccatgggggtgggctcggcacgaggggtctcgacgaagcaggtccacgccagggactgacgaacaagctcgggcctggaggtactcttgcgggcggtgatcttcaggctgcggcagacgcggcgacgcttggggcgacagacctctccctgggagatcttgacctgacaccgctgcgcctccactgcgtctaggtccttcttcagctgcagattctcctaacacagctccaggatcttcatgttgttctcgaccaacccgcgatgcaccatctgatggaagtcgatacgggccgcgtcgtatcctccaccatgcgcgccaggtgcatgatggtagcgtcatcctccgagctagcatcccggaaggtggcgtagtcgcgggctcctccgcgacgagggtggtagcggtagggcaagtgctgcaactcgtccgggtagcgctggtgtagagtgccgatggcgaggagtgcggcgttctggcaagcggcggagaaggaatctccacccgcggtgactgccaacgaagtcctctcggatgagccagtgaggatcactgcagtaacctcccaagcagcgtggggctctgcatcgtcaccctcctgctccgggagctacttgccctggtagtccactccatgtggataccccaggacagcgcacatgctccgcagcttcaaaacgaagccagtcaggtccagaccacgacggttgatgctaccggccatctacaaacaaacgagaaaagcaacattttaaagatcagattttgacgataaatgaagcagcaggacaaagagagactaaaggattttcacaaataagaaaggatttttattttgaaaatattgctaaggcttgggatctacggctcgtcctagggtcaagggggctctgataccaacttgtcacgaccggaattaacccaacgggcgctccttacgtgcgtgtattattccttgtcccaggaggcaaggtacaccaaaagttgatacatttcagagtttatcaagcagaagcgtaaatagataatttattacatgggcggcgaaggcccagcacacacaaagacaaacgggaaacagcggaagactagggcgacgaccacaggcgcttgacggcagacacgagctagacaccaaagccttcatcttccaggaaatcaacttctgggtttgggaaaaattgagcaagactgagtacaaccaccgtactcaacaagacacacccacaagtgcaggataaatgcaagggagtataagggcgttataatataaagggttagggtttgcagtaaacagcattaaaagacacttagttgctcaaagctattttgtaaacacgattctagagctatacaatattattaaacaaggccgtgaacccacacgaacctgccttaacccaaggcctacgatgattcagaccgaactggcaacccgaccctaggtcccagctcgtcccaagccaacccaggccaaccattccacattttagttattaagcaggttttaagaattaaaaaactaacttgggtacattgctcggcttgcccataaccgagggcgcggctattcgaatagattatactctgatcagaggtgtacatctttacccacaatacacatcttcctcacgtgtaaccacgtgccacataccaccacggtatacggacggaagacgtgacatagtttccaacccatcctagccatagagaagagtaccgacccaaccccacctacggccggaacccccgggacaagtaggcaggactgagcccctagcagcaggacaccggccctgtgccatgtcatctcgactaccgggccgcagctcgtgtagccttcatttgtcctagagatgtccatcgaccaccgacttcatccatctccatccgtgtacttttgtttataaccagactgagccacaaactaagccttacccactagacatgtggaaggacggtagtgctttccaacagaggcccgaagaccggtccttatatggccgaggtgctactatcaaaaccatgcaccccgagcctagcctaaaaccattttgagggttttgaatagagggggaggtgtgaatccaattccacaataatccaaccattccatagtgtccaggtgatgagaat

SEQ ID NO: 39343 - DNA, 25278 bp, Oryza sativa
  unsure (1)..(25278): unsure at all n locations
gaagctgcagcgtctacacgaccaacggaaaagaaaaggcttttactctaataaactccgtataacaagcaggaacaaagcacaaaaatgggttcttgacttcttaagaaaaaattagagacttgaacggtccaattccgagttcaaatggccaagttatggtcatttgaagtttatatgctctttaaatgaatatttgcgaatttcttcatttaaattttaatttaaaaagggtttattgcgtcagccgaggggagggggcgcgcggaccgggtccacgggagtggggcccacgcggcaccctcacggtccacggtggaccgggtgcacccgggctcacaccggccagcgccgtgggtcccacgcgtcagctgcacccgagggcacgagcggctgatggccgggccccacgcggcagccactcggcgcgcccgagggcagccaagccggcgcagccggcggcggccataggcacggcggagcggcggccgagagaggggaagggaagggggaaaagaggcggcggtccacggctcaccctaggtccacggcgacgacgaaaaaggcggccggagcggaggaaggcggcggcgcggctcgggtcgacggggtcgacggcgttccggcggtcggcgagcgaaacggaggggtggatgaggtcggcgaggatgcggcgaagccgaaggaggcggcgccgaggtgggaggtggtctggggcgacgacggcggcggaccggagctcggcggcgacggcggagagagagagcgacggcgcgagctcgattccggtgaggaggaagggcggcgagaggcggaaacggacggaggaggtgcggggtgggtttaaatagagccggggcgagagagggcggccggggaaggaaggaaaccggcgcgggatgtcggccgccatcaatggcgccggcgagacttgcgggggcaagtccgcccgtttgaacgcatgagagagagggaaaaatgggggaaagggagagagaatcacggggaataattcccctctattgattacacgcggggacgacgggatgcggcggattcggcggcggcggcggcgctagggcgcgggcgaggcggcgggagcggcgggaggaaggggatgacgggtgggccccacccgtcagcgaggatggcgggcgggcccgcccgtcagcggcgcgcgcgcggggagagatcgagtgggccgcggggagaggggagagagggggagggagatgggccgagccggcccaagagggggagggagggaaaggggacctttagggtttttctttttataaagccattttaactttgtttatttcttaataattattatttgtgctctgaaaattccactaaaatttatttacgcattttaggcttttaggaaatatacaaaaatcctccaagccttatttgacttttaactttgcacattttaatttttggaggctttcacacggattttaattattctaggcataatttagaggatgtattttagagtcgttttgtgacgtaacagtcattaagattttaaaaatcaaatatgattatcattggggcttatttttttacttttctagaagtcccgccaaccgccttgaccaattgcttcacgacctgcccgtcgtccttcctttaaatcctcattaggattatatttggtgttctatttatagtttttagatgtcccatcaaacgccatcactctactctgttacttaattaatcttgtcatgtgttttaaatggtcttttcattcggtagtctttattttttatcaccaattttacttatttataaattgtatttgtagttgaagtcttattttctttttctaattccataatttattttattttttgtttcgaactttaagtaatatcgtattgtgttcttttaatattgcgcaattgcgcggctagcacccatacataattttctaaaaagaaatgttaaatagtatctcgttagattttaagagatcgaaagttatcattatggtgttttcaattttatagtttctaaaagtcccaccaatcatcatcccttactcatttgccatcctttatttgcttgtccagcctaccatgactttaatcattctcttggatcctttgaaaacagaccctatagattttagagttcattgtcttgtcggattcccttcatatgtttttaggagttccatcaagcatcaccatggtactttagtacagcctgcccactgcccctcttaattttcatatccatttgaaatcaaaccttatcgttgtgattccttttttactttttagaagttccgtcaaccatcccaacattgcaactttacggcctacccaatgccccttcttttaatcatgattggaattttatttttaaaatcacgtgcatagatttacctttttatagtatgtattccctctgtcccactcactaagatactcacgcattttaaaattcaactctttaaatatttgaccagtaaatattttattataaattaaattttatttgttaaaagtagtttcattggattgtcatttaaatttaattttatatgattatgatttaatttgttgctacaaactttgtagtatgtgagaaatttaaagttatagtttagttttgaataccaatgataattttgaacacaccttagtgagagggatgttgggagtatgtatctctaccaatgcatgttttctggtctatttgcatgctatgttttgatgaacatgagaaaaaaaatcccttccatcttccatcacatgtatttactattttttcagccataggtaaaaaaacacatttaaattctaattataccagctccaaaatctatatgcatgccatgcgtttgaatcctaatcccctgaactctttatccgtctagaataaggaaagaatcagaagcagcagtacgtccacctatttggacttgtattctagtgtacatgatcaatgttgtccgattgatctagtactacctagttgttttctatttggacttctattatcaaagttaatctacgccatcaaagtctagtcacagtataatctaacggtccagatttttcttttttctccgattaacatggtaatttctagcccccacagcgaacgtggagcctcctttcaaagctgtcttaattagggatggcaatcgggcgcgacgggcacgggtagtgcctacccatacccatgcccgtgagattatttgtgcccgtgggtatacccattactacatcacgggtaaggatggttgcccatgcccattgcccgccggcgccttatgcccgcgggcgtgcccgtttacccgccacaacaaaagcagtggaacaaaaagtctacaagctactaagttcgaatcgaacttaaaacatcaaatattctccggctcggtgtcgtgtctctcctctggtggcgatagagtaagaggagagaaataataagggaaataaaaggaaaccgtagaaaacaaagaacgtggcttatgtattctagtggattttgctcctagcctacatgtaagttagatttcgcgggtaaacgggcaaagcgggcatgggtagtgattacccatacccatgcccatttacccatcgggtatagcttttgaaccaataagatacccatgggtataaaatggagaacaaacccaaccctaatagggtttttacccacgggtaaacgggcaaacgggtacaattgccatccctagtcttaataatataatagatagataatagatagatagatagataaataataaatttctcactccatcggcaatcacatttcgccaaaaatttccccctttttgtttttatttgaatttagtcaaaatttattcaaattcattcaaactttgttaaattatcaaataatttcgtccaaaagagtttctaaattcccaaaaatttggtgaccacagaaaatccttttttttttttgaaaaacgaaagtgtaaacactgcttgtgactgtacgggcctgatatatgcaaccagcttttccttacaaattaaaatgagacatgtgtaggttgcgatttcgagttgttcgtgctagaatctatagatacgaatccgtctgaagctgattttgaatttgaattgcaagttggcttgcgagttgcgacacaagcagctcgcttcctccgtgcaccgtgccttccagaagccagaaggaatcaaaccggagcacgtaactaaccaccatcagcgagcgtcttcctcctcgtcgtcttcaacctctcgactctcgtgtctcgtgccgccattagccaccaccaaatccccaaacaaccactgctcccactcccgtctctccaatggctgacgagttcccgccaccaggtcctcctcaccctgcaccaatggctgatggtggcgagcctccgccgccatgggcggacctcccaatccacatcgtccgcgggatcccagccgcctcctgtgcaagatcgaccgtcgcttcggcgaaggcgtctgccgctcctggcgcgaggcgtttctgcaagtcgggccgccgcctcccccgctcccgctgctcgtcgtcgcgaacgccggcgagcacgcgttccactgcgtccccagcaactggcgcacccaccccatccccatccccatgccacgcttcgcgcaccaccgctacttcggctcctacgacggcggctggctcttcctctccatcagccaatccagccgccacggcctccacaacatcaacaagaacgtcaactccaagcgcttcagattcagcctccctgaccagcggctataccaaatccggccgacgacagcggaagcggataagtttattgttatcgtcgccgccaccctctcgtgccagccaaccgaaccgggatgcgtcgccgccggcatcatcgacttgcacagcttccccgaccacccaaggtacatcgcgttctggaagattggcgacaagtccattccggcgatgaactaggaaccggaagtggtggaggacctcctgtacagccgccatggcgctggcgccttcctcttcctcaccaacggagaacacatccgtgagctccctcaaccgatattcccgcccccaggcacggcgaagcgagtcaggaacgagctctacttcaagccgcgcggcgacgacggcggcggcggccggccggtccttgctcgctacctcgtggagtcccgagacgagctgctcatggtcgtcaggttgggtacccgtaagtcatgtactgctcgacctcgccgtggccgctcgcagtagccgccgccgccgccgccgacaccgacctcggcgttccaggtgttccagcgagaagaccagaaagtcaaaagcatcaacgacatcgacggcgtggttcgagttgagcactcctggatcaagctggccgaccttggcggccgcatgctgttcgtcgggagaggctgctccagatcctacgaagcggcggatgggtaccccggcatggagggagtctacttcctggatgaccggagcttctacgaccggacgaccgtgttcaagaatgacgacaaaaggaagtatcaccgcagcgacatcgggaaatggtcgggatcaccaccgcaggtcaggcactgcttaccggagcaaggtccgtcgaaaacctcccctccgttttggattctcccctaagtgaggtgataagtttcggcaacagatgaagtagttaattagttagagatcatgttagcgatatgttttggcaacagatcaagtagttagttagtgcagtgcgtggttgatgccttcatcaatgctgtgttgcttgtttgattcgagcttcttgctgagttcgatggtgatctcgtgttgaaatactgaaattgtagctttgctgacgaaaaatcccataattgggtgaagaaattctgaagatgatgaattaccattcacttagtttctctgtacttgcactgcaattcaatgccgtgctgtttgtttgtttcaagcttcttgttgagttctatcatcgatggtgaactcgtgttgagattgttgcttgctggtgcaagctgatgaaacattcctcaattcagtgaagaaattctgaagatgaagaagtacttttcaccttgtttctctgtactcgttttaacaaatttgcattgcaattcaagctttgttaagttgtagcgatattgcaatgcacggattcttctgtttctttatgacagccagttgataattataccttggtaatcatgatacagttgtaatgatctgcactgctgaacttgatttgtctgcatatttagtcctaaatcatgtgcacaatgaggctgatcgagtggctgatagagagtttgatggtattgcgctggtgagataatcctgaaattattctagctgaaacctgaaactgcactcatttaccaaaaatcacctgcctaaagccagctatgatcgacctgcacttcaattgttgtacaccttttgattcctgataaattcagtgcggacaccttttgtgacgcagaacacacccctttttacttctttgcttttatttgaagctggtttaatttgcatgcagtcaaattatttctgtatgttaattgagtccactttccttggttgaaccgttgaagtcatttatgtgctcaaatcgagaacattgaggttcttggctcaaatgcaaaactcacaaagtcttccatgaacattaatgggatgcatggtgcttcttatgtcgattttacaaacctgtgagcttctataatagtaacacacaatttttccagcttgtccatgcactgtcccttttttgttcttctgaaaagtagctgcttggttcatttctctgaagtattggcttgttgcatacggctagttgaccttgtaaataggcttttaaaactgaacacttgtagccaagaattttgtttgtgtgtgttactctgcacttaccatctcctttttttagatcatacttgagctattgttctggtaccctttcgcatttggattattcatgagcttactacttagcgctttgtgtttcaatggacaatttgcagacatgtaccgcatggttatgctttgatttttgtggccagtccatgtaatttcctgatcgatggagttattatactttgacttgctagaggatgcaagaattctgaatgggtttatcttcctttaattgatttaccatgtgcagagctctctgagtaaaacctgagaaaaaaacgtcaacaggattaggtttcaagctgaatatgcagattcctcgttgtctgaatgtgtgtgcaactgtgcattgcaagatcattcatgtgaagctaggttatgccaccaaaaaagagtattaacatgataacatctcacctgtagatgtagattgaagattctagcaatgcagattgttgaaatgtttttgttcccatactgccagctgtagtaatctaggaatcctcctaatttgaactgaaaatgaatgtgattcagtcattgggttttctgtacctgctattttctggtaccctattcatttttattcctatgaagttgcatgtagaaacggttaggttgggcttacatcattattgtcctgaaattggtaattccatgtgaaaatttaattgaacagtgcttcattgctggatgtaaagtgtgcttgtggtatctggtagctcaggtattaactcactgtgaaatgagagggtcaaagcagaactgcaaacatgaaacaaattgactgactaacctgaactcatatcttgttcataagagtaacatgaactcattttctgtccacaagagttactagttctttgatacttcactgaagatttgtagaccatctcaacggtgtggaatacagataagataatggataattgtaccttttgctatctgcagtctgcagactgcagattatccattttatacctagtacgatgccaatgccaattcagtattatctaaaaggtataatgccaattatcagcaccgctgaaattaggccaagtttagttccaaacttttcttcaaacttccaacttttccatcacatcgaaactttcttatacacacaaacttccaatttttccgtcacatcgttccaatttcaaccaaacttccaattttggtgtgaactaaacacacccttagtctgcaggttccagaaatgaagtttcatgcagaaatggttgtgctggtattacatcattttggtgctgaaatggataattcggtgggaaaatatgcttgtcagttcttaggcattcctgatagatggtgtcaggcatttcactgaatgatctaaatttttatgcatataatgtaaagtccgctcgtgttattggtaattgaactactaagctagtctgatataatcgtcaacattatttgacatttcagtaatcttttgcagatgagcatatcgatcagctgcaaaggaatacagaaaattggattttttgggggaaagataattggattttttttaatctgcagattgtcctggttcatcagtattgctgtagttgctaaccggtactcatagactccttggtacaaccgtacaacgctaattcgccatcttaaagaaatgttacaatgccaatttatctgcaccactgaatttaatctgtacccaatattcagtcccagatcatgtggaggtttgcactttgcagagtgccagttctctggaacttaaattttccaataccttttaaacagaacgaaattaaggtgcttctcaaaactagttttgaattcaaattgcaacctgcaagttgccatcgatcaagtcttgcaacgcaagcaggctccgcttcctccgcagcttccagaatttgttcgaaacgaagcaaactggagcacgcaactatccaacatatatactactagcagcagcgtcttcctcctcgtcgtcttcaacctctctcgtgtcgcgtgccattcgccatcgccaccacctccactactcgatcccctcccatccctccggaacctccactactactcgccccaccaatggctgacggcgagtctccgccatgggcggagctcgtccccgacatcgtccgcaagatcggccgccacctcctgtgcgagatcgaccgccaccacgcggatggcctctgcaggtcctggcgcgacgcgcttctacaactccggcccccgcctccgccgctcccgcggcttgtcctcccggaagccgacgggcccgcgttctactgcgtccccagcggctgccgcccccaccccttcgtcctcccgcccgccgcgctccgcgcgcggtgcttcggctcgtacaacggcgcctggatcttccaggccgtcgaccaggcggcgaaccacgtcctcctcaacctcatcacccaccagcagctcaacctccccaacctgatccgtttcccctccttccggcttccgggattgacattgacttcgaggtcgccttcgtcgccgccaccctctctagccagccgactgatcagggatgcgtcggcgccagcatcatcggcttcaaacgcaggcccctcaacccacggcacatcgcgttctggcgcatgggcgatgaggcgttctcgcagtccatcgagtcgaggtggattgacgaggagctggaactggatgtggtggacctcctgtacagcggccatggcgctggcgccttcctcttcctcacccgaggggaaaacatccgtgtgtttcgtcaaccgatattccctctcggagacatgcagacgacagtgctctacttcgagcggcgcggtgacgacgacgacgacgacgggcggccggtccttgatcgctacctcgtggagtcccgggggaagctgctcatggtcgtcaggttaggagatcgtgagcctggccgcttgccgaccacgacgttccgggtgttcgagagagaagacgagctgttcaacaactactggaccaagctgcccgaccttggcggccgaatgctgttcgtcggaagaggctgctccagatcgtacgaagcggcagatgggtaccccggcatggagggcgtctacttcctggacgaccggagcttccacgacccgatggttgtgtacaaggatgccgcccaacggcggtatccctgcagcgacaacgggagatggtcgggagcaccgccaccagcggaggtagagcgctgcttcccagagcaaggtccgtcgaactactcccctccggtttggattctcccatgaggcgcacgacacatgtttttggttgttgaaattgttgccggtgatcaggctagtctgtgatcgttgctaagctttcatgccttcatcagcatgtactgtgttagtgtgtttattcgttgagtttggatggttttctcgtgttaaaattgttactggtgtaagctgaagcaggattgctcaattcagtggagaaattgatctgcaggtgacttaccgttcccttagtttctgtcttcatgttttttctcaaatttgcatttcaattcaagcttcttttactgaagttgcagtgttcacaaatgtcttgggaattggaaaatgcagattgttctgtttctttatgatcgatagttgtaacatgatgcagcgctaatgatctgcagtgctgaatttagtagcactagctggcagaaatattaatatgtagtaggattgaccttattccacttcattgtttctgatgtagatgatactgtactgcagagatagttacttgttagtccagtattattaactgaacaaaactcattttcgaacaaaattcacttgcagatagccagcaatgatggatgcgtagtttatttgcacctttttgctgccttaagtgcctttttccccttgtgattttggattgcagctgataatttctgtgtggatatgtgcatgtttgtgctcaaattttctgtgtcagaacacatccttttttggtggatgtcctttgatttgtccgaagtgaatttgcatgcagtcaaatttagttgtaaactctagctgtctacttacgcttgcagtgagctgagaatgtgaaaacattgagttcttaggtcaagtacagaatccacatggtctgaaatctgaatgttggatgcccggtgcttcgtgcggtctctggtatacaaaagtggtgtgcatccataatagtagcacactattcttccaacttttccatgcattttccactttggttcttcagatacagtaaatagcagcttggttcatttctctgaagttatagtttgctgcgtatggctggccttttgaattggccgttataactgaacattgttagtatgttttgttccttctttctggttttgtagcccaaaattgtctttctgcttacgatatactaaatgttgtctttctgcatgaagatgcagataccgtagcacatccagcagaccgagcccgactgtttctttttctcgatttaagattttcatgcttttgatatctcgctctacatattgttggcaactttttgtgacaagttgataagcacgatcgcagcaactaaacgccttgcggtaatatggagtcgccaaaaatcgtgatggcaactttttgtgacaagtcgacaagcatgatcgcagcacctaaacgccttgcggtgatatggagtcgccaaccacctcgatctagccaaaaggccaaatcaagatgggttttgtagaaaaacagctaaaccggttagcagagccgatttagagatgaaaatcagtctctagaccgatttagatcgatatgaggataactacccgtctcgtgggcaaaacggaaggttttcaggacaaacctacaaagaggtgtcgcactctcgcagcggcggcggatgatttacgacacaaatagataaagatggactaaaattagtgtaaagtagaaaacatagcagaaaagtaaacataaaagagaaaacgattcaagtatattgtgtgttcgggggattacaattgaaccggccttgtccctcttaaataggggttggtcttgccctctacagactcttctccacgtccaactcgtgatagaaccaaaggaaacacgaaacatgccttcccaagcaaggaaacccgagacccgttgaatacagactcgggctcggaccctgacggtttgaccggccaaatacctgcggtcagaccggagttcaggccgcggtcagactgcccacatacctgcggtctgaccggtcctgtgaaggaaacccatcactttccaaactttggcaattttcccctatttcgcctataggtgccaaatttgggtgtaaacaaatgccccccttccttttttatgaacatcgtgaatctaaaagcatagaacatgtttgtcttagggtgataatacgattaccggccatagaacctcctaagcatattgccaaacactcgggaagtatttcttcaagtatttcccattgattgctcgcagaaaaatgctgtccttgaagtgtctctatgtctttcaaagttttcaaatgcttgtcgatgacgtcttcaaaattgcttcgcattaaggttttgtaatctttgaccaacaaatcgtcttacttgatataccgaagagagccaagatttacctcaaacggcaaaacggctttttgtccataaaccaactcgaaaggagtgactttggtagcaccatatttagatatcctatgagcccaaaatacttccgaaaacacttcatgccacttcttttgaagttcttcaatcttctctttgactaattttaacaatgttttattacttgactcggcttgtccattagcctaagcgtagtaaggaaaagaactcaacaacttaatctcgtaagattctgcaaaacatttcacctccttggacataaaagaagctcctcgatccgtagtcaaagtttaaggaataccgaatctatgaacaatatgcttcaagataaagtcaattaccttcatatgaatcatgttcttgagcgcttcggcccacttggtgaagtaatccatcgcaactagcacggaccgatgcccttttgatgtcgaaggataaatttgaccaatgaaatgcaaagcccatcctcggaacggccatggtttgatgataggattcaatatagcggtaggcgccaattgaacattgccgatccgttgacaagctttactctatagtacttgaaacaatcatcaatcatcttcggccgatagaaccccgctctcctaagcaatcaattcatcttatgagccgattgatgagttccacgaatccctttaagtactcccatagcaactttagaaaaagtacttcgtctatatttcggcgatataactctccattaagcaaagtgtatttgaatgcttgccgccgaatttttgatcaaccctaaaactagaatcttcaaatattccatcaaagggattctctagttttcttctgactcttgggcacaaatgtctgaatttacaattaatttggcctttgaaccaattgtaacatgccccccagctctctgcccgggatcggtcagaccggccacgcaatgccggtcagaccgccctgtctacccggtcagaccaccggtcatccgcggttaggccggctataatgcgacggtcaggccatccccaatctggaacttcaccaattttgcccaaagatttaaaatcaagcactggcttttctaatatcaaaaatactcctttcttcacatattaaccagatgcttggtgtatcaaattattggactaaaattccttctttctagacatatgagaaaattataacacccaactaatatgtctagatgaataccaatttaagtggcttttgaaacaataatcatcaaggtatcaaaacacttagccacttgaagtatgatcaataacgaatcaccaaagtcatatgcctctcacacatgaactctaataaactacaaatgttagtaatcggcttgagcatgttggcaaaatattaaaacaaagccaatgttcgaaacataacaactctagaacaaatcatcacattgaccattgacattagacgaattactaataagcaaaactttcatggtgcaataaatatgaattatatatattatatggtgatccataaaaacacatatgatttggctttaaataaatatcaaagactcatgagccaaattagactttaaacaaatcatatgccaacttaccaattccactacttagaactagcatttgcaacatgtatgtataatatcaatttgataagcaaaaacacacatgtgctagatagcaagcaatgttctaacatggcataggcatataatataatgatgaacacaataaacccataccttgccttagcatccaacaaacggcggctcaaagatgtgacattgtatccatcgccgttcatctctctcgatttcttcataagcatattaatgtcttgcccccccgagcaaaatcagctctcttgattgcacgatttcgaaggcaagatgaacaccgcaccaacatccatagcatcatgtggaggagagttttctctaatgaccgatgattcttctctcatgaacttaccactactctgggaaatcaccggtctcttaacttttacttctttaggtcttcacacttgcttaggtgttgttcgaggctctaaattttcacagttttgtccttcacatctttggccttcttttctttttgacctatggctcgaagacgctgtagcctcctcatttgagagcgagataagccagaaggtatccacttcggctgtggttgtttttcaggaaccaagcaatgattcttgatgtatttggttgaagtagaagctcctgtgttactctcaattttcccactcttctccaattccccccggtcagatcggcctctaggcctggtcagaccggctacaagttgtcggtcagaccagtcagtagggtcggtcagaccggccacaggttggcggtcagaccggcgagatgtctcggtcagacctccacttttgacaatcacggtgtcggctccgatctcctttgcttgtatggtttccaccgcatctccagtaggtctttgaacatcttgagactcctacttgatagcaacgacctccggagctttggcttattttctcacccacaccttcttcacctttttcacctttgatccactggaccgattcttttgtgggaaatggtcttgactagagttaaatgaatgacttggtactgacctaggtgattgcttccattcttgatgaaacatcatagatggttgaggcatccacggcatgtaatacataaaaggataaccgtatagtgacattggatatggataacacggtgttaaaactagaggtttgtatgaagttggtatagttgatggctccgattgctttggtgtttgaccaaatctcttcctacgagatgatcttggtcttttcgaatcactagtttgattatcaaatcgttgaccagctaatccttttttgtacttagccataaacatctcaaaagtgagcttcggctttttggtcttgttggaactagatgactcatcttttgtaaccttacgatcttcagccttcacattattgatcttcattgtctcgggccgaaaatccccaataataacacttttccctttcgtagattcggtttgactagactgaatcactactttcttgttgtcaaaatcaataggactaatatgaagaggattactaacaattctggtcttaggcataggtgtaaccgaaatagtttcacaaatgactgatgaatgatcaatcggtctttgctccatcaagcttgcatctttgaaataatcatgaaactcatgctccatttgtgaccatgtagaaattaaattgcaagcaagtaaactataccatgttgatgcaaagtttgacaaagaaagaggaaacaactttaacttaagcaaatcttagggataagtccattttacaccccccaaactattacttttgtctaaactacacccccaaactaaaaaaccgggtattcaacaccctccaactgtcaaaaccgctgaattaacccccccagtttcagatctgatggttttagcctacgtggcaaatgacatggcattcagattgatgaaaaaatatttaaaactttttgggcacaatcaacaaatcaaagtcttctcctgtgctcccctcctctctcgatcctgttcttcgcatccatccatcgctgctggtcgcaccgtcctcgacatccgcgtccatctgctgttacgttcctggccctctcctcccaccctctacaaccgggtgaaatgctacaatggtatatccatgcgcttgcggatcatatctgtaaccgcaatataccagcattatttctagtgctattgctgggaattatatttccattaatgtcgctaagaaataccaacaatattgcagatgtaaactagcataatcgtatcatacgatctacacatgtaaactagacagcaaaccatgaacagattgaatatgtgaaacatgttgaatgcataccgaaggtttttggaaaaccagcttctcagcaaggactcgtggtaccatgcgttgacgacagtgcacatcacgcgagcgaagaggaagaccagccgttgtggacgaatatgaagcagtcgtgcaaagcgctttctaaaatccttattgccgccttttcccggtgaaggacgtctaaggcgaaggttccggagacctgttctcccgatcgccggtgcacgccggcgagcgggatggagtagagtacgagcgagggcataatatagaggaggaggcaaccctatattgattttgcatgtgccacgtggaggcggtgactcgatttatatagagatatcaggacgcttgatcaggggcacctgcacgatctccactccgcgcaaccgaactagataagtcgtgcgtaacttattcggactttattccgttttcatgcactagattattcggcatgtttccaaaaaataaaatcgaatttcctgcagcaaaacaaaattgcaaaaggaaacaaaacagaatttcctgcaacaaaacaaaactgcaaaggagaccacatgtcacgtctagaaattcactagtaatttccgaactaatttgtgcattaaaaccctcgtccaggaatcggccgaggtacacaaactgacaatttaatatacggatttatcaaaataactaaagcaataaatacttatataagaggcacttagtcctcaccacgaagaaaactgcagcggaaaataaaatctagcgaagctttagctccatacccataggcagctcaactggggtataagccaaacgtcttctccttcacaacttcttcaactgaggtttgattgattttcataaggcaagtcacacggatcccaaataaccctttgagcatattgaacccgtttaaagctattgttttatttcaacttatgcattatttttgaatgtcatcgggtggtgagcctttcccatttaattatggccgaagatgactttattttcctatgggttataatttgattagcgtgaaccttatatattggtttggttcagctagatgcttataatagatgcttagccatgcttagaaacactagcacactattgggatgattaatgtttcactgttacttaataatggatatttaatggtagctcacgatggtcaatcgtgattggttattaattacttgccaactaaaatttgattaatggtaggttgtgagcacatagttttgatggtcgtgctcatgacaattaaggaacgattcgcgagctactgttgtgagacattaactgtactaaccacaagccagcttgggcaatggctggacactttgtgtagcaaggctcattgtggtgcgccagactgtgaagcggcgagaagtgcgtgatgcctctggttattcagggggtgattatgatctagaaaaggtgcactactttgagttgagttatgcgaggggtcttgtcacaactacataaatggtgacatgttcagcatgggcacataatgatatggtgacattttgtggagttgtgtcctgtgggtaaatatgtacatctctggctatagtaaaactattcgaatagccgttcctgtggttatgggcggggtgagcaatgtttttcgtgattagtcccacactgctcattaatgataataatgtgataattaatttggctcctggtttggaatggctaatttctggtttggaggtttgatctgtacgaccggggttggttgttcaggtttggttgggcctgtgcagcatggatgtgctgttcagtgttgattaatattgatgattaattactctattgtattacaattcttaaatgtttgctaaatgctgcttttgcaaacgagtctatattataccatcctttggtatccttgtgcacttgcatatttgttgtgtggcttgcggagtattccatgtactcaccttacaataatcaatcaaacctcagttgaagaagaaggatccagaaggagaagacgtttggcttataccccagttgagctacctgtgggagtagagccagagcttcgctagaccgttattctgctgctcttgtttttcttttcttttgtaagtatgtaatgttattattatgatggatttgtatattaaattaccagtttgtgtacctcggctgattcctggatgaggattttatgcacaaataagtttggaaattacttgtgaatttccgggcgtgacaagttggtatcagagccatctggactgtaggataagccaaatggtcaaactttaaggacaaattttccgaaaacatgatttgtgaaaaatttcctttcttctttctccagaattctctgcaaatcattttatcatcctctcgcctccctctttcaacttgagtagttgttaaacttattggagaaacccgaagacgtcaatgtggtttacttatggaggccaagtcaagtgaatcaaggaataagaagatgacggtcgaactgaagtgcagagctttcataatgggatgaagtttggatcctaccatagaacctaaaccaccaaagtgactttgaagaatagttagtagggtagaacgtttgttgcttgcttgtgtgtaggtatggttgcattcccaacattgttgtagttcagtgctgagtgtgtaattatactaggttgcttacttaatcaacttaaacaatataatggactacatacaccagagaagaagagggtggccaaggcgtacaacaaaagggtgaaagcaaagttgtttcaagttggagacttggtttggaagacaattttgcctttgggtactcgatccaggaagttcagtaagtggtctcctagttgggaaggtccttattgagtatgcggcattgtttgagggaacgcatattttttggagacacttcaaggggagcgttttcagcgagcaattaatgggaaatacttgacgaaatacttcccgagcgtttggcaagatgcttaggaggttcaatggtcggtaattggattatcgccctaagaccaaaaaacatgttctgtgcttttagattcacgttgttcataaaaaaggcagggggcatgtgtttacacccaaatttggcacctaggagtaaaatagggaaaattgccaaagtttgaaagtctgtcggttttcctatgtgagggccggtctgaccgccgtgtataggctggtcagaccgccgagtgagggccgttcggaccggcggtgtgtgggccggtctgaccggcagagtccgagtcatggactgtttcgtcgggtctcgaagtttccttgctcgggaaggcatgttttgggtttcctttggattatatcctgagttggacatgtaggagggcttatagagggcaagaccaacccctatataagggacatggccggttcaattgtaactaatcaatctacaatcaatcaatcgaatcgtttttcatattacttttagttttctcttagtttgtccatctttgttaatttgcgctgtaaattgtccgccaccgctgcgagagtgtgacacccctttgtaggtttgtcttgaaaaccttccgttttgcccacgagacgggtagttatctagaatcggctctgctagccggtttagttatcaaaacccatcttgatttatcttttgctagattgaggtggttggcgactttaggatcaccgcaaggtgttcaggtgttgcaatcatgcttgtcaacttgtcacaaaaagttgccaacacaacgtaccccagtaccctaatcatccggtctacgagtatcactcgttgataatggcgtgctaggtagggggacttggtgctcaaggttctgccaatatgacttcaagccatcctgacaacagtaccaacagtaccaatactggcgtcaatcaaggagtttccacattgctggtgtggacttaagtcggatctattgcctctctagtctacaccgttacgccaatctcgacttcgagaaatgacatctcgccgacaattcctcccacgcaagtggagaacggaatatcgacgaccccaacacctggaagaaatcctcaagtggctgcacagaaacctagagccgacaaggatatctacccagaaacccagatcttggtgtcctgttcataagacatccaagcatactgtacaagattgcccggtgatactccacacgaaggccgaactctacgcctgttgggagcgtgggattcaacgcacttcaccgacgggtgtcacatactgcccaatccataagtcaagatctcactatctcacgagttgcaaaatcttccttaaaatactcaagtcgacgtgtccttatgtccaacaaccacaagttcaacttcagtgcgttgccaaggaacgagacgtagcaatgacttcagattggttcgtgggttttgtcagtgtcaaccctgacgagccatctgtactacacctattggaagatcaagagtcctcttcgtcgagtttgccacgagatgtaaacgtgatcaatattggtgagacaagtacgtccgcaacagctaggacgcctgctcaacaactgcagaacctcgacgtgatattgagataaagcccttttgaccccatcctaaaccctgacgtcgatatgtgggcaacacgacaatgagagactgtgaccaatctcaatagcgcgtttgcagatacaacaatcgagccttcacctcaagatccatcacgaggaaatggtgaaccagctaatgggaacgcggaagcggaaaaccctattggagagcgtcctcaccgtgctcagtcaccacgggcaacacgatatccaactccgccacttcgtgagaatcgcaaccttcgcgaacatgtagacgaccggcagagggaacgacgaaatcggaatgacactgactgtcatcggcgtcgttctccctctcgacaaggagggaacaccatctaccgtcgacaccgacaccgctccccttcacgttgaggagggaacaacgatcgagaaggacgccccaatgaacatcgagatccgcaggcccgcaatgatcgccgagataacgattgttgtgacggtggcggtgacaatcggcgagatcagggagccgatggacgagttcagggagaccatggtcgagatcagaggcgagatggcgacgacagatgggaacgtaactctcaatctcccgcgttgggacgagaccgacgacacgaccactgatcgggtagccgagcccccgacccaagtgatcccttgtcttcatctacgtcatattcttcatcagacagaccaactcaacgacaccagaaatgcgggccaccctttgctctagatggccgatgcagagcattcagaaccacactacgagacgtacgatggcccgaaaagttttgaccaggagcgatcgagaagtataacggaagtacagacccagaggagttccttcaggtctactccacaattctgtacgctgctggcgcagacaacaacgcaccagcgaattatttaccagctgcgttgataggttctgctcaatcatggttggtccatctcccgccccactcaattccctcatgggaagacttatggcagcaatttgtcgccaatttccaagtaacaaacaagcgccacgcgatcgaggactatttacatgctctaactcagaaccaaggtgaatcattgagggactatatccggtgcttcaatgagtgcatgaaatcatcgatgcttttgttatccatgcattcaagtcaggcgtccgagataagctgttcaaaattatcgacagatgcgctcacacagacgacgccctaagatggaaggaaggaaaaagcaaggtaggggaagagaataagccagccaacaaagacgcaccagagtcgagcaagaagagaagtcataagagtgggaagcgcaaaccttcgggagaggtccatgctgccaagcaaacggacccacccatgtgcccaaacccccagaatgacaactcacgaaaacaatggtgccctatacacatgacgaacaatcactccatggaggattattacgtcttcaaaaggagctgggcgaaattaccatccagagaggtagcgagtacgagtngtcgaaacggctgagagaacggccactccgacttggactccgcatttccagaatacgacctccatgcctcgaacatcttcggcggttttacatcgtacacctcaaagagggagtacgaaaagatagagcgagaagtctgctccacgtcgtgggggctattgccaagatgagatggtccaaacacacgcccaaactcccagacagacgactcatgaaaacaatggtgccccatacacaagacaaacaaccactccttggaggactgccatgtcttcaagaaggaacttgcgcgacaactagtaatcgagacggggaagcgagtacgtgttgtcgaggcgactactgaagcagccaccccaactccaactttgcattcccagacttcgacctccatatcatgcatatcttcagcgcttttccatcatacacctcgaagagggaattcaagaagatagaacgcgaagtatgctcctcatcacagggggcggctaccaagatgaaatggtcccaacacaagatcgagctctcagaggcggaccacccaaaaattgcaaccacacctggcagatatctgatcgtggtcgagcccactattcggaatatcaaggtagcacgggttctcatcgacggcggcagttccatcaacctgcttttcaccagtaccttagacgccatggggataccacaaagcgagctgacaaccactccagaatcatcattgaagccgttgggtaagatcacactacctgccacttttggacaaacccataacttccgaacaaagcatatcatctttgatgtcgcagagttcgacagtacatacaacgccattattgggagtgcactcacgaagttcatggcagcatctcactattcctatcaagtgctcaaaatgccaggaccaaaagggacaactactatccagggaaaagttggtggtacagttcgataagcggaacctcgacatggtcgagcataatcctaacctgctcgccacaactgagcaacccaagaaaatgagcaagcccaacaagatgccgaaactagacgacgcgatcaaaatcataccgttgaccagctccaaccccgacaagaccgtcaagatcggggcaacactggacgaaaaataggaactcacgctcatcaccttcctccgcgacaatgcagacgtgatcacttggcaaatgtcagacatgccgggagccccagggaggtaattgagcacaactgatggtacgacccgacgccaagctagttaagcaaaaacaacagagattcacacccgatcggaaacaagccatacgagaagaactcgacaaacttctcaaagctggcttcatcaaagaagtcttccatctagtgtggctcgctaatccagtaatggtacgcaaagccaatgggaagtggagaatgtgtgcagacttcaccaacctcaataaggcgtgtcccaaggatcacttccctctccctcgaatagatcaactagtggattcaacagccggttgtgagctcttgagtttacttgacgcttactccggctaccaccagatcaacatggcaaaagaggatgaggagaagatggcattcatcacgcccttcggtgtattctgctatgccaaggtgccgttcggattaataagcacaggaaatacctatcagcgcgggatccagagagcacttggtgatcaacttgtacgaaacatcgaggcctatgtggatgacatcgccgtcaaaaccaagacgagcgattcgctaatcaacgaccttagggaaacgttcgacagcctccgacgatatcaaatgaagcttaaccaggagaagtgcacgttaggagtaccgtcagggaaaatactcggcttcctagtctcgggatgaggaatcgaggccaaccctgaaaagatcaaggtaatcgagaacatgaagtcacccacaagactcaaggaggtccagcggttgacaggatgcatggcttcgcttagtcgtttcatcgcaaggatgggtgaacgaggacaacctttcttcaccctgctcaagaagcaggacatagtcaagtggagctaagaagacaagaacacgttcatcgtgctcaagcgctacttgtcaaacccccctgtactcgttgctccacaaattaatgaagagttattcctgtatatcattgccacaccttaatctgtgagtacggttattgtcgttgagagggaaagagtacaatacccagtgtactacaccagcgaggccctccacgacgcaaaaactagatacccacagatccaaaagctactctatgctgtgattatgacatcaacaaagctacgccactgcttccaagcccacaaggtcactgtcatctcttccttccctttgggtttctagctgaatatgcagattcatcgttgtctgaatgtgtgtgaaactgtgcattgctagatcatttatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39344 - DNA, 1051 bp, Oryza sativa
  unsure (1)..(1051): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgcggaggaagttctcgaacatcgagcccttgagagctgttgcatcgccggctgaagaggccgttgagcttacgcgcggaggaagttctcgaacatccaacccttgagaaccctcgagaacagcgacagacttctatagcaagccgcactgcggtcaccacgattgcgggtcacctcgccggagctgttgcatcgtccagtgcttctggatgaaggacgacccccagctccgctccttctcgaacgccgtcaccaatgacctttgcatagctgccgccgccataagctggcccatcatccgcctcctcaccctcctatacgacgccgccgccgccaccgaccaccccgcgaacagccgccggcgctggaacacagatacggggaacagacgagagagagacgggtgcccgatttttcctttccgcatcggttttttccatcatgcacaactctccaatagtcacaaatttaaaagttctaggaaaaaaaacttggcgaagttttctggcaactccgattatttttctttaagatgtggccaataagtatttcggaaatgctaacgatctgtcgacagaaaatctacctccaaatcttgtagattttggtccaccggataaactttatcattagtgctccagggccttatcctccaactctggccaccccctgttcttatccagcgccggcgacaccctagactccg

SEQ ID NO: 39345 - DNA, 8528 bp, Oryza sativa
gcggcgacatgagcgaggggaggggaacgagaggagtgttagggttaatacctctgcacgaatctcaaagtgtatccgatggttcaaaatttgaaagatggaaagtgagattttctatcaacagatatacagacaatcccaaaaacaattcatgttgaaacttttttttcgagcaatgaaatattgcaacatattttaacatataatgcaacatcatcaggagatttgcaaatatccggacgtccgacgcgtagccctctccaatcctttccgctgctaactagcagtgatacgtgacacgcaatcccagggagatggtacatgacaatagaatcaacaacggcacgttctatcgggaaactcttgattgttcacccatttaatacatgtaattcaaatagttatgaaaaaaaattgaaaaaaaattgacaagatagatcaatatgtaatatatcactccacaaacatgcaaattaaaattcaacttctataaattgtaaaaataaagcaaataaaacttaaattagtatatgcatgtatagttgcagttaaatttgttatttttgttacaacttgtagaagttgaatttgaacttgtatgtttatagtgtgatatattaaatatcgatctatctagtcattttttttgaatttttttcataaccatttatttgacatacaataaacgggtggacgtccactcaagttattagaatccgtctcccgttctatcgccattcttccaagtggctaaaagaaaacgtaggttaccatgtttttcctatatttacttgcttcgattcacattcagcttcaaatattgttgccattatttgggaaactactccattcatacctttaggatttttcatgtcgcttaaaaagttatcaaaaatttaaagacatttagtaacaaagatcaatatatgatatattacttcacaaatatgtgtatgttcaaattcaatatgtaaaagtagaagagaaacaacaaatttgaaatttgactatgaatataatgcgtaatctgtggtcaaatttgttatttgtttgcgttgtataattcaaattttaacttgaatgtttgtggaaagatatattatatattgatctattttgatttttttttcaaaaattttaaacgctatgtacaaaacgagaggatatcttctcgggggcaaaatctacttggccattattttgtcactataaattggctaagttcgctagacattcttagctagcgagcaacaatacgtgggatttcatcggggtaagaagatggcattctctgccacaaatatcaagtttcgatgaccgtagaaacatcaaaaaatttaaaagctttgaaagtgtagccaatctagccagcttggcttctcgtcgtgacaagatgtcgttggtaggaagcactagcagcgcgagcacgtcgatgagaggatgctcgatgttagagacaagtatatagtctataagacaatacaaaaattattatttagagatcatatctttataataattcaccattagaaaatgattttttatggcgttggcttattattttcgttggcggaaaaatgtaaaaaccgccagcaaagtcgtaacaagggggtgggggaaccgaccgccagcgaaaatgaattttcactggtggcccgtctaaagcggccgccagcaaaaaaatgtcaatttttggtggtgtcgacgtttgatgttgcgattccggtatttgcatagtatggagatcattggtaccagggtatacgcgagactgaggtaaaagagacgggaacagggatttttatacaggttcgggcccctgaattgtcaggtaataaccctacatcctgttggccaaagccgatattactcttattcaccataatcacaccagtacaatattttgggtagcctatctaactgttgtcgacttggcggtctgaaggtctgactcatagtcgacaacagggtagtcttcctcctcgaatccatgcccggcgagatcagagatagcgctttagtctctcctgacagtatccggagacaccgtaggggactagccgtgcttatctccgaagtcgatatccggcgtcttgtcttggcgtatgttggcttgtatgttgtggcatctgttgttccatgtatgttgattgtgggtgttgattgtccgtgtcccctctcctcctagggggccttgtatttatacccataggtgtccccttgtctaagtagaactaggaaaaccaatatggatacaatccgagtagtccttgtcgtttccatgtagaactctggttgtctttccttattcggaactcctcctatatccacaggttgtttccgtataggacatggtatgtggtgggtcctgccgagatttactcaactactattaggtatgtggtatccataaccctgataggtggcggtcacttaggtgcgccgccagcgaaaatatataattcgctgacggtcgaatttttcctggtggccaataaacagaaccgccagaaaaaacccagctcgtacccaatatccctcacattaaaaaccactcacctacctcatcctcttctcttctctccacatcccctcctcttcttacccctcctcttctctcctcctccatcccggcctccccaccggcgacggcgatggcggctctggcggcagtgaccagcggctccccgcgccacccctgccctcccatcccctcctctcaacactcccagatccactctatcctccagatccactcttccctcctcctcccttcccaacgacgcgtagccctctcctcctccctctccaccgacggcgcaggagatggaggctccggcggtggcaaaggggatgggtcgtggcggtgaccgggctctgcagcggggacggtgctggcgcgacggatccagcaggctcggcgacgtctagtctcggtgacgacgacgacgcaggcgacggatccggtggcgagctctccttctccctcttcctcctccaccgccaccagctatcgtcgccaccatcgccgcgggctgccgtcgcctctactgccaggagatcggggccggccggatccggccgccgcgacgacgggagaggctggatccaccgccgtgacgacaggggtggccggatccaccgccgcgatgacctgggaggccggatctgctgccaatgctgatgggggaggtgccgcgacgacgacttcaaatttttgtgatgcttgaaagcttgggtgaatggaaatttttgaatgtaaatttttgtgaattttagaatgcttgggtaaatttctgtgaaatttttgaatggtggagcgttgatggaggcgggcggagcggtgtcgctccgtccatcattttttaaaaaaatttggccagcatttacaccagcggctggcatggtgtaacccgacagcgataattcattttcgctggcggtcgtcttatgcctgttgccagcgaaaatggattttcgctggcggctgccttaagacgaccaccagcgaaaatgaattatcactggcggtcgataaccgctagcgaagatcttgattttcactggctttttgctttgtgacggcttcaaattccgccagtgaaaacccaaaatggccgccacgaatgatggttttggtagtagtgatgggaacggaaatatattgttttttattactattctttcaattcttttcaccctcatgcaagagtgtttctatgttctagaggctaagtgtcgttgttaagccgttgttaccagtagcaacaattgtttgcctcttttctttctctctcttccatatcaacgaacactcgtaattaggaagagtaagagatcactattcagtgccacacaaagcgtgttagttttgattaagaaatctggcacctattgtcggttcccaactaacacctagcagtggcacctttgagtcacctcgaagatgctagtttaggaaccggcacctttaaggttctcgggatgaaaaacagggggggcaccgagcacatccaccctgcttcgcccccaaaatcaaacgctttgaaccattagatcaatccacaatgaactctagatcataatcatcgtcacaacaacacaacaacaacaacatcatccataacaagttgtcaccgccgccggatctgccgtgcaagaagcttgggacggaaggggaatggaggtggtagaggacctccgggaaagccaccgccgccactggatccgctcgctggagcaacgatgccatcgcctccattggatctgccacaagaaaatcttgttggtggagagggagaaggaccactagatctgccgccaatgagggcaagggagcagggtcaagagagagggggggttacagggataaggacaagacgggatatatgggtggttgataggctcggctctttttttttcatatagtttttctaattaactgacacctataatatattataggtgttgtttcttctaagtaaactgacacttatagtattggtgtcagtagtatttctttataaccggcatccatagttttgaaaagtgttggttctatttttttttcccgcggggatgagaaaaagtgtataggaaccagttttaactgttccgccacctataataccatatcatttgtgtgtgttttaagtagtgattaacaacccttgtacatgccgttatgtcctcgtggtgcaggcctcaccaaacccgcacttcaacatcccggtgtaagagaggaggaaatgccagaggcggctaggtggagcatttttcaacaaaaataatgaatagtgatggaaataacatgcttggagacattgatcatttcatcaatttaaatgcctaatgcttagtcgcacgataagcatgtgttggatgaaaagatgcttgcatacaacaacctctgctgatcgattcaatcacctgaagacttggttctcatgtgaagcgagaacatgcgcttgtggccgtttggcggctgcgtttctcatggagccgatccggctttgacgcggaggagcaacggattgagcgtgggctgccgttcggtgttagctctatataggagtgaaggagacgtctttgaaggacacagaacacaacagccatctactctgaaattcctcaactaccgccgtgttgcgtcgccgtcgatccaagccggccgtggtgctcatcgtgcaacgagcattccggcgagcggtgtctccgagccttcgccgcattcgcacctgcacgggggcggtgtaaaggtttctgggcagcgtatttctacacggccgctcgacatcatcgattgactgcagtgcttcgactcgctgatctccgtcgatccattcagtgagtgaattctttcgtttacaaaggaaaggaaccggtgcatttctaatctagttttgttcgtacctgagttttgtatatgcatggtactgttcatctagattaaaatattgcggctagattaccattgtgattagcctaataacttacttggcttggttatttatgtcttgtttgatatctagcatgatagaatttatgagtttttcttgtcctatcatgtcgcaagtaggttatgcttgctgtatatgctaaattaatggctaagtatgcactatttccaacaaatagtacttgtgcatgttaaaaaacatacaaaattaaaactgcatgcatacatctagtctaaaaaatataaatgagtccagcaattttccatgtgcaataaattacacaccaattccactcgtgcaccgtcgacgatcatcgcagccgcctctcgagatcagagaaacccaaacgtgcgcacggctggcgacggatgcatcttgaagaaggcgtgcgccaccgtgttctccctgaacgccacctgcaataacccgccgttgcgcgcgccgcacgcgaacacgtggagcgccctccccctcgccgccgtctcatccacgccgtacagcgtgatgcgacgccgggtgaacgtggcgccgccggcgtcgccgccgccgccgccgtcgtcatcccacacggccacgctcgccggcgtagagactggtaacatgcagctatatttgcattcccagacaggtgcccactgctcgccggcgtcgccgccgccgccgccgccgacgtcatcgtcgagcacccacagcttgagcgtcgacatcgctccgcctttcagcaccgcgagtgccccgtccagctcgaacatcagcacgtcgtcgtcgtcgccgttgttcgccgccgtctccggcgacggcgccaccagccggaacgcctcggacaccgtgtcgaacgccacgagcttcgcgggggcgtaggggtttaggtgcgggtgtctgccggcctctacgaggtcgcccatccagtagagcttccccccggcggcgacgtggcccaggtgagagcacgggtgtctctccacgagctggtcggcggtcgcgccgccggggttcgccgccgccgccggccgagatgacgaagtacgacgagctgtgcttgcgcgacggatcggggcccttggacagcacgcggtactcgccggacggccggtggaggtagaagcccagcgcggcggacgacaggtgcggcgggaggcccgaccaccgccgcgttgtcgggtcgcagatgacgcggaggcgccgccggtggtcggcgaagaggagcaggccgtcgcaggacgcgaggagggtgcagtgggtgtagccgccggggaacgacgccgtgtagcgggcgagggggcggcgcgcctcctcgccctcggcgccgccggagatcagcggggcggggacgaccacgctcagctcggcatcgtcgtactgcctgccgttcgagtccgacggccgcctggagacgcggaggagctggagcggcggcgcgcggcgctcgcgggccgcgaggaaggtcgggtcggcggcgacgcggcgccactgcttgcacacggcggcgaggcggccgacggagttggcgggaacgaggaggaggatctcggcgaccatgtcatcgctcaggcttactggccgtctctcgcacggcggcggcggcggcgccatgtttggagagcgtgtgctggctgctacctagggtttttgtttttgtttttttttaaaaaaataaggttttgtttttagttttgcttaaggatacgtaagcccatatataaaacgtattgccccaagggcccaagagataaacatggagatcatcagtcgaacgacacgagatgaacgcattgagataatcgaaggacatgcagaatcagacgtgtagaatcgcttggcagtgctttgagttttcctgctactttgttttagaaaaaaagaaaaaaaaacgtatgcacggcacactattttgatcaaattcgtacaacacacataatgtaccgttcaacaaagtcaaattcagtatacgaacggtagtggtattaagcggaattgctaactatcatttgacagatttataagccttccatcattcgttttttagccgttagatggtttttgagatccatgctagcatccctcctttctataggataagggattatgagtttttgcttgcaatatttgactacttgtcttattaaaaaaatttgtgtaaatataaaaaacgaaaagttgtgcttaaagtactttgaataataaagtaaatcacaaagaaaataaaacaataattctaattttttttttaataagatgaatggtcaagcagtgcaagcaaaaactcaaaatcccttatattatgggatggagagagatgtaagctagactgtcttaaccaacgacttctcttgttgctactagtacactcaatagtgcatgttttttttcttcttatagaattttcttttaaatcactcatccgatctatgatccgattacaccgttgtattcgtaacaattaaatttttacaacaaaatctcacatgataatattttttttatgaaaaatacaatttacttttataatatatctaaattacttttagatttcattaaattacttcttagatatataaaagtaaattcaataaatggtaaaagtaatttacatatattatagaagtaacttaaaaaagtaaaaaaagtaacttgtcacgatatcaaaagtaaatctattatggaggtaaaaacctaagtttatctagaaattaaatctaatcaacatattatagaactaacgataaagtaaagtatattgttcagtgaatgtctaaaaagtaacttaatcaaatttaaaagtaatttatacgtatggtaaaagtaacttacatatatatgataaaagtaatttacaatataaatattttttattataatataatcatgtaagatattgttataaatatttaattacaacgaacacaatggtatagtcatattgtagatcgaataaatattttaagagaaaaatccataagaagaaaaaaaagagatacactttgtgcaatagtaaacaactagaccatctctcacgtacgtctctcacgtaagtgtaccaactaacacaatggtgtagtcatattgtag

SEQ ID NO: 39346 - DNA, 8757 bp, Oryza sativa
tttaatactaaatcgagagcgctctcggtttagattgtacttgctaattaactaggtccacgttactgttccctgctgttctccggttgaatatttatttgtcgacagcttgcgttccgcttggagagacgatttgattttccccgatttctgcatagatttgagttcgctttgcctaatcttcgacaggcttcttttgattggaggcggcaaaacttggagcatgatttggtgagattactgggctattttctttgcatttccttcgaattgagcagtgttttccgacctacttttgtttatgattcaccatttcaccggagttgtcgttgccgattcgatctgcgagcaatgatgagatttctggatctcaactccacctgagcccaaatcagccgttgccgactccatcattattgatttgagccgtgtttttcaatgctattttgtttacgatcccacgcgtgctaattacatcgtgcttatactataattatatatgtaatttttcagacttacatcataaatgcactaaaattatatatataatttacgaacttacaatataaatacatatcgactgtttttttaaatattatgacgttataaatataattactctcttaatttaaacagatgagatgatatttgagctttaatgggtcacggatgattggtggcctgtttaatagtgggttggtcatacaggtttcgacctgttttttacttttcgtaatggtttgtatagactttttgataaaaaatataagaacggttacgaaagagaactcaaaacccacagatagaacataaaagtactctagttacgaacataaccagaagtttaggagatttgtaatgtgaagtgaaagaggcagattagagtgagtgcaagaggaattcgaagggtagacagggatatgttcacggagtcaaggaagaaaggagatggagggtctgagcaccgaaaagagttgaggatattgaattgaaaaaactcaccaggtcaaactcgcagggatgatatagcagaaagaatgctcgttggagtctcgcggtggcagaggttcaccgacgtctgtagtagtggtggtagagccaccagggtagatgagcagctggagataggtaagcaagcgggtcgacatgtgaatctacttatatattaaatcttggcttccttattatggtctagcttaccgtatcttaccgtatcgaaagatataagtgggtcgtcccataaacatatttaggtcaaattaataggttacccgcgtgagttgcccactattttaacatataaacgggttcgcggacttgcatccataactggagagactcgcgcgcccggcggtggtcgtagccggtgtcgcctctcagctccattctaattctaaagttccctcctgcgaggaagaagcccatgcgggccccgcaaaccagagtcccactcccacgacctaaaatgaaaaaaaatccatccaacggcccacgatctccaccaggccgaaccaacggtgagatgggccaccaagtctcgcccgctccctcgtataaaaactccccccaagcccaagccctaaaaccctctcgccgccggcaccccctctcccgccgcatcccacaacacctcgctctaaaccctcgcggcggcggcggcggcggcggcgcctactccccctccccaccatctcgccgcagccggaccttcgcctcgcgctctcctccccccatcgtcgattcgcgtccaatcgagccaaggtttgcgccattttcttttcttgagggtgtatatatcctagctgctcggtttgacccaagctttcgatcttgtggtttttttttttgatttgggtttgtgatccaggtgtaggtgttctcgtgcggtgagagagatgctggtgctgttcgagacgcccgcggggttcgccctcttcaaggtgctcgacgaagggaagctcgacaaggtcgaggtgagtcttccgccaccgcctccgcctccgcggtttcagctcttcgtttgctttgctgctgtggagtgttcggtggactaattgcgctacgcgtttgtgttcatccttttttaggatttatggaaggagttcacgacgtctgactcggcgagaaaggtttgtgttttttcttttcacgttactcccaggacaaaatattcttcttctttttttatttaataatctcgttattgcacaagatatctcatatttatggagttaaataagccaggacccatggcttcagtaggttgattcaacataggtgattacaaccttctttctttttggggttttgtgactttgagagaagcaaagtgattttcaggaataaaaaaatacaactgagtaataattctctgatgctctgaaccgcagttttgttttggatgtgtaatttgtatggtgagagaagagggtaatggttagttcagtctcctataatataaatgccctgatgcacattggaatgacatggtgtggagaacagtattatatacataagctgtgttacttttctactttgaattgtgatgagcatctccatatcttcctcttactactgtttattttattattttgagttgattttctttcctgaccaaacaaattaactatattcaggtggtcgagctgaaggctttcaacaagtttgagaacacctccgatgccctttcagctgcaaccctcattattgacagcaagcctaccaagggtttgcgcaaattcttgcagaagcactgtgagggtgaaacgttagctgtagctgactctaaacttggaaatgctataaaggagaagctggttagtaggttccttggttgctttgtttatgttgaacaaacaatcatgcttataatttgacgtgcttttgcagaaaattgattgccttcataacagtgctgtgatggagctcatgagagggttaaggaaccagctcactgaacttatatctggtttgggtgcacaagaccttggtccaatgagccttggattgtcccacagcctgtctagatataagctgaagttcagtcctgaaaaggttagtcttttatttattccactattcatatttattgatcacgctatccagtgcttcttcctggctctgagtcatatgaatcaacatcattatcttttgttagtttccaaactagatttttcaatgccatgcttctgttaactttacatttaacttccatttgcaattaattagtctagcacttcagcattgtgatggactgaggttaacgttactgtttttatttgtacatgaccccatcctgacaagctaactgaggtaaattgtttctggttatacaggttgatactatgatcattcaggccattggattattggatgatcttgataaggagctcaacacttacgccatgagggttcgtgaatggtatgggtggcacttcccagagctcactaaaattgtagctgataacatacagtacgcaaaagttgtgaagatgatgggtgatcggactaacgcagaaagccttgatttctctgaggtaaattctggacatacctgatctgaatttaacggccatgactatacaccacaactggttcttgaatatgaagcaaatgcttttttccagatactctcagatgatgaggttgaagcacagttaaaagaggcggcagtaatatccatgggaacagaagttagtgaacttgatttgctaaatatcagggagctgtgtgatcaggtgttggctctttctgagtacagagcccagctgtttgattatctgagaagcaggatgaacactatcgcaccaaatttgactgcacttgtgggcgaattggttggtgctcgacttattgcacacggtggcagtttggtaaatctggccaagcagccgggcagcacaattcagatacttggtgcagagaaggtcagttgctatttgtgaaccttgaactctttaattattttccactctttgtagtttatgcaaaattgtcccttggatgatgggttctctaggcacatggggaagggatgcttgattgttgttttgtgtaactttcctttttttcatctccttatatttctgtctaagtctgggaggtaagtttgattcaaacaactcaatttttctgtgttgtgctgacatctgtttttcttttttcaggctttgttcagagctctcaagacaaaacatgctacgccgaagtatggtctcatttaccatgcatccctaattggtcaagcagctccaaagcacaagggaaagatttctcgttctcttgcagcaaaaactgctcttgccattcggtatgatgcccttggtgatggtgaagacaactccattggtctagagagtcgagtcaaggtatttactttgtggaaatacatttcctttgtccataatattttctgacccattgagattgacatgtgatccatttggacagcttgagacgcggcttcgtgttctcgagggtaaagaacttggcaggtctgcaggttccactaaaggaaagcccaagatagaagtgtatgaaaaggaccggaagaagggtgctggggctttaatcactcctgctaaggtaggtggtatcacgaattctctcttgaaagtattttcaggaagcttaacgtcttgtgttattcttaaccagtacttgaagaaaaatactagttgtcaaggcagttgttctttgttagatacctaacattttgaccggtcactgtaaagatgtcttgtgtatattactaacattttatacttagcaaacatctgttattggtaccaaggcactctttttacttgtgtaagcatctgttattcagaagtcatctcaacctgatgctttgcacttgatcccagacatacaatcctgcggctgatctggtacttggacaatccactgaagaaactccaaagaagcctgaaggtgcttcgaagaagaggaaacatcaagagacggagcctgcaccagcagagaagaccactaaagaggatggtgaccaagaaggtgaaaagaaaaagaagaaaaagaagtccaaagagagcgaggaatctcctgcggccgatgctgacggtggcaagaaaaagaaaaagacgtccaaggagagcgaggaacctccagtggccactacagaaggtgagaagaaggagaagaagaaaaagaagaaatctgattcacaagatgccgaggatgttgccatggaaaccgaggagtctggcaagaaagagaagaagaaaaagaagaaacaccatagcgatgaatgaaggatacactggagaaggacatgttatcttgagtagcatagggttgaagaatcgctgctctgtaaaatgcaacattccgagtttttccatgccggttagttgtaggataggcatcaagtttggacttgttactcatggatcttgtattcaattgcctactgaattttggaattggagagcatatgatgcttttgctcattctatgtgaactaaagtttcttgtccttttggctggccagatctcgttctcgcagttgctgttgatgtctttcaggttcttacttcccaacagtagttcgtgctctttcgtctgattctgaagttgtcttttttgttagtatgtgctgtggtgacaatgttgctggtcgccaaggcagcactacgcatgcatgatgctatgggtgactcggaacttttggatcaactttgccaaccagattgaaagccttggctgcttgtctgattatctctgtacctgcagcaagtcagcaacgctacgcatgttgtatgtactccctccgtccccaaaaaaaaaaaaacaattctggacaaccaaatcaaacacggggaattgcaccagcgcaccactaactaaatgttactcccttcgtcccggattttgatattttgcttgtactgtttgaccagtcgttttatttaaaaatatgtgtaaatataaaaaacgaaaagttgtgcttaaagtattttggataataaagtaagtcaaaaaaaataaataataatttcaaaatttttgaataaattgaatggtcaaacatacaagcaaaatatcaaaatctcttatattagaggacggaggaagtatcatttatgtggacggcatcattacaccactaactaaatattttcttactactactacgtattctaggctgttgttggtccaatactccaggatgttaagtatcccatgcatgaattgtcaaaatcccttatattagagggcggagggagcatcattttatgtggactacatcattacaccagtaactaaatattttcttactacgactacgtatattacactgctgatggtccaatactccaagatgttaggcatcccatgcatgaactgtcaatgtccgtacggaagttaatattttcttactacgactacgggtgtgtttagttcacgctaaaattgaaagtttggttgaaattggaacgatgtgatagaaaagttgaaagtttgtgtgtaggaaagttttaatgtgatggaaaaattgaaagtttgaagataaattttggaactaaactcggcctacatatactacgctgctgctggtccaatacttcaagatgcgtctcatgcatgaactgtcgatgcccgtacggaagttattagatttgataagtacgtaaaacctaactgattttcttctggtgacatacacacgttggttaaatagacaagtttatcgaaatcagggctgctgctgcttctttggccagatacgttaagcaaaactcaagaccaagccgttcgttttcggtcataactgagatttgtgataattgaaaaatcaaataaaccataacaaaatttggcagcaccttcctcttttatgattgtttggcaaacaaataacataataggaaacaatatataacacactaatttaccaagatggatcgtagtagtttatttttatcaggaaggcaaaaaccagccgaagtttattaagaagggggagagaaaaaacatttacaatgcttacaccaggctaactgcggtcagcaacggtgaactcctaggtagctcaactcacgttgaaacacatgcttccactacctaagtatagacttaccttagcgccttctggtgtccgccagcttcagcaggccaaccacctcccatgtctttcactcgtccgcaatcgccgtgcatagggccctagccgaagtggtcttccgttcacagacatgcgcatttcgctccttccaaatgagccaagttactgaatttacatccgtattgaaggattattcggtcttgttttgccaatcttcttccatgcctcaatcgaccaatcggataggttaggagaaggcggcgggcaaggaaagccaagacggcttcacacccgctcccacacatgcgctgtaaactcacaattgtggaagatgtgtgcacatgattctaactctctgccatagagaaagtagcagtttgccaagtgacatgccacccgtgtcactgcaaattgtcggtggtgaggcaagctccacgcatagtgaggaacatgaaaactttgcatcgcttcgggctcaggccttccagttccagatgatcttgcccagtgcacacatagttcgcccacaataaagcatcggatagcccgatttgcccgagaattcgccatttatcgttactgcccataggaagggaatcaagagtgctgggctccaacaccacctccgcgttcatatcgaaaccttgaagcactccacgagtacctgaaaggacaactcgcttttgatatcagcaaaccatgcatggtcctagagcacgaatgccactgtgcggcctcctgtttcttgacaaaggaggtgagaataggtgtccaactctcgattgagctgcccttgggcaaccaacgatccttccaaacggatgcaagtcttcgtttcctgaggatcaaatttgaccccgccgcgagaaggtgagtaacctttggcggtgacgctagtgcaacccatgggcgattggacaatgtttgacgcatccaacaccacctagcgtgccacacgactcccatgcgtcaatagattctagacgctctgaccatcacactctatcgacaagtataacttctcttgtgccaccaggcaagtttcatcgaaagcttatgcatcacccttccaaatgaaccttttgtacttcttctcaatctccttaattgccaggctagaagctcaaggactgacatgaagtagagggaaagcgccataagaaagtgattgatcaacgcaatgcgagcatctcgaaataacatcttgggtttccaccccgtaagtgcttggagtttgttcatcattagctgaatctttgccttcgttggtttgtgtatggaaaggggtaggctaaggaagttgtcggcaaaggtttcaccgggcaacacaaaacgttgttcttaatctagcaattttaactttcaacttatgaccaagccatcaagactaagatactcttactatttaggctttcccctctaatttcggttaaattcggtcattcaattaactgagagcgatgaccgaattaaccttaatagtttcagttagtggaaaaacctggtcgaatttctcaccgaaaatttcggcatcgatcatttccactggttttctgtttgtggtcactttgcccacccgtcacatgttccccatttttgcaatacagctgtctccataataatcaaacggattgcaaccctgagtccccgacctaataagccatccggggtgc

SEQ ID NO: 39347 - DNA, 12057 bp, Oryza sativa
gcagccgggaacgtacgcttcgcgctttcctctcccgtcgtcgaatcgaatcgacccaaggtttgcgcgcgccatcctttttttttttttttttttttgctgctgctgctgctcggtttgagcgtggaggtttgaggttggggttttgatttggtggggggggggggggttatctagtagttgcgggacacgggcggtgagagagatgctggtgctgttcgagacgcccgcggggttcgccctcttcaaggtgctcgacgaggggaagctcgacaaggtcgaggtgagtcttccgccgccgccgccgcttcagctgttggtttgactttctatggagtgttaagtggactaatcgtgctaacgcattttgtgttgttttttttaggatttatggaaggagttcacgacgtctgactcggcgagaaaggtttgtgcttttcttccttacagcacaaaattttctctttttttttgtttattaagagcgttaatgcatgatttgacacatgtcgatggagtcagttaaattagcacaaggaccaatggcttctgtaggttggtgagtactacatatgttttagcttagctgattttgccttgctaattggggatatgattttgatagatgcaaagtggttttcgagaaacaaaaaaaaactgactaatcctaccatgttctgaactgtaatttcctttccaatgtgttatggttatcaggggagagagatgtaatggtttagtttgcctcctattgtgcacatattctgtccgtccgatgtctatagattgattcgacaaataaatttgtgcacattgagtttatgacattatgtggagaacattgtcatgtacagaagtcatgttactttacgccgaattgcaatgagtctatccatttgttcctattactgctatttattttgttcttttcagttgattttctttcctgacaaaacaaatcaactatatttaggtggttgagctgaaggctttcaacaagtttgagaacacatctgatgccctttctgctgcaaccctcattattgacagcaagcctaccaagggtttgcgcaagttcttgcagaagcactgtgagggtgaaacttagctgtggctgactctaaacttggaaatgctataaaggagaagctggttagttaggctcctggttgttttgtttatgtagaacaaccaatcatgcttataatttgacgtgcttttgcagaaaattgactgccttcataatagtgctgtgatggagctcatgagagggttaagaaaccagctcactgaacttatctctggtttgggtgcacaagaccttggtccaatgagccttggcttgtcccacagtttgtctagatataagctgaagttcagtcctgaaaaggtgagcttttatttatcctaccgttcgcttttattgaacatgttattcagtacttctccctggctctgagtcatatgattcaatcattttccttttgttagttttcatgctcaatttgttactcttatgtttctgttaactttataacgaataactcgcacctgcaattatttagttcagcatcaaatggatatacaagaggtcttactatttttaatttgtacataacctcttcatgggactgttactgaggtaaacactatattgtttctgattatacaggttgatactatgatcattcaggccattggcttattggatgatcttgacaaggagcttaacacttatgccatgagggttcgtgaatggtatgggtggcactttccagagctcactaaaattgtagctgataacatacagtacgcaaaagttgtgaagatgatgggtgatcggactaacgcagaaagccttgatttctctgaggtaaattctgcacatttgtgatcagaatgtaatggccgtgagtatccaccacaactggttctttattaagaagcaaatgctattttcagatactttcagatgatgaggttgaagcacagctaaaagaggcggcagtaatatccatgggaacagaagttagtgaacttgacttgctaaatatcagggagctgtgtgatcaggtgttggctctttctgagtacagagcccagctgtttgattatctgagaagcaggatgaacactatcgcaccaaatttgactgcacttgttggcgaattggttggtgctcgacttattgcacatggcggcagtttggtaaatctggccaagcagcctggcagcacaattcagatacttggtgcagagaaggtcagttgctatttgttattcttgaaagatttaaccattttccactcagattacttgatgcaaaataggtaaatggaagtatgggtttgttttctagtaacatggggaaaggatgcttcatgtgtggtgtttgtgattttactttgtttgatcttatatttcagtctatgtctgggagataatatgtttcacacatcctgtacttggtccctaatgctaggatatgcccccatcctgtactaggttgctatattatgggacggagggagtagctttttgcggtgtattataatttgtttcccacaaaaataataagtaacacaatctttccctccaggctttgttcagagctctaaagacaaagcatgctacgccaaagtatggtctcatctaccatgcatccttaattggtcaagcagctccaaagcacaaggggaagatttctcgttctcttgctgcaaaaactgctcttgccattcggtatgatgcccttggtgatggtgaagataactccattggtcttgagagtcgagtcaaggtatgtactttctgaaataccttttctttatccataatattgtctgactccttggattgacatgagatccatttgggcagcttgagacacggcttcgggttcttgagggtaaagaacttggcaggtctgcaggttctactaagggaaagcccaagatagaagtgtatgaaaaggaccggaagaagggtgctggggctttaatcactcctgccaaggtaggtagtatcttgatttttgtcttgaaaatatattgaggaagcttaatgttttctgttaatcttggccactcttcaagaaacttactaattttcgagactgcgttgcacctaacgttttgtccagtcactgtaaaagctgtcttgtgtattttgcttacttttacttgggcaaacatctaattcagaattcatctcaacctgattatggcacctgaatttgtcagacatacaatcctgcggctgatctggtacttggacaatccactgaagaaacaccaaagaagcctgaaggtgcttcaaagaagaggaaacatcaagaggcggagcctgcaggtgcagaggaaaccattcaagaggatggtgaccaagagggtcagaagaaaaagaagaaaaaaaagtccaaagatagcgaggattctcctgtggccgatgctgatggcggcaagaaaaagaaaaagaagtccaaggagagcgaggagccacctgtagccaccgctgaaggtgagaagaaggagaagaagaaaaagaagaaatctgattcacaagatgctaaggatgttgccatggaaaccgaagcgtctggtaagaaagacaaaaagaaaaagaagaaaaagcatggtgatgaatgagggatacactggagaaagacaatcttgggtagcattgggttgaaaactcgctgttctgtaaaatggaacatgccgggtctgttccatgcctgttagccatagtataggcaccactgttgagacttgagacttgtttactagtggaactgtattgaagcacctagtagtactaaattttggaatagggaaacatgtcgtgcttgctcgttctatgtgaactgaaatttttggtccttttggccgggagggtcttgttcgtgcaatattgcaatggctgttaaggtctttcaggttcttacttccctacagtgaagttcatgttctttcttctgaatttgaagtggtctttggtatttcctgtatatctgttaagactgtagattgctggccaaggcagtaccgtctagtatgcatgatgcgctataggtggctcaacttttgagttccttagagccaccatcccgtttttggtgcatggaggggaaaaacatcgctctagcagaggctccatcagatgcgccaaaattggcggatcgccaaacacggagagagaagtgccaaatttggcgcttctcctcacgccatccccaaacgcccgctctcatccggttctcctgcccccatttggatcgagcatgaagggtgaaggaagagagaagagaggacgtaccggtggctaccttcgccgtttgaccgccgtcggccaacggaggggaggggagcggaggggatcgttcgaccgccgtcggccaacggaggggaggggagcggaggggaggagacctggatctagccgcccgtgccgccgtccccgccgctcgcctgacaccgccgcccgctcgccgccgcctgcctcctccgcggctcctccgcccgcctccggtcgtttgccgccgccccttgcccgcctgccagcttgtcggtggacgcgcagtgccccgccacctggtgctccggcgcaagcaggtcggaggccatggcggcggcggtgggtggtggaggtgaaggggattcggcgagagaggagaagagttgagaaatgagtagaagagagaagagaagagttaatataaaatagatggcagttgaaagataatagtaaaatataggatagatgatgtaatatgaatgatctgttggagtaaaaataaatatgaagtgagaatttttttttgtaggaccattcaaataggcatatggaggatagaatatagatgagctgctagggatgctcttatgaccatggaattttataggaattttaaaggattgaaatcctataaaataatatagttctgtgaagctcgttggactacaagaatatgtttcaaaatttctcccattcatccactttttgaagtatttcagacatttgatcaaagactagtagcagcatggttttcattgggctactgcttccttctcgaaaagaacgagtggacaggataagcatgacccgaaaaaaaacagactaaaagaaaaataaaaaaaatgaatgcatacggatacgtgtgtagatgatctaatacaagatttgtcctaaaatataactacttctccaccaacatttttttcccaaccaatcacaactctccacctacctccactactcaatcaatcacaaccctccaccatttacttctaactactttcttaataaccgtatccaactcttaaaatgcttatattttgggacggatggagtagctatctattgtatatatactactcttactagttaacttaaatgcttgatgtggatattattggagctaatagcaaagctatgttattggaattgctctgatatattttgtctattttaatcgtctgaatcaaaattcctatgattctcatatgcagtagctaaacatgtcttttaccaaattttcctataggcttcgaccaatacgatactttatttctgtatttcctattgctgtatttcgaaggagtcgaagcttgcaggagaaaaatttccgtgaaataatctaattaagagaaggccctcgtgccgctcagccccagggcggcacgggcggcgaccagacgagcgcgccgccgccaacctcttcctcttctcccctccaccttgccgccgctcgagcgcccgccggcaaagccggggggacgcaatgacagcggcggcgaggctccctacctcctctcgcaggcgcggcggctggggcgatgccatgaccggagagaggtctcgcgggtgcagcggtcgccggcggccagatccggcgtcggtaggaccggatccggtccccacacggctggatcgggcgtctcagccggtggcgacaggaaggaggcgcacgctcaacgaggagcgcggaagaggcggcggaagtggcgacgtgcgaggaggacgacgttcgcgcgcaggccggtgacgctcccgtcaccggcggcccaggttcccgtccagatccgggccgggcgaggcgctgggaggtggcggctagcggcgggggagaggttaacgtcggggctggagagggtgcgaagaccggtggcaggcaggggtggcttcgcggtgggcagcagcggcttgcgccgaggtcgcggtgttgacgggaggtcagcaacggggctggagacgacgcggagatggtggcaggcaggggcggcgtcacggtgggcgggcagcggcggctcgctcgcgccggtcgcggcgtcggcgtcggcgtccgtccgcgcggggtcacagcggtggcgatagaggctgtggcggcgtggtggttgcgacgacgacggagctgcagcggcgcggatgtcgagccggcttgcgccgccctggctggatctggccgtccgcgaccagttccgtcgcctccgcgccggagggcctgtctttgccgttatggtcgaggtatgaatgcttgtgagacgtcatggactattctgtggccgtcattgtgggggtgcttgtgtgggtgatacgaagacgtcggcgaaagccttgccgtgcctttggccggttcgacgacgacggcgcccgtgggcgccgttttccttcttggaggcgttgtcatggcgtttctttcatatcccccacaaatctccaggtgaaaaccttgttccggcttcggacgagcggcggcggcggagttacgacgtcgtgtcctcctttggggcgtcgcttcggagaagttccaacacattgacgactgttgatggtccttttcggttcaaaagctctcatacattgtgttcggcgaggccttcgccttcttgggtccgctttgtttctcgtggtgggtgtcacgctctttggttgtttctgcagatgaagtcggagctactcgctgatggggtgcggtgacgcctggcaacgatgacatgttgcagtctcttcctaggagttgtggtgctggccgtgtaaaggaagtggctcctcggtggcttggctgatgtccattgttggatgtcggagctgctttttgctttggcgactttcatggctttagtgtcgctgtggttgtgaagtcggcgctgctgggtcgcttgggcggctagctcggcaacgataacacctcttctgcggtgtgggagctgttgggtggcttttgtgtttagcttggcgacgacgtcctgcatttgggctccgccatcatggttagtagtgtagcggtgggttttagccggttttcctgtaattaaccatgcggatgtatggttttcgggtccggttatccttataaactgggtcaattctcttcttctaaatataaaagtggaacgaagttccgccttatgtttcaaaaagaagcttgcaggacagcaacttaagcacatgttatgtaaccaaaccaaacccgggaaatacagtacaccactaactaaatcttatcattgatgtgcattagatcagtacaccactaactaaatctttatcattaacgtgcatcagtgaactcgattgtgttttgccttttttagctataacaactttctattgtagtgcagaagtccccctccgtacaacaattttagaaaaagctactgccttttaggctttagagtacaacagtaggttcaacttgttaagcatcccatgcgtgaactgtcactgtccatatgaaagttattacccttatcatccaaaataaagcaaccgagcttgagataagatttctaatacaatgaatctagacaacttcttgtttggatttgttatgtactacgtactgggaggacctatctaattcgttgtgttaagagtcctatctcagcggttactttaatagtaagtagattcgctacatgactctaatatcgacgaagttccaatagtaactgattttttacatatacacatgttgttggtttaaagcagaccagtacactgcatgatgaaaatcacagcctttttttgtctgacgcaagacgcaactacgcaactgcatgatgaaaatcacagcctttacttgtgaactgctttgcctgacagccgtatattgtggcactagacttaacagcttggtcttgcaagggaacagatgtaacaagtttctcagcgacaaatacctcgaaatgcacaagtccaagttactgacatgtgacaaatacctcagaaacattttcttgcacaagtcctcgtagtaggctgtgtttaaatctaaagtttggatccaaacttcagtccttttccatcacatcaacctgttatacacacacaacttttcaattacatcatctctaatttctactaaaatctaaactttgcgttgaactaaacacaaccctacttctattgtaggtaacatgttcgtggtcttgcttttctcgaacaccggcaacaggagcgtggcaggttagatttgtttagtgatacacatgaatgacaaacgcaatatctcaaaaggcaaaaaaaaaaaaagaataaaatttagagcagaaaaaggaagtctgctatagacagaacatactccctccgttaaaaaaaactcaacccagattcattgtactaggaggggtcccctcctagattgagtttttttggacggagggagtaggttggtttatttcagaacagaaaaaaaagcaaatggttgatatgcacttttttcaaggctgcaaatgttgggtttagtcacacatcggtaattgatgatgggacagcacgacttaaaaggtgtgggcagtccttacccatcagactagtattttaggttgtgtagacacaagacctaaagttgtggctccggttaggcctatgctgtagcagacccaatgtgacctagacggctcacggttggtgggccgggctacgcactctaacagcaaaagctgaatgcatagagatgcatcaaaatatatagcttcctccggaacgtaagaatttagaaacacatggatagacaaagataagtcttgtcatctgatgggagttagacacaattggatttttcaagagattggatcttacgttgaaaaccctttaaaattcttatgatttgaggaaatataaggaatttcgtatgattttggtatggctattcgtttgtttcaaatgggcatgtatgaattttattataggatttgaaccatacaaatttcttttgttctaaagaagccgctggtttagagtaagacttcaccctcctacacggacacgttcgttcaggggacattgagtgagaaaacacgtcgttttccacgcgcacgttttccaaactactaaacaatgtattttttgcaaaaaaattctatagacaagtttctttaaaaaatcatattaatctatttttaaaatttaaaatagataatactcaattaatcatgtgctaattgatcgtctcgttttacgtatcttctcgatcccctgcttttcaaactcagccggattgcttgtatttgcacaaaactaaatgcccttaatagattcttgttgacttgaaagtgcacttggatgggatgtaacccactaaatttattggataatttggcctgttaaaaaaaagagtagtatgacctcaggagataattaacaccttttatttagaatactagatgataccccgcgcgttgctgcggaatactcatgtgcaatatgtgtaaacttaaaaactatatcaaaagtacatttgtgtaataagaaaaatacatgattcatatagtacagaaatattatgtgatagtctgaagcatcaaagtaccattcatgggtgcaaaagattggtgatgttgtggtataatctaatgcatatatagattagattattaaaggaaatagttttttaagtgaattatattataaatcatgtctaagtggaataagcagattaaactgtaattatttttttagctctagggctagtgccttaaaactaattaagctgccatctaaagtactaactttgatctgtggagttggagcaatgtagcaagtctacagatgaaacaccgtgttaagatgacacaaaaagtaggtgcctgcaacatgtagaacatatgcaataacaacaaaacaaagtgcaattccatgaaatattttcatgttttgaaagggtcagctttacctcatgcttgagtaccacatatatattttactgactaaacagatatataactgaaattattcctgatacaacattgtaccttaatacaattttaatgaactaaagagaaaatgtgatatctgacggatgactccggaaagcaaggagaaagcaatatgtagcataaacagaaattaatgaccataatatcaataaacttaccatatggggggttggaaaaaatctgagatctagaagttggcgagaaaaagttttgagcaccgggataatcaaattattatatgcattactgccgatggcgatcaagggcatttctgttttgtggttgatcacattggctgatgtgatttacattcttggactacattgaaacctcagacagaacaaaatccgaagaataaagttacatcaatcacaaaactgtagcttacaattctgaacttaaagtagaaacatcatatagcaaggaaggatagcatgcacagatccaggaaccaatatatgtacctaaattaagttcattgttaaaataatcacacataaccttgcacttgcaatctatgatagtatatacatgaaaatcctgacggtgtttttacagaagaaatgcttagtaatatcttgaaaagaagatatcgtaggatgatcatataataatatcttgaaagccggtgaccatgaacgaatatgaggtaccaatatattgggatattttcttgatagaggaatcatatggaaaaacccaatcagtcgctgctttggatgggaatgttatgggtactgacctcagtaatagcccatagctgctgctacaatgatagtaggcaataggtgtagggacgaactgcaataggagtttagaaacacaacaaattataggtacagcaaagttgaaaaaatggtttacataccatgaacaggctagtagaaaccttataaataccatgaattgactcctttaagtatacagaccaaataaatttcaatcttgctagtagaaacataaagaagggacaaaaccaaatccatctgtctgtttttctattctttgataacttcagtggcaagaggaacaaataaatctagcgtccatggaaaaagaaataaaggccataaattgaatgaacatatatgtgattcaagaagaggaggaagcagacctttgggagaagattgtatactcgtgtgatttcttaaaggtgaggggctgctccaggtttcatgggagggagaggccgtttccagtgacggagatgaagtaggaaaccaatcgaagtaatgcgagaagactgttatgctgtggaagacggtttctaatgaaattttactccatgtgcggcgacgattagttttctgtctctccaaataccaaggaggcgagcagtttcgaggaggcggggaggcgcgcgggaggtagggagccggcgcgtcggccgttattcaggtggcgcgggtagatggaaacgctcggcagtgtagtgggaacgggcgaattgggcctaggcagtggattgggcttgcccatgtatattgggctactgttaatggaagggaagctaagtagagactgcaatctaaactgttgctatttcatctaatggctatggtaatttgaggtgacgtgacttaaccacatatattagctttgggtcttaagaaagaaggggcaagtcaggtttgcctcctcaagccctcaagggcgagctacgcgtgagtccatgccaccttcacctggtttgatgctgccatcaattcacatcaccaagctactagtagtaggaggtataggagctcgtaatcaccattgtctcatgaataaaggagggctaaggctgttcttagattaagggtgaaattttttgtcgtgtcatatcggatat

SEQ ID NO: 39348 - DNA, 11614 bp, Oryza sativa
ctattcccttacctagtgcagagtacacttatctcaaattgaagccaaatggttttgtatctaaatcttccctttctaatatttttctgttttataattacaagagaatacacacgtagtctcgccattacacaaacacactgggctgcttttcatcttttttgtttagctaggggcttcatgttcttaaccagttgagtattggatatgctaattaaccaagattaactaaatcaagtacttcgtcaaaatttttggaaatgcctcaagtactttacttcaaatttctgaattcgcaatctacaaatccaagtggattataatgcataaaaatcgagcatgttagacatttcaccatgacaagggacaacttataatatttattaaatataaaaatgataaaacaaataagatccatatgcatgatcaattttaaaccctttccctttttttttcaataaaggtggcataacttcttccttaaagtacttaaactagcacttcatctcatttatattcgaattcatgaacatgttctcctgttccagtatttctacatgtcaacaagctctttccacacatatatagcattctttagcgattcgtacaggttaccatgcatgcatgatttgcttaaaaagtgatctgctgaaaccataaatttttcatggatcgatatgcatgatgcttgcagtataataccttttctcatgtaccatgagagataaataaattgtcatcaaattgcttctcctttccacatatttttacctaacatatgtattaattcgtgttagcagcggccagagaaatggatgagagagagatccgatcagttaagaaaggacgtaagtcagctgttcgacgctttcgatggtgtggcagaaaaaatgaatctagttgacacgctccaacgcctggggatagatcatctctttgaggaagagatagccaccaccttgaataccattcatggtgctgaatttgacagccctagccttcatgacgttgccctccggtttcgcttgctgaggcagcaagggttatgggtttcatcaggtatgctgtaaaagtgaaatatttatatgctaatactccctttgtattttaatgtatgatgccgttaactttttaatcaacgtttgatcatttgtcttattaaaataatatatacaattatcatttattttactgtgacttgattcatcatcaaatgttctttaagcatgacataaatatttttatatttgcacaaaaattttgaatagaacggatggtcaaattttggttaaaaaagtcaacaaagaaaaaccattaaaatacgaaggaaatatatgctatccgcttgcaaatacttttttttttggtggggaaaagacagatatattactcagctaaagcctccttacaaacagcttgtgagattaaattacaacttccatccggccaaaactccgaacgagcattagtccggcctctattagctaagtaatgtctgatattgttctgactacgctgaattttccgaattctaacttcccttccttcagacagcatctctcctatgtctctaacaaggtaggcaagctgagaccactccttcttcttagattggatcatatcgactgcaaccaaacaatctgactcaacaatgatcggcagcaaggtccattgcaaagccagattaattccctctttgcaagctagaagttcagcttcaagagggttgcaacatctctctataaagccacaggctgaaaaaataacagttcctaacctgtccctaagcaccgcccctatgcctcctgtactagagctcgaatcaaaggaaccatcaacatttaacttcatccagcctggctgcggacgctcccaacggcatggaactgatcttttctctggtcttgccgctacacaattctgtaaaccagactgaaccacatgtttccctttaaccacatcgacaaggggaaactgtctaacttcaagcagagaactgcagtaactttccaggaatctttttgacacatcaataggcggaggaattttaccatgatataactcattacggacgaactagatccgccatagaagcattagcagcatcattctctcctcctttggtgttttttcaacttggttgagaaaccagtaacttcctgtaccatttccgactacgcccatggacaaataccctgaattctccagagctgcccaaagatgaacagcatgaggacagcgacaaagggcatgttcaacatcttctttttcattcccacagatgcagcaaacatcaactcgctccatgtttctctttttcttgttggcttgagttgccaggctattagttgcagcccgccaatcaaatatcttcaccttttgtggcacttcacatttccaaatcatatcccaagccgccttagagttttgtcctgaagaacttgagctttcatcagtagttgctaaggagagcaccaacttgtaagcactcctcaccgagaatcgacctaacttatccgggtgccacgcaggaaaatcctcctccagacgcactgaagtacggattctaaggatctcttcagtgtcaatcggcaggaaggtctgagacaccttaagagcatcccaagaaccatttgggctcaaaagatcagaaacccatttcaaacgatagtgtcccttcgtggtaatcggcctccgagagaggtctctcgggatccatggatctcgccaaatgcaaactgactggccattatcaatcctctagataatgcctttcttaagaagctctaggccaaattcgattgccttccaccccggaagttaggttcaactaggcaactctactttttgaaagttaatgttaacaaaattcccaggcttagtaataactgaaaagagctggtaacaaaaagaatattatataacaaatattatgattttaacatgcatgtgtgtactttgcagatgttttcaacaaattcaaacacagagatggaagctttatcattgacataacaaatgacccaaaaggtctcttaagcttatacaatgctgccaaccttctcacccacaacgaggaagccctccaggaagctatcttattttcaaggcatcatttggagttaatgaaaagtaacctgaagtccccattagctgagcaagtttcacgtgctcttcagataccattgtccagaaacttgaagagggttgaggccctatcttatatattagagtacaatgtacacgagcaaacatacaacccctcaatactggagcttgccaagctagactttaaccttcttcaacatattcaccaaagggagctcaagacaattactcagtaatttttcggagcatgctctaaatatatcaaactcaatatctatgagccctaatataaatggaatttgacaatgactagaacttttttactatcacttacaacaacatacacatatcctttcttaatttcaggtggtgggaggatctttcaaatgacataggactagactacataagggatcgcattgttgaatgctacttttggtcatattctatgtactttgaggaggagtacacacgtgcccggatgatccttgccaagtttttcatgttaacatcattgttagatgacacttatgatacgcatgctactttggaggaatgtcgaaatctcaatgtggccatacaaaggttatactattatttttgattaactttcatctagagaacaaaacatgggtataatcaatgaggtgaaatttgactaactaattcgtgcaaaaaatgaccatgcagctgggatgagagtgatatttctgttctaccagattatctgaagaaattctttctcaaggtgatgagcaatttcgtggagttcgagaatgaattggaaccacatattaggcaccgcaatgcttacaataggaaagtggtatgacacctttttacgtttacctccgtttgtattattgattttacaaattaaatagcaagtatgttcatttccctaatattcatgtaaaattcgcactatagctaattgatcaagtaaacatgccatcatctttcatggtgctacgatatttttccttaaaaacatcaaccatattttattacatgtaacaggaacccaattttggaattaagttaaaagaaaggtcccccaaaaacaggcaaggaccactgatgtaactgaaaccaaagataaattaagtaacatcttctggcccaagtttttaacttggaatggtatgctggttccaaaaaactggcaaggaccccaccatttttggctcaccttcctattgcttatatttcgtgaactaatttataaacaaaattttagtttccctaaagcaaatcggtgataaaagttggaaccagtctccttttggtatttggacagttgtaatttttgaaaccctacatgcttcatggtgcttacatattactcctttgatccagttacaagtatatataattttggatattgacatggtgttccaaatgctatttttttaatcaatcactaatttatattatttgtaacaatttaagttataatattatggagtaattttcaaggaaactactaaagtatgtgatcaaactttcatgagtcaaaatgtaaatatttaaaaatccacggatacttcaaactttgaattaattgactaggtgtttgaaatgaaattactatttgtaactgaaaattaagacaatatttaacaaataggtggatggattggtgaaggactttaaaaagaaaaagagaggtgttgcggactgttggaatggatagtaaagacaataaagcaaaaacaatgtttgcctaaccacaatgtgagattaaatagacccgccacatataaagttgcttgaaaaagtagggcactgaaaaatacctcaaaaactgaatatccaccacaaaagatgactaacttattgaatatattgatttgtagagcatacaaataggtacaatctgccaaacaaaaaaggaaccaaggaaaaaaaattagtagaacgatatttgagataaatgacaatataacataacccaatggcacctccacatcttccattcgcctagctcttccacctctgccgcaacatttctcactagacccccaagattatgattaaacaaacaaacaaacgagcaatcaatcttaaccaattaattatatatgtgccggccgctcaaatctgtccttaagtccgcgcacaacacacacatttgcaatgtcctcgaattcccaatatctacacctcttcgagagagatgccgttgccttttcctttatacagcttctctccatcttctcaagtcaaatcgatcgcagtcagaatgtcagatgagctgagaaatcagagaagaagttggctcgctcgcttttccagtctggtcgtcggcggtctccgccgtcgaggcggcgtcgaccgagccgcgcttcccgggccagcctccccatccttcctggctcctgccgcttgccaccgtacgccggtgccgcctcggcctcgtgcgccccttttttttctttctttttttttccgtttcagataatttactccgctaagtagggctggatcggagtggcagtagcccatgggcctcttgggccatggcccagcaaggcagcaactcctcgtcatccagaaaaggaattagtctattgtggatccttcaagtcttgatcctccctcataccgagtataacgtctccccaatctttaaaaactagagccaatcagttccctcgaccgtttggatagcagtctcatcctatgtaatgctcatatgacctacttgtcagtgagaaaaaaaataaaaacaatatggtcttacatgtcaatcatcttggtctccccctttgctctttctcctctctaccccgtcccccatagagtcatcgtatcctattaaaaaaaaagtttgccgatccttgtaatgggactaaacgcacataaaacaaaaaatgaaacgctacctccgttaaggacatcgtcctataataccttgatttcttaaatcattactggataaaaatattaagatttaatatgtgaagatagcattgatagatctgtgatgagaaaaaaaatattttatatggttttttttaaatatattttagaaatattaaaaaatattaatgatgagacaactacattggagactatggcggcttagctattcctctattttcgttggcacgcttttcaaactgttaaacggtgtattttacgtgaaaacttatatatatgtatacatacatatatgtgtatatgtatatgtatatgtatatgtatatgtgtatatatatatatatatatatgtgtgtgtgtaagttgtttaaaaaaatctaataaatttattcatcaaatttttatatattaatacttaattaatcatatgctaatatcatttctcgttttacgtgcggctaattactgtttcaaacatctaaaaagaacacagccatatatatcaatgtttggacaagtaaagaacagaggtagtatcagcatgcacttactatgtgatacacacacacccctacctcatagatcttagcattgttctgttttctcctatgcagtttcaattgttatctgggtattatctccaggaggcagaatggttccatcataactacgtaccaagtttcaaagagcaaatagaagtgtcggtgatgtctgcaggtattcaagcactaagtgtatgtatacttgtcggcatgggaaatatagtaaccgaggagacacttgagtgggccattggcaacaatgatgccgttagggctggcggtgaggtggcacgtttcatggatgacatggctgcatttaaggtatgagtttaagctttgtaaatagaacttactcctctactgtattgcttttatagtaggagtcactgacatatagatcctagagcatgtcagatccatgtgtcaatatgtcgtattgcaacagcagtgctagagatcaggatctctcttgtaaatatcaaatctaactttaccatggtatattgatacacatgcacattgctaaatctgtcatttttcttcatagaatggaaggaacaaattggatgtagccagctccgtggagtgctacatcaaggagtacaatgttaccagtgaggttgccctagccaagataggttctttggtcgaagatgcatggaaaaccataaaccaagctcatattgatcgccgtgaactgttgccatttgtacatcgggtcaccaacctatcaaggagcatggctattttgtttcttgacaaaagagatgcatacacatacagtaaggatttcaaaaggacgatggagagccattttgtcaaacctattcccctttaggtaccgcacgtagaagtgtgaactactttaattattatgtattgggatattagttaaatatgacaataatgataattaagatgcctgttttgatcatatgagagattcattattgaacctctcaacttgcgttgatacatatgcagcactatgtattgtcatcatgtaggtccatgtacgtactagcgtgtaagcgtttggattgtgtatataacgagttatatcatgcgcttcgaaatcattcatcatatgtgcactatgattgattttcttttcttattacttccgcaaccatattcctaagttgggaagtcgatgcagtgggagtcactccacctaccaccagggttcaaatcctggtcccaacaaatatcacaggcatgcaaatatggtttaataaaattaagtggggtacgtaagagattcgccgttggtttccatctatttgaaccttgttaagagttgtatttgtgtgcagtttggtggcattaattccagcatatatatatgatacacactaattattccttgcggaaaagaatggggagcgcatgaactaaagttgatctcaccttcatcatagttgaaaatactagactggtgggtgacttggtcaacctctcggttcacctatccgactatctagccaatcgaaccgcaattcactaacgtagagataaattttatgttccaatacaatcacaaataacgcagtggtcggatggttatgggagtttacccctagctcaaccacctcgggttgactccccaccatgcccattttcaaaatcaagtgcttgtggacccacgagttagccgggcctttttctagcctatttaaagcagtgacatgtcttagtcctggcctgactgaagacggtttactactggttcacctaacaacccgccggtttgagcggtccaaagtgggtcaattgtgtgttcaatatttccatataactggaccatgctgacctcgaggagcagcaaaatgctaccgccaccgattagcagcaaggcgctgccgctgttgccaggagcttcctggtgattgacaaggggctcgacaaaattgatgagggatcgttcctagaagtatttgcattaaaatcctatggcatcaataaggtggtaagaaaggaatgttgaatacttacattcatgatcttgtcccaatcaacttgggctaggttgcacaaggggctggggatatcttcagcaatgctcagcttgttggccactgttggtaattcttaacctcacagataaaatctgcaagcgcacggaataaaacgatgtagcacttcacccgggagtattctcaggtatcgatttccacagggaatgtgtgtgtcagctcttcaccagtttcgtccaaggacacaaagctaaagataggctaaggatagagaggattcacctgtgagaaacagtgtctacggaaagcttaactttaatcctaacgcgatacttcgggcactggccagcctgttgctctgaaatatcgctctactacgcatccggactgggaggactttagtgatcttgagggctgtcaccacctcacacctactgtgggatgcagagcaaacactggaaatcaactacctagacaccgcgtctaagtagttaataacttactttaatgttagctacacactaaagcaatcactatattttaattgattataatgaacgatgatcctgtatgctaattaggaactaatcaagaagtaaatctcactaagcaaaactaaattactcaaaagatatttctataataatcagagtaattaacagagcaaaagaaataagaagtggattaccgacaactccggaactcctccaacttcttctactctactctctccctaatctagtatacaataaagtacaatagagcctcttataattcagctcaagcttggagtgtgtgttgaagtgagtgaagtgaagtcattatataggggcaggtataacggttgtaaaacacgaaaagtccattttgccatccaaccgtcattcatgagctcatccagactgtccctgccaaaccctacatcggacggttgcgggagtggttcggccgaacccaggcctggtccaacaggcccaggttttggcctgttgtctctcctcctcctcttctatccatttctgcgagtggaaggcccatttgatggtattttagtgtaattcttggcccgcttgtgatatggataggaattctccttcacttaagtctatagttcatccaacattggcggtttgtcacctgtattcaaatattcaccaatatttgtggaatatgtaagaatttaaccctttcactatgttggatgttttatttccttgatttatgcatgtattggcgatataaaattggcatttaatagccgtcaacagccaccaccttcttggtacagtctttcgaccgtgtcaaagtaggaagctcctctagcaggaaggcaaagtaccctgaccccctttggaagttcggccagggtgcaggtaccgaggttgtgtttggatcgcatgaaaggatgtagataaaagatatatacaggttcatgatgtttgaaagcacaataccctactattgtgttcttgctatatgcgatcaatattacaatgtgttattgggtggatgttgttctaagtgggagatgatgaacccttcttcactttcttgtgtctagaatctaacttagaccaactaaaccaaatttctgaattgaacccttttctctgtggaattggtcctccttttacatgccaaggggatactacagtgcccatgcaagtatacatatgtgggacccagcccacaggaagttggtatgcttagtcttctcattgtccctctaagaggaccggctggatgcaaagggtctacctactggttgatgcgtggagcagagtcacccaagccatcaccccagcagtcattgggcctgtatatcaaccacagaggaggagaaaagtgggcccttatagccaggtgagcatggagcacacgctgggtcacttactttttctccggggcgacatgggcaacgaggagagacatgcaccgccacatctcccacgccgcccgtgatctctccccaggaaccatatcacatggtaattaatgtggaataacggggcaaggttgtgcacatgataccgtaattaatgctgaatgacggggtcaggcagccggcaggactgagtcacatctacccaaagacaaactcgctcgtaacagacctcggggccctggcccacgtgcagtgaccgtggtggccctaagttgacgctagctcggccccgagaagcagttgtcctcgggtcaccttcttcggccaggggcactacttgggtccctgttttagttctcgctttgaccattgtgggctccacagttccccatgttgctgatggagtgggaacctccggtcctacttctctgacataccatgtccttgaaaatatctgcacattgaagttcagtttaggttttatatttcaactaatacaatgtagatatttgaagaggaaaaataaccgtactccgcaagatcatccaggttagctatgtactcgtgcacatggtgatcatgctcttataaaggatggttccgatgacgcatgaaatcgctgataacctcatgcgctatcagaatactcccttaactctcgagttatctcgataaagggatttggattccaatcgagtagaggaccacgttttctatcgggcaggcttggtggttgagaatttgaggtggcaagaactggtatcgatgaagaagtaaaaccaaccttttctctatcccttcctaggaataggtgaggtcattactatgtatgctttcttcaagccatcttggaccccgaacaccacagtgacatgtgatcaaggtaataaatagcgttcatagcgggtgctatagcagtagcggcctcctaccgctaccgctacgatgtagcagactggaaatagcatgttggaacttagcggccgctatttttacttagcgagccactatagcatgagcaaatttatataatcactaacctataacaaacggcgagtttgttagttattttgcctctcaaaatattgtattcttgtgagttgtaacttctaatgagtagaataccaggtttgttccttaatttagtgtaagttggaacaagagatcaacttttcgagtgctactaatcctcagatgttatagttatattgatctat

SEQ ID NO: 39349 - DNA, 959 bp, Oryza sativa
tatgtgacacattctagtaccatgaatcatcctgtctagattcgtagtacgctggtatttattacgagcacagaataatctgcaagctcacaggtaccgttgtagctttcacccaagagtattccagggtattgtatccacagggaacgtgtgtgtataatctaagaacatgattcttccaaggacaacgactaaatggtaggcttgggatagagaagattcttatgggttaaaattcttaaataagttatggtaaaactctatctattgattcaggcattggcttacccctggtctgccaaggagactccggcctatagctctatgatgctcccaaacgtgaaggattacaaaggacggacatggctgttaccacttgccgcctacctctacaacccatggagcacacaacaaacaaaggtaaccttcagcctagacatcgcatctatgctattgattactacgctaatctcgatgtcacgctagaagattaaggtactctacctaagcagagcgatgaacccataacaatgaaaatatatcttacttaaataagaaaagtaaataccaaaggtaatcaccaatacttatataaaagagacatccgtcaaggtacaaaatcagagaaagtgctgacatctccggcattcctccggaactcccatggaagaatgtcaatatctcctgcacgtctccggaacttcaccggagagaattccgatattaggggcactcctttcaaagcttccctcctctcttttcctatattataactctactagagagtagcccaaatgtataagtgagttgtactccacttgttatgtgttgagaatgaggagtagaagggatatttatagtgtgaagatgacttgagagagtagagatgctaagggaatattctcctccaactcctctcaagcctccacatcatagttattaagattggaccgataatt

SEQ ID NO: 39350 - DNA, 8806 bp, Oryza sativa
tggtgttgaacacttggtcacggggtcacaggttcaaatctcagcctccactcttttttcctcaatgttctattacgcacgagcatggctcacaagccccactccaattttttattactcacaagccccactccgcctgataggcctacatgggcagtcaccggcttatagccggcccaaaagatacagaaaactggccggtttgatcgagtgtttaccggtccaattgcgtaccgacattttggtttcggtttattccgatcagcccgctgtccggtccgattttaataactatcctccgcattcctccaaccatcattggatggaggtttcctaccttgagccttgcaccaccgactttaggacaacgatatctgtcgccacgtggaagctgagcgcaaggggagccaagctgcttctaccgaaccctggtcgagcccctcacgtcgccttttgcctgggacactgcctggtgggttctcatgatggtgcatggtggttggcttcaaatatgttgattttactttggtttgtgggccttccaatccgtgtactcgcatctgattggccagacatgtcaggtggttttcatccaaaattcacatgcatacaaatattcaccaagacttgcggaaatggttagtaataaccattatctctaagtttgatattccattttgtattctttcatttgcttttatgtaggaattgaaggtcgaatttggtacttaagaaccgtcaacatagtattaggatgcgtcccatctgctcagatttgtattactatgatgcatctaatgcagtactaagtagcaatattttgagacggagatagtatatggtggggctgtttgaatagaggcatgatcttcaaaacatattttgactatgtgttttattataacatatacaagacataaataaatatttattttttgttgtagcactttctaattttaatctatatatacattgctatattgttttcaagttattgataatcaaagctttaaaagtctactcaaaacaatatggaactgaagaggagagtactccattgctagtggctgatgtgcactgggcattttgagatggacggggatacctgtcgcttttcgtccaatgcatgattgctaatactactgttgagcaggaggccctgtattaattattgtacaaatgacgacaatcgaccctaaacttcttgatcaggaaggtatttgaatcttctgagattaaagataaagataaaggttaaagtgtttcacgcaaaacgaggtggtaataacgtgtgattaattgagttttaattattataaatttgaaaaataaattaatagaacaacttttatatataaagttttcgcacgaaacacattgtttagcagtctgaaaagcgtgccataaaaatcttcatcttcatgtaacttttgttggagaaacgaatgggacccatgtcgttatgtcggaccagtggctgagagtgcttcggtgttcaaagtttctgaagtttggtatgtgcagctctcagtttatcggctcggctgtttttcttgtgtatggtgtgcatgctttctaaacggttaaattgtgggtttcgtaaaaaggatataaaagttttctccacaaaacatcacttttcaggtatataatggttagtacttaattaattaattaatcatactctgtctcgttttgcataggactaattagctactgaatgcagcctaaaagagcgtggctcgtgtagaaattagattttgtgtgcccgtcttgtggtgttagcatatgtctagagagagaatcttgcaggcagataaatagggaaaggcaattttgtccatgggtctggatatccgcggatacccgacccaatgggcacgagcgtgggtgtgattttttatccgtgggcacgcccgcccgaaacccgtagacatcgtgggcaacaaccgggtttcattttttgcccgtgggtaacccatgcccgacccgatacatatgtattagctaatttcgacttatctcttaattcttatacccctttctcttggttcatttgtgatactaactaataataagttgtgatgtaattcaaattattgttgataactgataatttggtaaattattgattttacttctctttgttaaattatgtatttttgagttactattaatgtgagatccattgggtacccgccggtatatccgtgcccgtcgggcatgggtacagatacaaagttttgcccgctaaccctagtgggtagggtttggacgggcgacgacgggcatgggttcgggcatggttttgctctacccatgcccgacccgacccgttgccatccctacagataagggattgtaaaaaaagaaatccatttgtattttactattgttttactcaccataattttgtcccgttggaaaactcaacgaacatttacaatccttcatatataaattcaaacttttaggtaatctcaatatattatgccaaataggattgtgaccgtatatatattcatctacgagtatttgggataaaggatgaaattttcacttttcaagtttataaaggagttgtacttaatattttctttctataaaactaatattcactaaatacctgaagcttaacatgcaaacatagtatttattagcactcctaaaatcaacatgcaagcatggcatattaacacactaaacacacaaagctcaacattaagcatatagtaattatatctataatttatttcattctaaaactaaacatacacatgctaaatcatcattctcaaactattttcataatatttcaatctaagtcatttaatcatttctacaatttctaacatatatcccacagcaaagcgcagtgcatccactactacataatagctaatataagtcggcactataggtgccgaaagtaggtaaaacatgcattcatagtgcctttcccgcccacgctcccgtcagcttgctgctactgttgctgcttgctgctgctgctgctgcttatgtgaatgtgtgatggaaaacctatgtgaatatgtttggggaatatattgcctatgaatatgaatgtgaatgtgaatgtgaatgtggctctttcttggtgaatgtatgtgaattgtgtgatttggatgatgtggatgtgaaaattgaaatatgtaagtgaatgatgtttttgtgatgatgtggatgtgaatataaagcatattggaattgtatgtgtgatctgtatgtgaaattgacaggtactgctatttttttttacccaacatataggtgccgatttttcattacaaccagccaccttatgtgcttgccacgtgttcctttggtgctaaaaccaacacctatatggaaccggcacctttctcccctaataggtgccggttctaacatacaaaccggcatctattacacagatagatgccagttttgaaaccggcaccgatgaccaaagtcattgtgccacctccgtggtgccggttgggaaaaccggcacctaagggggtatcccaaccagcaccgattagggtttctgtagtcgtgatgatcatttagttagttatatacttatggcttatctcattttgcataggactaattagctaacactactagaaaaagcactttcgcagatgtaagggtttttttttccaggtgggtatgactttcggagccaaatggatgcctataaaaatataaaccggggtgaagctcgtcgtcctcctgcgaaaatcaatttttccagacggaccacttaagagatccgcctgcaaaaatacctttgttttcgctggcagacctcttaagtggtccgcatagaaaaatatgatttttgcaagcggaaccttatgtggtccgcctacaaaaataatgcctacagaaaaaaaatctaagtcctatcccatccttgtcttctcctccacaacttatcctgtccagcaccactcatttccctcacccttctctctcacttttctggctccctcccctccccttccttccttcccctcccagatctggcaaaggggaggggcatcggtggctgcgcaggcggagggggtcgtgggcagcggcgcaagcggagggcgtcagccgcgcaacgacgacagcgcctactgcacgcgacgatgatgactaccgccggccgcatcgctgccccttcccttccctgccctcccagatccggcagaggggaggggcattggtggtggcgctgtcggaggggaggtgcggctcccctccctcttctctccctcagctctactctcctccgccgccggccgcaacaatgactaccacaggacgacaacggccgccgcaggaagaggggagccggccgccggtggcggcggtcggaggaggagagccatcgaggggagggggaggatctaccacctgcaaaaatagcaaaaatagttgccgcctgtaaaaatgattgccgcaagtctttgcttgcaagcggaacgcctatccgtatgggaagacggatttggcccgcctacaaataccttttatctagtagtgtaaccaataagttctattgaatgcagcctaaaagagcgtggcttgtgtagaagctagattttgtgcccgtcttacattattactatatatctagagaatcttgccatttcacaccatggcttttaggctagctggttgcaagcagataagggattgtacacaaagaaattgttgatagtgaaatttggcacctgtttgattgtgcatgcactttaattagtagccatgggggtagctgcctatgagttttgcatgtagtgctcgtatttgtttgcatgcatgatcaggtcgtttggagggatcattgaatggatatgcacatgcactttgatagcagtctgtttaatggagattaattagcggcaacattaccttgggaggctcagagatgcgaatgaaaaactttgctgcttcatgcgacacaaatggaaagcatgctatatgcgaatcaaggctgagcaaggagatggaaaggtttggctgcacacaagggaaagtgaaacagactcgtcggctgatgaggattcaccgttcgagtgctatgaagttacggcatggcggcggcaaggatttccctacctcaatcgatataaattcattctacgttcttgtttcttctttttcttctttatggctaggagtatattagtctagttttatttgcaaatgaccagtcgctcgtcgtcgcaagagcgtgatggtcatctttttattaatttgtttatgatgaaccgtgtgttggtgcttttcgatgcgaacacaaatatactagtattgttggatcgaatagtaagaatcaagccaaccagagaggtgaatagttataaaaccccaaaaccaaaacttttagcggaattaaaatttacactcaattcgatgacgatcactagtagagaaatgatctttactatcggttaataaaccctcttagtattggttgtagcaaccgagataaggaaaccgagactaaagtttgtgacctttagtactaaatatgcatattaagtcaaaaaaaatatgtggcatattaaagtcaaaaaaatatgtgggatgttggatttgaactcaacatctctcaccttagcctattaaccatcccaccaactccacacatctaacttggatagagatgctttctttttgaactaaccccgaagacatctttagcaccagttggtaacaccaacgttattaaaaatatctttagtgatactaaccggtacttaaaaatacatttttaacaccggttggtaagaccaaccaggactaaacatattttggagacttgcacttttagaacaggtactaaaaagttattagtatcggttcttaatacatccagtacatttgtggtttggggtattggataaaagatgagttctctaatagtggatcggtctgactggagtagatgtgccgatctgaccgcttgaagaccttcggtctgaccgcccattacgtcgctatcgcctgtcgccgcctccggtctgaccgtcgtgtcccagccggtctgaccagtgcgatgccactgatctgtccgttggtgtcccgtcagatagaccgtcgaacccgagcaaacacaaatcaaagatctctcaaagtagattaaaactttattacctctctgtatctataaagtgcaacaatagcatttacaaaaatcttgaccaaactcgaaaccctaacttttctctaaactcaactctatctaaattgatactgggaggacataccctccctctctatttatatccatgataagtagcctaaagccacaaaccaatcttgtacacgaagtcataatcccctaggaaaccttcccatacaagaaacaaactttacaaactcaaatcgtaccaaatttggactctctccaaattcgactacgtatccagtatgcacacaatatatctatcgtatgccatatggaattctcaccaaccacgtgcactgttctttaggctaagcatcccgcatgatatcatgatcatatgttatcttctccaagttgtcggtggggtggaggaggcggacgacatgtcgccggagaaggaagaatggccggtgatgttcgccggcggggaggggaggttagagagcggaagcgagtgatcagtagtctgataccatgagagtgaatatgaatcaacacgataatcatattgatatgcggagatcagtacatataggcctcaaccttccatagcacactcaaccaatttatagaaacagtatcgagaggtttattgaagggagccaatcaaggtacatgccaaatatagtctaacattcctcaatctaccctctatctccaacatcccgggcagaatcaaaatcagacagtggcgataaaatcaaatcgaacggagatactactatgttggggccaaaatccagaggtagctagactgctagaggcagtgccgcagtggtaggctgaatcaggcagtggccagcgaagaaatcaaaatcgagcagagcggagaaattgatcgaatcggcagtggcaacaagattaaattccaacggtggtggcggaatcgaagttggcgttggcggcgacattattgagcagtttaacctaaaagcttaatctgatgagaaaagacggacaattcactttattttccaacactctccttcacgcgaggcctactcaagcttctagcgtggaatagaagtgggctgcaatatatcaatctatctatttatctatatctatatctatatctatattaatcggttactttttatgagcttccatgttaattagaaaaatctgatcgtcgattcaatggaggttaacatctcaaccgtagatcaaatcgatccatctccgcaaattcggccgtaagaccccgtaacgagagtaatatcgtggacgtagatcaaatcgatcttggtctccgcaaatcgggccatatgtaacgagaaagcatctttgctagcaaacggccgggagcgtccgcacttctcacgcatgcgggttcgcgcacgcgatccatcgatcgatcgatctggatacttgggtcctatttgggggagcttgtcccaactgcagtttttggaaaccctgtttgggggagcttgtcccagctgcagcttttggaaaaagctatcccaaacagttcacagcttctgagaatctatagttacatattctgaaaaatgaactaagaagccagaaactggagaagctgggtttgagtttttccagattctcagaaactgactatcaaacagctgcttctcagaatctaaaactcctcccaaacagtcagtgaaggtgaaatcacgtgctccggcggtcttcatctctctgcccccaccttgccagcggtggtatgcgggcgcgcggtccagtgcctcaacacgcctgcatccttctccgggctcaggacgacaaagctgaagcagcgcgtacgcgagagatcgacagcttaattcttctatgattaattattaagatccaatcaacatgcatgcaagagttttggttgtggacaaaatgtccactttatgttacattatttgtgagatttgtccgatatgttgcttttgcgatcagtgcaagagttggaatttgcgacagctaccaaacaatggtctgctgttctggatcggtgatccaatcgatccacggcatcaataatatacacacgtataacgatgtcagtggtggtgtcatgcagtgacaggtactgcaacaaatatgagctgtacaaccgactctctccgtccctaaatatttaacgccgttgactttttaaagatatatttgaccgttcgttttatttaaaacttctgtgaaatatgtaaaactatatatataaaaaagtatatttaacaatgaatcaaaagataggaaaagaattaaaaattatttaaattttttgaataagacgaacgactaaacatgtttaaaaatgtcaacggcgttaaatatttagttacggagggagtatataatttctcatttggataagggcctgcattacccacatgtattgccgtgcatacacacacacatcaagcttcgaatagttcccatcagataggaacggatcgacaaggggccttcatatggttgcgtcatgtactgattacttgatcaggctagctagaacaaggaaatcggagttgtccaattatagtagatcatttctcatagggataagaactaaactgatcgggcctgcttaagagtcagggtttactgtatactagttgtctacttcccattagataagaatcgatcaggccc

SEQ ID NO: 39351 - DNA, 1084 bp, Oryza sativa
tgaggttagcaacagcatgctgatttgtctaattatcagtttgaaatgccttgaaacagtattcaatttggtcggaggccttggagtgctaaactagtttcaatttaggtaaacatagtggttgataaaaccagtagcttttcatgtggaaactggaaacgttgctctaccaaaagttctaactttatctgtagtaccacatgttcaacgtattacacttttaggcccccttcggtttgtaggaaaaacataggaaatatggaggatttcgatcctattggaaaaaatcctaggaaggcatttgaaacaaaggattaaatcctatcttttcctttgaaattcctatggaatgtacaatcctatggagatttcggaggaaaattagcaagagctccaacctcttggaaaatttctttttgattctatctcactcatctgattcccgtgttttgcaatcttgtgactttcttattccttcgttttttcaatcccgtgttccaaaggaacccttattttgtactatattttttattcgtacttgagattatgctagatccaatatgacctgttgcactgttcatgcacgtaatgttgttcattccagccaatctaatgaatgccaattgtatttatgttccatgtttatttaatttaataatcatctgtcccttttaggtggaacagctgcataaaatttttaagctgtgcggctcccccacagaagaatattggaaaaagtccaagctacctcatgcaacaatatttaagcctcaacaaccatacaaaaggcgaatatcagagacttacaaagattttccacagtcagcactgcgattgattgaaacactgctcgcaattgatccagctgatcgtttaacagcgacttctgcattaagaagtgatgtaagttggctttggtgtcttacgacacagtttgaagttctgaaatctgcgattctgtgtttgcctcaaagtcattgccctctataagcacaatatttttagaaaatcttgggtgtaggtgatttacgttttcattgcaataacttagtttgcaattggggtttcagaacatggtgctttg

SEQ ID NO: 39352 - DNA, 1604 bp, Oryza sativa
taccagatattatcaatctaggctatagtagcactctataactgcaagtctgattttcgaattcaatagcatacatttggtttgaatgacatatctcactggataatgtgtgaagtagatctgtttattgtcatctttgttgaaattatgtagcattgttttacacttttactaaagaattgcttattacaatctatgcagttctttacaactgaaccttatgcatgtgaaccatcaagtctcccagcatatcctccaagcaaagaaatggatgcaaaacgaagagatgaagaagccagacggtttgtcaccttgatactcattagttttattatttgtttgttattcgctttggtccttggctgtctctctagtactggacactctgtggttgtagcactttctttttaaattggcatttgagaaatagcatctttaactttaaacatataactgttgcttatcaaatggcacattatttttctggggacctaggttggatacttgagtgcttgctcgggtttaatacctacgacaagaaaaaacatgtatttattctaatatttgggtatgcatatggaatagttcaataaactaaaaacaatttcactattttcgaaagaaacatttgtacaaagtgctgtcttcagataacagggccactctctctttcttttgttttttttataaaaagaatggaagccactctcttttgtcggattacaagaaaatgactaataagtgctaaaacagtaaagttcaccaaaagtttgttgatatttggtattaatatggatgtttttttttcccgtaagcaatattattagcatagaaatatatcctaaagagatggcacacaatgttcatgcagcaaagttatatataatcaaattatgaaagcattgcccaaatgtaattttagtgcaatgcaagtgctgatttaggtgaaactttaagtagacatactgctgtggtactaatgtccctggatttcacagaatttgtctgacacatgcctcatcgttgggctgatagtcagtctctcaccatctgggctcagctatttagaatttttgctcactaagtgatccaaatgcccacatatcctagtatatttgatgtttgattcatgttttctgtccatgctctcatgtgagttgagcgtgtatagaaatatttgattgctacctgacctattcatggcatgatcaacagtttgagagctgctggcggtaggactaatgatggagctaagaagacaaagacgcgcgatcgacctagggcagtaccggctccagaggcaaatgctgaacttcaaataaatatcgatgtatgtgaacatacttgctccctgactaattccagtagtgttttagtttttgtttctttgagctgttttacttaaagactaggctagcgatctaaatttaaggtggaggtggtgaaaccacttgcttagtctcatctccgtcgcagtaacactttatcaccactttattttcttgtcttacctatactggtctcatttgatttactatggcccaaaatggagcccggcactctcttaatgtaaattttgcaatgtctctaatgggctgcaggaa

SEQ ID NO: 39353 - DNA, 5400 bp, Oryza sativa
  unsure (1)..(5400): unsure at all n locations
gagctcagtagtttacctgtgtacattaggttctgtttttcaattcttatagccctggtgcatttggtgttagattcatttgagtggaagcttagatctctagcatttcaggacatccccttccattgtaacacctttcttcaattgcaacctgtgtaatcattcctcatcgatccaaagcaaatcttgtgttttgattggtctgttgcatggtgacctgaattttccagttgtactgcagcaaagatggtacacctttaatgcttataatcaatattatttctttcttttagaatgaatcattgctcttatttctcggggaaagtttattgttaatttgaacttgaattcacgtcaacctatacacaacatttttgatatgatagtttgaactatttcatttttatgagagagaggtgaactgtcaattacctgatagcatcgtagtagcatgcagaagcttttcaaaaatgaaacaaaaacgaaaatgcggactcccagtctactttcaataagaattttaagaatctagcaaggttagttatttgttgctgatcttcatctctttaagagcgcatatgctatacaccacattcacaatatcatagtgagcaggcgtgtcggcgtttgccttttttaaacatgtttgaccgttcgtcttattcaaaaacttctgttcgtcttattcaaaaacttctgtgaaatgtgtaaaactatatgtatacataaaaatatttttaacaataaatcaaatgatatgaaaataattaataattacttaaattttttgaataaaacaaacggtcaaacatttttaaaaaagtcaacggcgtcaaacattttgtgatggagggagtagtaaattacacaccacggtacactaacttgcgttgtgtggtgggtatagattggtataacaacttgcgaatcgtttaatccgatacaataacttgctgaattcatgcgaatcaagattcaggacaaatcgggtgtcacaatctaaatgaactgatatatcgctgacttggtttccatgcagcacaatttagtttcagcttgcttccatttgttttcatctgttctggtagcttttgcaaataatctcaaacttttttttggtgatgtttaatttctagttttgcattacataataattatcttatagcaacattatactggatggtatacatcctagtataatgaatcttgcacatgagtatgtccatatttgttgtactaggatatgtcccattcagtataaggttgctatattttaaaacggatggagtagtttttatgccacaaccaccacaagaatagacgcattcgagaaaagcaatatgcaatcgaactgtgtcacgtggaaactgacgtgaagtgaattttcactgtgagatttgaccccaattcgcactgacgaagcaagttgttttaccgggccaaacgatttgcatgttattgtaccgatttagggcctgttttgattccaacttttttcttcaaacttttaacttttccgtcacattgaacttttctacacacataaacttctaacttttccatcacatcgttttaatttcttcaaacttccaattttaacgtggaactaaacacagccttccaaccatcacacaagttcgtataccatagacacaatttataattaaaaaaaaatgcagaagagaagatgggccgatctgacctgaatcgggcacaaattcgcaagagccggtaggcccaggcccatctacaacaagaacaaagccctcttttccctacccccgaaaaaggaaaaacccgctccactcccccctccgctccgccgcaccacgccctacgacaccaaccaaaccctcctcctagccccccggcggcgatggccggcgtcggcggcagcagcagcggcggcggcgacgtggagatgggcgggtggtcggagctcctccactcctccactaagctcctcgagcaggccgcccccaccccgcacttccctcccctccaggtgcgccgccgctttcctctcccgttcctcccccccgcatctgcctcctcctcctccgccgccgccatagcttcttccgcctgacgtgttcccccgtgtgcttgtccccgcgcgcagaggaacctggaccagctggaggtgctctccaccaagctcaaggccaagacggtgcgcgccgaggcgcccgtgcagtcgctctccgccaccaggtcggtgtcttctccccggagccccccttcgatttgcctcggcgaggctcgcagcgcggttctccgcgtcgggttcgtcgggggtaggcggttgttgggggtttacgggggacttagggttttgggctttgctttctgcaggttgttggcgcgcgaggggatcaatgcggagcagctcgccagggacctcaaatccttcgaacttaaggtgatggccggcgagggatatcccatttcatagagtgatattatactaatctcatttgctgattatcagatcgagcagtttgtccggtttgagattagacattttactgtactgctggttaaaacctagggttatcacaaagtagggttaaaacgtaataaaattataacaagtcataagcattgccatgttttattccttgcaccaaattgttgaaaaacatcctttacaatttcaaatgaagaagtgaagatgatagtttggtgtttgttaccaatacatcatgtcttcttaaattggaagagcagtttaacttactagtaaatagtttagttcagtagttttgacgaaatgtttagttagtatctgtgagctagctttggtgaaatagttacccatgaactatgttgaaacaagaaacgactctagagttcgaggtgcagcaagatctcgttggtcctatactttcaattatactgctccagattagcgttcaattttctacttaaattgtagaagaaacttaacatacagttatctacttgagtaagaaattgatagctcatatttctatgctttatctatgcaatgttctctttgtgtatttaaatgcagctaatataacgatagcatgtattcattataataatagtgtaagaatcagtcctttcctattgggtaaatgctactattttttgcttggatcagcgggctcttgatataaaaaacttgaccggaaatcattactcaataacagcgcacgatttttcgcacttcaccttatatatccaccataactttactgttcactatgtatgccccatgtcccattctctaaaattcactcctaattcatcagtataccttaatacatttacaactctgttgctgtatgtgaatctgcagcttcttattgtatattttctgttttctactctatcttgctagactacttgaatatacatcatagtgattaaaattgaggttttgtagaccacatttgaggatgtttttccatctgaagcaactactgtcgaggagtacctgcagcaggtgcacacttcataccgtcatacatcttttacatgcattttctcctaatttcatggaatatatcctgaaacatgtcatgtgttttcagcttcatgaaatggcaatcgtctcatccattcaagaagcacaaaaggacaacttaaggagttttaacaattatatgatgcaagttctcgaggttgtttaccctttcctgctgctaacttcattacatatatatatatatatatatatatatatatatatatatatatatatatatatatatatatatatactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaatttttttttttaaattctccatgattagttacgctctttgaaattatatttgaatttttcagagcttaattgttaattttattaatacaaacgtcatttaacaattatttacttggaaaaagaaagaaaatacttccttttaggtttgcttcgaaataaacacattcaataacttataattgtaatgcttctgaaaaaatgagcactaaaaatgaacttattctctttttttgggcctgagggacctaaaatagacttatttccggcccttgccggtcggtccacggccttttgtgcacgcgcaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcggcggcgccctcccccacaaccaacggcgcggcgccctctccccgaacaacggcggcgtggaggcggctgcggcccggcgggagcgggaggggcggcgggccggacctcgcctccgccagatctggcggcatggaagcggctgtggtccggcgagggcaggagaggcggcggcgtcgtctctttctctctctctctgtgcatggtggggaggtgcggcagtggtggtggtggcggacgtcatggaacgctggttgggcctcgcctccgccagatccggcggtgtggaggcagctgcagcccggcgggggtgggaggggcggcgggccggacctcgcctccgccagattcggcggcatggaggcggctgcggtccgacgggggcgggagaggtggcggcgtcgtctctttctctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtngtngtatatatatatatatatatatatatatatatatatatatgatctggtttagttgttgcaagcctgtgggaagtgcttttcagattgcactttcttatatcatcttggtatatgttaaaagtttctcggcaaatttctgtatcatctgggggtttgtaatgttattacctatatgtattattgcattgcacattagaaaacaaaatcagttgtcataggg

SEQ ID NO: 39354 - DNA, 20835 bp, Oryza sativa
  unsure (1)..(20835): unsure at all n locations
gctcagtggtgaatgtttcaaattattttacggtttggttctcaacttatataacatctatgttgtaggatgattggcagaaggagaagcgagacttcttgcagagtctaagccgactctctacattaccgaaaagaaacactaatctcatggccagtgggatttctcgtcctgctctgatgccatcttcagcttccagtccccaatcttcgtccggtctgccatctaaggaagtcatgcccatacctaacaaaactataattgaaaacaaatcttcagtttatgctgcagttgtgagagatcttaatgatgctagagggcgcagcctaccttttggtgtaagtgttaaactcatatgctatgattcaacatgttacttagtccctctatggacatttattcatttatagattgaatttgtggtttttgctatccatagttctattctccaaataatttaatttgagaaatagatcaagtgcctttttttttatgtagcctcgacatgttatcatcagagcataagcaaattctattgatgtacttgtagttctgctaatgcttattaaagttatcttttggttagcctgctacagcattcagggctgcttatgagtctttatctgttggtgctattgggacaaaatcagtgaccatgcataaagtgtggcatttaattcaggtaataaaattgatttttgtgtagcactcatgctgacatctgttggcccttttccatccaatatatatgatatatccttatctattattccctcatagctatactttgcttcttgtttgtcttattcaggcattagttggggaagggtcaactcatcgaaacatttcaagaaaaatgtcactagtgattggtgctagacgacaccttgagtggggtcatgaaaagtacatacttgagaccatcaatagccatccggctctagtgagtattttcacatactttttagttctgacatttctttcaaaattccttatgaaaatagaatataacatgtaagattctgacaataattttggtgttgatccaactgaactcttgagagttactacacctgttttcttatgttgcctatgggtattccactcttttgtgtcatgtcaccttagttcatatttttgagcattaattttctttcttgaatgtcctgaaggtgaattgtgatgtgatatgtgctttctaccaattgtgcatatttatggaagataatatttaatgttagtgagcaactcagaatagttcattattttttgattttttaacacatggttgtgatcttccattagtcttttagcaaatgatgttccctactctcactttactatgtggcttatgttttaggaaacctactcatgcaagagcttttctgttgtatcaatagatcttaattaagctgtgattgtgctttatggttgtaggctgctcttggtggatctgttggcaatcttcagaagattcgcgcatttcttcgggtatgttttaaatttgatgcttctctcccttttcattgtttctgtacatcattttattttcaagtgaaatgatgctgtacaatttgggttctacatgagcttcatgcatctttgtccttatgactggcaggtccgtttgcgggatcatggtgtgctagactttgatgcaactgatctgcgtagacagccaccagtggacacaacatggcaacaggttccctttttagttttgggtatttaacacaaaattgcaattggtgccatttcaatctgtctagtaatggcatattaaaatcatgaaaaaacaattggttacattcaaataaaaccgtgccaccaaaatacagtaagtgcagcaactgaagaatactggagcttttatgagaacatcgtgttgaatatagtgcaacactggggccatgagtgtttttattattcattatttttcaactctagcttaggcttttcatggtatcattcctatgctaggtcaattcggcttattctatgacttactttattcaagtgtaggctataatactctaaagtaaagccatatctgatgcataaaaagttttctgtgggtacatgtgctttattctaatttatcaacaaatatttctcagttgcgccttcatggaatgttctctctctttgattttcatgtaacttgttaatcttgtactgctaacattgaagtattattgtttgacatttttttagatttatttctgcttgagaaccggatactatgatgaggcaagacaagttgcccaatcatctcgtgctgcattcaactttgctcccctggtaaactattgacatgtcataaattgcgatgagttcttgttcttgataccatacatgcaaataatatgttctttgcagcttgtagaatggattactactaatggtgctgtatccccagagactgctctgacagcttctgaggaatgtgacaaaatgctgagaatgggtgatcgacctggccgtcctggttatgataggaagaagttgctcctttatgccatgatctgtggttgtcgacgtcaaatcgacagattgcttaaagatctgccaacacttttcaatactatagaggatttcttgtggttcaaattgtcagctctgcgggagtacaccagtgcatcttcttctaatgtttcaaatgaaggcttggtgccttatactctggaggatctgcaaagttacttaaacaaatttgaaccatcatattatacaaagaatggaaaagaccccttggtctatccatatgttctgctgttaagcatccaattgcttccagcaattctttatttgtctaaagaagttggagaggaaggataccatgtagatgctgtgcatatttcaattgctttatctgatcatggtgttctccctgatgagtgttgggtcacagcccagaagatgggttcatggatgcttgtgcaaagctgccagtataatacggcagtatggctctatttatttgcgtaatggtaaccttgatttggccttggagtattatgcacagtctgctgctgcaatgggtggaggagaggtatcatggattggtcgagggaatgctgatcagcagcggcagcgaaatctaatgttgaagcaactgctgacagagatattactaagggatggtggcattcaacttttgcttggtccaagtggaatgggggaagaaggagaattaaagaagtatatgatggattggagaagcaggcagcaattcttacttgaagctgcccatcagtgtcatgaggcaggcctctatgacaaagtaagtaaacaagtaaatgctcttttcttgtgatagtagtagtaaaaactcgtcttgattgtcacatgtaggacatatcacacatgcttcatcaaatctgatatatgtgcgtgcattttaaccgttgactataattttataaactattgatggcaagctacatggtacagaagtagatatttaccatatgaatttgaagatgtctatgttttctgcactttggtcttactctctttgttgagttgttctatatccgtctaatatcactttacgctctgcatgagctcagtcagtggaaattcataaaagagttggagcttttgccatggcacttcagacaataaataagtgcctgtcggatgcaatatgtgccatggcacgcagtatgttagatggtgaaagtcgtgctgctgctctaattcattctggtaatgaaattatggaaactgccagatattcggaagccaggttattatcctcttctgttttttcacaagttgagcattaatcctttatgctttttaaagctgtgttttgatcaatttattggaaacgttcttacagtgttcaagacaaggacctcatatctgagcaacaaactgtactgagacagcttgaagctattctccatatctataggcttgctcgagctggacagactttagatgctttgagggaaaccatcaaactcccatttcttcatttggatcctcaggctccaaatgtgacagttgatgtgttcagaaacttgtcaccgcatgttcaagcttgtgtgccagatctcttgaaggttgctctaaattgtatggacaatgttagagatactgatgggaccttgcgtgcagtcaagtcaaaggtattcaatctcttttgcgcatttacttatacaatgagcatgtaggcactgcacttcataatggcagagaaaatgtgatgctaaactaccatagataagtaaactataaataatttgaagaacctgtttagtaacacatccacataccttaactagcaggttataccactcgcaagcattctcttgtgtgtgcacacagacagttacgtacctgatggctgattgcagttgggcagtcttatgctgatacatgtctttagctgttgtagttgtaaagattgctgtcacggccgtaaaccttgcggcccagcctgtgggcccaagaagcacttaaaatattctatagagagcttgcacaagaaagttttccaacaatgtccaatcttagtgtaaaatctggtcatatcatgacgcactacgctgctaaatgctagctatctgccacatatacacatccttctggagactttcattgtcaaatggcaagcttgaccacgtccattaaccttgtttttaatacatttttatttcaaataagttatctggatgaccgcagaggagggcaccatgctgtgttatcacgttttagacatgcattaatttaatttcttttagttagcattattctgatattatctcgctataatataaaatgcaaccccctgcatttttttcatgcaatatttttcatgatgggcagatcgcaaacctcgtggcaagcaacatgagcaggaactggccacaggatttgtatcagaaggtggcgcagtgcatatgatggggatctgtccggccatatacctgacactatcaaaagcttccgaaagcacgcggaaatgcttttctgtgtttgtgctggtgatgtgcttatggtccgaaccggaatgtttcagactggtggatgcaaatccttttgatcactcagctatatcagccaaaagagaacatatatgccatgcccgggggtcatctgatgtgtagtgtgtgaaatgtgaaacttaatggcaccaatcagaatctgtattattaatccatggttgtaaagcagtttctgaatatccaaatgcactgttgcttagttcgaggagattatctgcggctctattgtactgtcattctgttggcttatcccacttaatcccgcgtcctatctcggatctaacagcgtcattttcgaatgttctatttttgcacgtactactttctcaggatcgacaagcctaagcatgatgcaacatggaattactccatacagtattgaaagaagatgctggaagatcatcttggagtattatcgcttatacacatgattcgctaactggagattgggcggaacatcacggcagtgagtgattgaatgcattatgctgactcctctcatcctcgtgaataatttactcctgcccccatcctctctggcctcccagatgtgaccccctgatgagaagaaaaaaagtccgtttataatttccagtagaagcagcaaaaaaaaatcagggaaggtgccggttcgaccagccatcgacctaattttgttttgatcgattgatttatcgacctaattttgttcggtcaaatgcttaagcagagaagcgcgatggttgctgcagcctgcaggtcgagtgtcaggtgaagaagctccaggggaaccgcacaaacactctcctggaagcaaattttatggagatggctcgctaaacggtaggactcctttcgaatacatgaaatttaaaaatttatagaaggaataaatcaatttctgtggatttgtttctaaaaatttcacccattacaagaaagataagataatgtagcgtgtctgcagacctttagaggtcatcgagtcctaccgttcagtcatttcgtttacaattgattataaggcctaacatttattattaaaaaataatattttggtataaaacttctgtatatatatttttaatgatttaaaagctaatgccataaaataaacaacgatgaaaataaactgataagatcggttagtttgtcatgggttgatgcgtggatcgtgggaatgaactgccggaggaagcaaggaatcgtcatcttgaatacagttggtgcggagcggagcgggcagcatgtcactttgatctacctgcacgccacctcctcaatccaaccttgctggtatatactacaattcttgaaagctctgagaggaagaaatgcaaaggccattgcatcttgataagttttaaaaaagtacactttcaaaagatagctccgaatttcccaagcagaagatgttgaaaaaaaagaagagttgtaaacaaaacagtgctggcatttaaggctcctcctaggcgaccaccaagaacctcaaagagagagaagttatttatttttactccaaacagatgcaacatctgaagacaacttttggactgtttggaaaaacaattgcagcttctttcagaatcacgaactcttccaaataacttacaacatcatcttttcgcttatgcttatacttattagtcaaaattaaaattttcaacattaattttaaagctgatttttggttttttcatcgaaatttatttttcagtatttgcttttagataactaagaacacgtatataaaagttttattcacaaattactttccgtttacaaatatactgttttgctactataggaccatcagattatagaaagtgtagtagtagaatttaaagatatgagttaaaagccataagctaaaaaactcttaacgtttttagattctcataaatttggttactaaacatctcaatcaggactttcctttttacagtagagaatccgtgtgtctgacaggacagtggcgacccaatccccaatctccattttcttgagatttggatcagctgcagtagtagtactgactgcaacttatgcagtcatagttgctaccgtttgatctgaatcggatggcacaggttagtcagagcactatagcaaaagtaccgtagaataaaatattagttttatgattctattttgatcactgtagcgataaatctggaccattcatcatcaaaatgaatggttgaagatacgtgcagtcctaagttacagtggaagttaccactgcagctgatctcaatccattttcttgccattctcggcagcccttccttccaagcccccaccacacacacacacactcgcgagcacagctcgctcctcactagtataaaatagtagtcgtccccttcttggcgcgccgccgcagcaacagcggcgcgcgaggctgctcggatctcgccgcggccatcgaaccgatggagctcgacgacgcgtctcgccacggattcggcaggatgggatttgggtaaattcctctgctctgcacttctcctcctcctccttgccgctgctgttcttggacaagaaaagctttcgtgttctttcttcgttttgtttttgagctcatcgagtcgttggcgcgcgcgcagatgcaagcactacaggaggaggtgcaggatccgggcgccgtgctgcaacgacgtcttccactgccgccattgccacaacgagtccacggtttcgtctcccccgcgtgcttgcttgcattgcatcaccaatcctgaattttatttttattttttctgctcctgcctttctgatgtgccgctccctgttcttggatcagaaagacggccacgagctcgatcggcacgcggttgaatcggtgggtgctcctatatcacatcaattcgatcctgtttcttgatctgaaaaaaactgaaaaaacttatcttggggtatctgctcttcaggttatctgtctcgtctgtgacaccgaacagccggttagtgttgaatccactgggctttcctttccgtttcttggatcaatttttgtttctgaccggtgattttttttttgagcaggttgcgcaagtgtgctacaactgcggcgtttgcatgggcgagtacttctgcagcgcgtgcaaattcttcgacgacgacgtgagatgccgatgctgcttgctttgcttctgctggatctggtgattttcgatttggttgttgatgagatgcacgttcgtgttctgcaggttgacagggaacacttccactgccaagattgcggcatctgcaggtatgtttttaccacaccatctaaaaaaatcacttaaaaagtgggaatgcatttcaaattttctgagctgactgaatttgggatgcattgcaaatttgcaatagagttggagggaaggataacttcttccactgcgaaaaatgtggtgagtcagtgtgatcctacatctctcgatactcggtactgaaatcccaagctattactatttactggtgagatggttgaatctgaatctctcaattccacttttaaatatctgttgaaacacaggatcatgctactcggtcagcctgcgcgacaagcactgctgcatcgagaactccatgaagaacaactgccccatctgttacgaggtgtgtgttctaatgtnnnnnnnnnnnnnnnnnnnnnnnncgctaccttctgcatactgttcatttaaaaaaaatgcagtctcttatgtacgaaactgtcgatcgtcatcacaaatgcagtatctgtttgactctctaagggagacgtccgtgctcagatgtgggcacacgatgcacctgcaatgcttccacgagatgctgaagcacgacaagtaatcgcccatgctgtgttgatctgtttccatgtggctctttctttctttgtttgtttctttactttgtgtgctagattagtcatctctttcgtgtgatcttgttcttcttggatgcctgataattgtaggttctcttgtcccatatgctcgatgcctatctttgacatggacaagttcttgagggctttggacgctgaggtatgtattaaatttcttagtgagcttgcttaacacaatagcattatacaactagacttcatctttcaatttatttaatagacctgttgtaggttcagaaatagtgaatataaaataaaccaaaatacaaatcatatgcaaaggaactaaaaaaccggaccagatattggctcatcatttcaattacattttggaaaggtttcaaacttgcagagttgcagtagtctcaccaatctaaagccttagtgataattaatttgtaggaatactgccataatatgttcattttttaacctctgcagattgaagcaaatatgctgcacatagattacatgggaaaggtaagcttgcctccatccaagaactctcaccctgtgccatttgacagtataaaatactacatacactttgacgctaatgttgctgattggtgttggtttgcagggatggatcgtgtgcaacgactgcagggacacgacgcaggtgtacgcgagggtggcagggcacaagtgctgccattgccagtctcacaacacctgcagggtggctgccccggtgctccctgcttaattaaattgagtaaatttcatataaaattcagctgcagatgctgtcagcaccgcagcatcatattattgatttatacttagtattcagtagtattggctgggttattttaagtagccaattaagtgtattttcagtccaacatgaactgcatgggtcacatcttgtatgcgaattatacacgttttatgtaacaaagcaaggtgaatttgaaaggcgaagaaacagttagggatgtgcccaatttttgttggtctgcagagtgcagatccaagctaaaaacactaaaggacacctggcatttctgttctttttctgggcctgaaaaagggtacgtattgcctttgtgcctgttcaggcctcattcggccacaggcggcctgttgaccataccatcccaccccaagaggccaaggcgatggattagagaggtgggagtgggctaagcccatggatacttattagccaattctactttaaataaatatagattaatttctatttcatagtaaattcgtaaaactacgtataaatcaaactgtcgtaaaactatagatttaaagcgggtatctcacagaactagagatttagtattgagcttatcatgaaactatgtaaagcataataccgcaatctatagatttagtgctattttagtgcaaaagtacaacgtttataattctaacataatagtagtcctaggagctaaaatctatatttagaatttcactactaaatctgtaggtttgccattatctaaaaaaatatatgtaggtttgcggtaaatttggtactaaaccgatagcttttacgatagattgtctaaattcgtagttttgcaaatttggtcaaaatgtcacaagtgagtgtgccttgcacacgtcttaaccagattagagacataacatagccataagtaacgtaaatatggaaagagattctctaacttattgccctctgactttaaggggttgacatgcgagccccatagctcaaggacccacatgctagtgacccatgtcagagaagccctcttccgataagtatatacgctttatcaaacacacccttacgagtatgtactattaatataatgttgtgcaacaagttaaaaaaaaagcatgagtagccatgctcagtttacaaccacaatttatttttagaggtaagtgggtttactgcagctaggggcggatgtacatgtgaagtttgttcactttaacaccacttttaaccatagcaaattttggtgttctcaaattttaatagggtaacaaactaaacactaccttttactaacattatcctatcaaatcgtggtagctctggaacttttctctcatagaaatactaccgaattttggaaagaaatcaaactaaataaatccagcgctatcaaaatttgacaacgtaaaaacgtatcaaaatttggtattgctaaaattagtaagattgaaattggcagcgaagtgaataaatccaaagtttaggtgatgttcacttgacataggggaaattttgaaatctcataagtattagatcaaattaaacattatattatacctatgattatttgtaagcgtagacacatcatatatttcgttctagatttatccttgcatgccatgtagatgttggtaggtaggagttggaaggagaaaagcaagagacacaaatggcctacaacaaaacgaagaccgggtttagctcccaaatttttttttccaaaaacatcatattgaatctttaaacacatgcatgaatcattaaatatagataaaaataaaagctaattgcataatttgcatggaaatacgagatgaatcttttgagcctaattaatccatgattagctataaatgcaacagtaacccaatggcttaattaggctcaaaagattcgcggttttcagacgagttatgaaattaattattttactcacggttttcagacgagttataaaattaattattttattcttgtcaaaaaccctttctgacatccgctcaaacattattttcttttagcgaagccgaaacgtggtcgttgttgcgccataacagcagccttgtttagattttaactttttttttttcaaacttccaatttttccgtcacatcaaacttttctacccacaaacttacaactttttcatcatattgatccaatttgttcgaacttttaattttggcgtgaatctaaacacagccgcggcaaccgtagtagtctagtactagtactactccgtactccgtagcctcttctcgcctcatctcgtgctgcgcgtctgacgacctcgccctaccaacctgccaatttcttccttccttccatccgtcctgcaacctcctcctctgcttctcgatttctcctcctccactccatcgtctctctctctctctctctctctgcagctaactcctccgaattaggaggttcatcttgatgtaattgactggattcaataaaatttttcattatcttgaaaaagaaagtagcggaggtgcaacgttggcatatggagaagcggaggcggccggcggcggcggcgatgcttctggtgctcatccctgctgcatcgcgcccaccccatgggatcgtagcagcaacaggtaaagctcatctctgcctcagccttatcacttgctgctagcgcggcagctgatggattgattatttgatttctttctgttcttttttgttttctttgatgcaattttgtttttttatgcaactgatttctcttcatcgatttaatttcaatttgagaaggggggaaaaatgaggcgaattttatatctcaatgtgctcatgcaaggtttgcttgtactgtagtagtagatttaatcactagtagtgtggctgtttctggaagacagtgatgttgactgttattgttgactattgtttctggctttctgcaagacgattaataatgttgactattgtttacttcctccgtttgacgatgtaagtaaatctaacatttctcacatctgtctagattcattagcatcaatatgaatgtaggaaatgctaaaatgacttacattgtgaaacggatagggtatatgaaatcaataactattgtacctggaagcaaaaaaaaaaaggatattttgcacgcgtgagttgaacttgaaccttcaaatgtatagcaaagtacagggcctttgtatctcaattctttcatctaatggcatgaagaaggaatggtaccctagcaggaacattgctttcatcacccagacaatctaaggaatacacaaatgcaacactaaagtttacttatgttctaattcttgtctgatagcatttattcttgatgagtatgaatgtatgatgtgtaactgagatttgcacatatcagcatccctgttcttttcgataagatatctatcagcatgcctaaaggctagatgttccaatctccacagaatccagtgtccagaatagtgagcagagctttggtttcaaccttacacttgccaagactattgtggagtatgcctcagctgtaagttatcatcaccttattctttccaaattgtgtcatgtgtcatatacaaatacaatactcaatgcaccactcccccaccccccaattttttttttggtgtaattcaagagtaaattgtatcttgcagtgaatagagtcaacccctttttagtttattctttttttttctcgacatgaagttaccctcaattatttcctctcgtatttggcagtgtgcatccaccttaggatgcagaggccaggcgttacccattatctaaaaaaatgatttcctctcgtatatataggtctatatgacagatctaacagagctctatacatggacatgctcaaaatgcaatgacttaatccaagtaagatacccaacactttggtgcctaattagtttcattttgatcacgattaaaattgattttgtcatgggcgcttgttttccgaaaacaggggttcgagatgagacgtctaatcgttgatgtccagaactgcttgcaggtctatatctaaatgctaatactgttttacaatacagttctcatcaatcctatttaaataaaatgctactacatgacattaaacaatatgacaggcatttgttggtgtcgatcacaatctcaacgctatcattgtttcaatcaggggaactcaagagaacaggttctgaaataactctacacaattttcttgttcttagtggcttctacgggagttatgatatccctctgtattcatgcctaaattttctgctcagtgtacagaattggattaaggatatgctatggaagcaatctgatctgaactacccggacatgcccgacgcaaaggtttttgccactgacctgttaatgtaattatacttttttgctgaagaataggacatgagtttttttttctttgggtctgatgagatttctactctggttaaaggttcacactggattttactcttcttacaataacacacttttacgtccagccatcgcaaacgccgttcacaaggcgaggaagttatatggagatattagcataatagttacagggcattcaatgggaggagcgcttgcttctttctgtgcacttgatcttgcggtaagtgctactgaaattcaaccaaatacttgctgaatttaagcatcagttaaaggaaatagggagaaatatcaccacaatcacaatgaacaggccaaaacaatccgaactgaacaaattcagaaagcttgattgtaatgtagtttcactaacgttgcatgtttgcaagggaattgctaaaaaacagtcacaagtttttttaagtatgatgttataattaagaagataccttgtttcgacagtagatattctttcaccgctgattcattaaactctgaaatgctttctacatttgcagattacccatggaggcaacaatgtttacctgatgacttttgggcagccgcgcgttggcaacgctgcatttgcatcctactttaccaaatatgtgcccaatacaattcgagtgacacatgagcatgacattgtgccgcatttgcccccatattttttcatttttccagaccaaacataccatcacttcccaacagaggtatgctagctcttgcataaaaacaggaaatttgctactccctctgtttcacaatgtaagtcattctagcattttccacatctatctatctattatatactaaaagtccattaaacttcctacaaacgctctcaagttaccacatggcgctctaataaattagagaaaatcctgtaaattctaagaaaaaagcaaaacatctaccccttgattttcacttaaattggtgggtccaatattatacaccgttagataaaattgattctaaaataaaccaaatactatgggtcccacctaactcacgtacgtacatgggtatgcagtacgtacgcctccttccaattattttggtatgtagtatgtacgcctccctccaattatttcttcctttttctctcttcttttttccatttatataattgatatatatatattctaaataaacataatttacaaacaaagaatataccatcatataattctttataaacacagttaactaaattagctctacaatctttgaaaataaaatttacaccattatatgtttacccattaaatcaatataatttccaattaaaccggtgtactcattaatttgtactattattttcaaataatacactattttaaaataaactttacacaattataatgtgtacttatcaaataaataatttaagatctatattaactaattatacgtgcacttaaacagatggacccattatttaaatcatgggatctttttttttattaatttggactattattctcaaataatatactattttaaaataaattctacaccatcatattgtgtacccattaaattaacaatttaaaatatatattaactaatttacatttacactagaaccggtggacccattatttaaatcaacatatctattgttaataactaaagtgtccaaagttctctttttggtccgctgcacaatgcacatctacacctttgcctttcgcacgtgtgacaaagcatcgtgtctgaggcatcttaggtgatcacgatcgctgcaacgctaccgcttttgttaataaaaaatcttaagccaccacatatatatcaactgttaaagatttttagaatgagaaaacaacgagttctcacctacattatttagaaacattagaaaaacaatgtcccctccacctccctctccaatcacatgtgcataacactgttacactgccaacccatctctggctcgagttgtatgctattcattcctctccaatctcctccctattttcagcataatattaacacatattaatataattcgtactaggataagagtaataagggagttttaaggccttattttttttattgattccatcttttgcattttcgtttgcacgctccacgcttttccaagtttataaatggtgcttttcttaaacgactttttaactatttagaagttaattcatttgtttataatctcaaatagctatcacataaatcagataattcatcaatttcagttttcctaaaccctaagtagtacatatttttttcgtgcgaatcatggtgatcaacgaataatcaaagtggtaacatgaatcttaagagctactatgaacaattgcaaatatgtgtcaaaattatttgctattaattagacatctaatggtttgctagcaacatatttaatttctctctacatgtatataaacatggacaaagctagaatgaatattaacatatatcccatacatatatattacatgttaatattctcattacatgtggtaagtccattaaaatttcaaataccctcaagctaccacttggtgctctaataaattagagaacatattagaaattctaagaaaaaaagcaaattatctattacttgattttcacttaaatcggtgggttcaatattataaaccattagattaaattgatcttagaagaaactaaatactacaaggtcccacctctccaccttcgatacgcacctacgtacgcgtgggtacctatgcttcccctcccttttatcatttttccctttcttcttttcttcatatatacgcttccctctctttcttactatatcatgcgccttcatgagacgatttaatcacaagaattttgagtatcttgctctcacatttataattggtttttatactacaagcaatatatagttcattatttactcgagaaaataacatgtttcaaaagtcgtaagtacttaatccatctcctacttaaaaatttgtgaatggatttttaagatactttaagaaaaatagaaaccttaaattattataaaattacattatccgatctttagttttcccttaatctatgagacaaaatctttaaacaaataataaaaatcttacctttcaataatataagtgcccgcgcatacgcgcgggccaccttcctagttatattaatgttaatgaatctagacatatatatctagctagattcattaacatcaatatgaatatgggaaatgttagaatgacttatattgtgaaacggaggaagtactactaaactgcagtcacaacgtttgtgcttaattttttcttcacattgaactagattacaatgcaagtagttttctgcaaaacagtattttttctttccatcttggcatcatgaaatgtttaaactaatttgccagcctattttatctgcttgaagaatgaaaaaatgctaccactcgtggttgtataaattaaatatataatttaaactgtaacggttttcttgctagatagcagaaaccaaacgccccctctgaactctgatatatcatacatcatcgtttcaccacccaaacaatgttctcacttacgcatatatatcacctatacatacgcactaactgaaatttcaggtctgggaacatgaagtcgatggcagcacagtctaccaagtctgcgacggcagcggcgaagtatccagactgctccaggtgatcatctgatctgacgactgactgatcgtcgctcgttcatcctttggcatctcaatccagcgcagtgcttcagaataatggcttaatttgttgtgcctagctgtgctgtactagtagagatcctgaagaacattttgcgtgtatatccattgattccaggagcgtgctggtgctgttctggagcgcgtcagaccacctgacataccttggagggacatggaggccgatactggagcacctgcaggatcgtcctgggcaggagcgccgccgagacgctcctgctgcagcacgcacggcaactcgccggcggcgacgacgagagcggcggcgtcaatgtcgtcgtcagagatcacggtgtgcaggttgttggttcggagatagcagttgcggctaggtagccgtaccgtatgtacttgtgcaacttgaaagtgcgttttgtgaacacaactcactgatggtatctctatatatatagttttggctgtaaatttttagatattgctttcttctgtaatgctggtatagattaattgatattgaagtacacaacaattcaaggctagttgtttctcttctctatctctgtctctatctttactctctactattataaaaattgaagatgtttttgccacaatctttggtacgtctctccgctgcccccgcttccggtgcctgccattgccaccgtggaatagtgccgaagtgtagcaagaggattgtggccaagctcgcgctcgctgtgctgagtgatacaacctcatgcacgcagctctttcctttggatcacgccatggccctatcttcactcttctctagctcctcgtctcaggtgcaagccggagtgtagtgggaccccctaacccaccctccctcttgtgataggagtatttttctttcttagtagcttatcttccttgtatttgtttttttttccttgaccccctgtcaacggttttctgaccgtgtgcattgtgtaatcaaactctgctatcttcttctaatatattgacgtgcaatttttttgcacattcgcgaaaaaacatcgttccttcgtatgattcgggttcgggctttcgttcgcctcctttgccccttcgtctaagcgggagcgcgttgtctgatctgagtctaaggtgcaatcagagtgagtccagaaaggccaccgtgggaggtctcagacagattgcaaatgattgaaatgctgatatcggataacggtagtccatggtgaacaagtccttctcaatctttccaaactggaggaatcaccttgtcctgctcctggttagttggtccattttcatcagacgacaccagctgaaagtttttcacagaggcaagagtagcccgtggccgtccacggaagttgaggcaccatcattgcagttgctcatgccacctaggagatttattcttcggaaccagcttttcttccttctgagtagataattgtaaagttgcactatctctatacgaggtgattttgatctgaagaatgaaatcgatgggaaagagtcgaggccactaagaggaaatcagtctgtgttggagcttttccaccctcttgaacagctgatgcggggatggaatccataatgcagctcatccttcttggacctctgcaataagcatgcatcgcaaaaatcactgcaattttctacaaagtactgtagaagcagttaaatctagcatgcaatgtcaatcaacaatgaaaaggctcaaggagttgtgatgttatcaccactttttataattggagccttttttttagaaaatagattcagcatgtctaattgatcgcattaatcaccactgtgatttttacactatcgatgaattcacatattcagatctcaggtgttgatgacaatatttaccaaaactatccatagatttactcggcataacacaagtgctgattcaataccttgcacccaaaacattcagttcgtagggaacatgtgaaactgggtaattcccggcaggaactctcggggatacttggttcagaccaaccacacgtgcagaccaacattttgggtccatctatatatatggcgccacaaattttagtccaaaacagtcggattggactacatactgattaccgccatttcaaacacaaagttgaccattaatgagccttggcaatataacaaataagtaactttattataatacacaatataaattaaatttacgatagaaaactaacaatcacaaaagttacacttaaataaatttaaaatcacatacataattttaatgtattttcactgtaagttccaaaattacatatgtaattttaatgtattttcactgtaagttccaaaataacatatttaagtgcccttaaaattacatatgtaattttaatatattttcactgcaagttttaaaattacatatgtaagtcccaaaattacatatgtatttaatatgtaattacaatgtaagtggcatataattgcataaattatcactatagtgtaattttcattaattatgatttactttgaggacataacgaatagaatctttgtgctcagttggtcaaaagcctggtgttgtaagcctgtaactcgtcgatcacgggatcgactccccgccaccgcaccgcaccttcatttttctcggaaagcattagcacgaatcttgatacagatcctagggtctaaaaatcgactatttttttacagaaattggcgtgcgagtgaaactgtccctcccgcacacgttttcttttttttctttttgccttttttttgtgttttcttcttttttttttcatctttttcgcattttttttggctccccctcctctcatgcgttttcccttttttcccttttttccccatttttttaatcgttcgcacaagtgttttcaaaatatttgagttgaatgttttcaaattttaactttgaaagtttttcaatctgaagaaagtttcaaatctagagttgaaagttttaaaatccgagttgaaagttttcaaaatttgtcttacaaatttaaattttgagttgaaagtttttaaaatttgacttgaaattttaaatcttgagtcgaaagttttcatatttaacttgaaagtttaaatttcgagttgaattttttttaacaaaatgagtttagagtttcaaattttgagatgaaagttttaaatttta

SEQ ID NO: 39355 - DNA, 7346 bp, Oryza sativa
gccgaaggtctaaccggcgccgttaacgccctccggccagtcggcgaggcgggcggcggcgtggtgggacggtggcggcggggggatcgggcggataatagtgatgggatgggtggcggctgaatacgcgcgacgtgagggaaaagggaggagagctagggttaatgcctctttatgaatcttaaagcacatccaacggtctaaaatttaaaagatgggaggtgagattttctgtccacagatgtattggtaaaaagtcgaaactaataggagtatgaattatgatgcatggttttgttatctgtccaattaaatgatcgaatcatgcttgctgctgatccatcaatgtgcctgatgttttatatgcatctctgtaggctactgcaatttctgatatgatgttcagaatcgtctactaccaattgaatttgcatgcaacctatgctacgtagttcagttgattctttcttcagtgtcaaatttatgcatgaagttctatacttctgtttattatgaattgcaataaacctgtcaggaattgttgctgccatgttggtttctttcttgtttgtaactcaggtaaggattttctggtccggggcgatgcaattctcaactgtgcatgataactgattgccgccccttgcatgtgcttgtatgcttccagtttcaggacatgtatggctgtatgttgggtgaccatgaagttacaggcaggtatttctcccaaaaagaaaaaaaaaactatagccaaggtacttgttataaaatggcagaatcccaattgcaaatctcttgctaaataggagtactatttgtgctacattgcaatacctaacctttcaggtaggagcatactctgtcgctgatgccttaaaaactctctcatctactgaatttatagtagaacatacagagttagaaagtacatattagaaaaacacctcaatacgaatcgtgattatatttcggggtactgatagaagttcagaaatttctgatctgagaaaaaaaaaagaaatttgaacaatgtattgttatttttttccttaattcgtttagctaaaataatttcatatcatggaacaaatttcctgaaatttcaaaccaaaacattaaaccctgccttgttttgccaaaaatatatcaatgtattgactggcaattttttgattaagtgtgctcatcttagttatatacgcattgttaatattattaagtacatttctgttgttggagcagtggtaactatgatttttatccgaacccgtattatacattttaggtagttgtccatagtcaggttggcaacagtactacttaaaaagaagataaggatgcaagagtgatggagcaccctacaactgaagagataaggatgcaagagtttgtggtgctatagtctacgaccattgatgcatcaaagatttgaccatcaaaccgaagggcccattgcattcagcggtgtaaagtaaaaaagaatacacacatgcttgtctttccttgtgtctattttttactactatttacatgtgattggttcacctacatgtttagtatcatcagttatgatccatccgagcagctaagaaaaaaataggttacataaccaccgacattgtacatgctatttgtttgcacctattcctctcttgaacatcgataggataaaaattttggaattatgacaattttggtctacattaatttaaaatgttaaacaaaatttggtcacaactaaataaattttgctaaattcaatttttattgaaatgttctaaaataattgagagaaatagtttcatgttgaaaggggttgataaaatccgaagcttcgatggtttatattttgttggctggtgggaatcaaccatacatacagtttaggatacgtggaaatgcaaaatggtttgaatttgtaagttatccaataagtgaagattatgtttcctctttcttaaaataaactataatcatcgttataacattagtttttttcccattacaatgcacgggcaacttttatcttatcttatcttatcttacctacttaaaaaattggaattttccaatcgccacaatctgagatttcttcccccggccggcacaaaaatttcgtccaatgcgtctgattccgcatccttagacgcgccctcctcggatgatacgttgttggagctgccgccgattctattgccgatgagagatcgtgcactgttgccaaatgctacccacacgatggcacacatttgatttcgtcttcgatctcctcctctctcttgtagcggcggtggcggcgtcggtggcctccgtctctgatgacgagttgctgatccggcaggtcaggctgtggcgctgtgccgtgtccaccgtccacccacagcgtcgccacgcgctaggcgctgtctctcacctcaacagcctagagagaggcgattgaccactgcctctacgccttgtacaaggaggatgacgactcccaatgctgactgctggcaaggtcggttcggtgatcagttttttacttcatcggttcttccagcatatggccatcctacaaacaaacacatctagatcaggctgaatttatctcatcatcaatattgtttctctgaatttttctgcacgctgatgaaatctttgttttgtgttttccgttttgatgtctgaatctgatccaattgtctcatcagttttgctatataaaagttagtcgatagtggaacgacgactaatcttctcgacttcagtcattgatcccaaaatataccagatgacgacacataaacaatcgtaacaatgaaatagaacaattctaattttatttattgtaaaataaatttaatttaattttatacatcatacatgttatatatttactttgaatactactccctctgttctaaaatttaatggttttttttagtttttcgctgtgattaaggaaacaagaaaattattactggatgattactataattgttgagatgaggaagtcaccaaaaaaaataaatgagagatgactgtaattggttgagataagattttaggtagagaaattgctatattttaaaataaatcattagaagatgctatattttgaaatgaatgaagtatataaatccatgtttccaaaaatattttaaaatgaaggaagtatataattccctggtatttctacaaaatttagaaacagaaaatgcatgcggcatttctagatgtggtaagagttatggcatatcttgtgctaaggttatcttgacgtcatgcatccaaagtatagttcataagggcaaaaattgctgaattattgacattattatattctcactgatgcacagctgcataatgacatctttatcttcttctgttcgtcttgaggtcttgtgtccactcatcatcattatggacgatgaccttgcatgctgaggtgcgtttatcatgctgatgctgttctgcaaccacgtgtaacactattaaaaaaccattttgcagacggtgacatttttttccagacgcgtaggccttttggagctatatggccgcctacaaaaatgacaaccgtgagacgagatcattgtctgcatgtgaaaattgaataccattacttttacaggcggacctcgatttttacaggcgagacattatatgtccgccaacaaaaaagttcataagttacaaaaatcgcaacctaccccattaccaagtctccaccattattccttccctccctcgcctcacccgatctcccccattctcatgcgtgttgtccttccccctcccctccctccctccagatccgatcggaggaggggagggtggcggtggtgcgacgtggaggtggtgcagaggcggttccccctctctctagctggatgagggggagcgacagtggtggcgcagacgcggcgacggtgacgacggtggaggaagcgacagtggcggctactccctccttccccgctcctagatccggccggacgaaggggagtgacggtggcggcgtgcaatggtggcgacgtagaggcgactcccctcccgagcgacggcggcggcacggagcgacggtggcggtgcggaggcagcacccctcccctccctatcctagatccagccagagcaaggagcggggatggtggtggcggtggcagagacctccccttgtagatccggccggaggaaggggagcgatggcagaggcggcacagaggtggtcggcggagacctccctccctcctgaatccggtggagggaagggtggtggtgggggccaccgcatgcaacaacagcggccggagggccctcccctccctcattttcctctctatcccagatccctccggagggggggagggcaatagccagatgagttcggttgtaaggttggaggtggggtagttgcaacaggggagggggttttatgggtttggagggattcctatgacggcatcgtcattgaagctaagccacatgggttgaacaacggggacaaagtggagctagtggtgagaaagtggtagcgtagtaagatgatggaacggggccacgtcacccccgttggattgaggagcaggagagagggacctcgtaggcgttgacaagatcagggggaacgagtgcaatggcggtggtgtgggaggctggctactggaatgcatcgatctgagcgagtagagggagaaggaggaggacaggatatggttgaggcacagtagctctatgaatctcacaatgatccgggccgtccaaaatgtgattgagatgagagtgggttcttccatcaaatgggtatgtgtagtcctttagagatcatgatttacgtgcacacacgattaattagggccttttcttattcagatattcacaaaggatttaaaagtcccatgtcaacccaaaatttcctgtttgcattttactattgttgctcaacaaattaacatctatatatagttttcatacttctaaactatcttactattgtcaagcaggacagtaactccgtatactcttctatttagggatatccatagcatgcaattttgcagtaaacagtatagaagctctgcaaccccaaagttttgcccgcatgaagcgccttaattcttgcctgctcacccccaccttgttgacattaattgacagatattggggcttacagttgtggcaaatggtgagtaaatagctcgacttcagctgtataatgtggtatttttccttcagaaaagctaggagaagcacctgtcagcaatcattctgtttctcttcagtctttataaaccaaatatatatgtatgtcgtgatctaggccaaaagcgagatgaaaagatagcttgtatcttttgtgggggcaaggtagaaataaccacacattgaccaatcaattactctcagggattaattagtggttggcaatatatattcatatgaaagggacttattttatttataaaaatggaaacctttgagtttgtaaaaacaaaagaagaatcccataaagaagaagaagaagaaaacaaacgaagagagagaaagaggatcagattctcgtggccgagtttgctccgtagtccacattggaatcaaaggtgtgcattctcatgtctagcatgatagtgagacagctgacactaatgtttttagaagaatattcaactagatcatgtggcttgtgtagaagcattattagttaatttatctttccgagcagatgtctagcgaataatcttgctgtttggcagcacattttaacggaattcagggtgccaagttggttgaatgcaaaagcaaataaatgtctgaggcaaatgagtaaattatatataactactaggcgaggtctaatagtatttctcttaaaaataataattctaagacataggggtagtatcaccgttttgatattttctttaggtttatacacacacaattaattaatgccttttgttaaaagttcctttacaagttaattgtggtattaaaaaggattaattatggcgggaaccagaaaatatgcaagcctagagagaaattagtctatcaaatatgatagtattggcatatattcttctatttgcagcatgcaatttcataccactagtaaacaatcgtctgtctaaattcgtagtactagaatattctaatctggattctaaattgctatattttaagaatgaaatgaatatataaagttaaacggaaattttacccacatgaagcaccttcttacctacacacctagttattaccccactttcttgacattgactgtcaacaagaattaggagaggtccacagatgggggcaaatggagaggtccacagatggcggcggctttacgaggaggaaggctggcagcggcttgatgagatggaggagcggcagcggcggctcgacaaggaggaggaggggcgatgatggctagacgaggaggaggagtggtggcggcagctcgacgaggaggaggagggacaacggtggcttgacgaggagtggtggcttgacgaagaggagcagtggcgatggcttgacgatgaggaggaggaggggcaacagtgttagggtggatccggcggaggctcggctacggatctagtggcaccgaggcacgcacgcagcggtggcgggacttagtggggagacggtggtgcttcggtgagggagggagcactggcggcggcggctcacagaggaagggagcatcggtgcacagtgaagcgacaatggcttgtggagggtgagagcagcggagccggagggtggagggagtggcggcggctgctgctccgcacggatgggctcgggagttcgccatcggcgacgtggtgtcctgctgcttgacatgtttttttttgtttttggtggacataaatttgtgccatgaaattgtgtttgaggcagtttaatatatactaattgcacataactatattgaataaaaaactttgagaaactaggttaaattcacaagggtataaatgaaatttttgtcttgagttaacaccgtcatgttgccttcacataatagggtcaagccccatcttcgtttctaaaaaaagagagtcaaatgagcaaactcgaaaaatcaggaccaaatcagtggttagtcttcaaagtagggtaaaaaacgcaatcgccctatcatataaagtcacccgattatctccaactagggcttttctaaaagagacatcaagtagtacgcttgtgaacatattggccaacacgacatttttcttgctagcaagattatacaacgaggtaaataacttatcaaaagaaatgtctccaaaacctcaaaattgagttccattatgaatcacaaaagatccatgtgagagaaagagacg

SEQ ID NO: 39356 - DNA, 4174 bp, Oryza sativa
atatttatattaattatatatagccattctatattaaaaaatatagtaatgatatatgccgtgcaaatggagacttatcaagagaatccatgttggttttgatatatttaactgattttaaatttgagcatattatttacattattttcaaatcatgttattttaaatcatattttgtagtattgttgggatcgtagaatcgggatacacctaagatttcgtaggatcgtgtagtaatgaatagtaggatcgagatactatgaaaattaggatactatgtgggatcagtatcgtttcggcttggtaggatcgtagtatcgtaagatactaggatacgaatcgggatactgacaaccttgcttctaatgttccttattttttaattccgaatttcaactatttctaaattgtatttctatatggactctagtctccttttctaatattccttattttttaatttcgaatttctgctatttctaaattgtatttctatatggactctgttttttcttttttcccgattaatgtgaaaatttctaggccatgtgagcgaatgtggaggctcctttttctattcctttaataatataatagatattcaactagatcatatggcttgtgtagaagcattattagttaatttatctttccgagcagatgtctagcgaataatcttgctgtttggcagcacattttaacggaatttagggtgccaagttggttgcatgcaaagcaaataaatgtctgaggcaaatgagtaaattaaatataactactaggcaggtctaatagtatttctcttaaaaataataattctaagacataggggtagtatcaccgttttgatattttctttaggtttatatacacacacaattaattaatgccttttgttaaaagttcctttacaagttaattgtggtattaaaaaggattaattatggcaggaaccagaaaatatgtaagcctagagagaaattagtctatcaaatatgatagtattggcatatattcttctatttgcagcatgcaatttcataccactagtaaacaatcgtctgtctaaactaaattcatagtactagaatattctaatctggattctaaattgctatattttaataatgaaatgaatatataaagttaaacgaaaattttacccacatgaagcaccttcttacctacacacccagttattaccccactttcttgacattgactgtcaacaagaattgggagaggtccacagatgggggcaaatggagaggtccacagatggcggtgactcgacgaggaggaaggctggcagcggctcgatgaggtggaggagcgcagcggcggctcaacaaggaggaggaggggcgacgatggctagacaaggaggaggagtggtggcggcagctcgacgaggaggaggaggggcaacgacggcttgacgaggaggagtggtggcttgacgaagaggagcagtggcgatggcttgacgatgacgaggaggaggggcggcagcgttagggtggatccggcggaggctcggcgacggatctagtggcaccgaggcacgcacgcggcggtggcgggacttagtggggagacggtggtgcttcggtgagggagggagcactggcggcggcggctcacagagaaagggagcatcagtgcacagtgaagcgacaatggctcgtggagggtgagagcagtggaaccggagggtggagggagtggtggtggctgctgctccgcacggatgggctcgggagtttgccgtcggcgacgtggtgtcctgctgcttgacatgttttttttctttttctttttctttttgtttttggtggacataaatttgtgccatgaaattttgtttgattcagtttaatatatactaattgcacaaaactgaataaaaaactttgagaaactaggttaaattcacaagggtataaatgaaatttttgtcttgagttaacaccgtcatgttgccttcacagaatagggtcaagccccattttcgtttctaaaaaagagagtcaaatgaccaaatcagtggttagtcttcaaagtagggtaaaaaacgcaattgccctatcatataaagtcacccgattatctccaattagggcttttctaaaggagacatcaagtagtacgtttgtgaacacattggccaacacgacatttttcttgctagcaagattattcaacgaggtaaataacttatcaaaagaaatgtctcccaaaacctcaaaattgagttccattatgaatcacaaaagatccatgtgagagaaagagacgatcgacatggatgatccctccaagcagaggcgttggcatagtacagagaacaaatcggagggaaggacgagacaacatggtgaggggttgagaactatacatgcttacgattgtggcaaatggtgagtaaataaattgatttcagctctacaatgtggtattttttcttcacaaaagccagattctacttctcatcggtcttcacaaaccaatgtagtgacacgtgccaaaagcgagatgaaaagatagcttgtgtcttttgctgggggaaggcagaactgaaccatgctatacaccatacattgacctatcaatcactttcggacattgtttggataataggattggaaaatgatttcccacccatcaaaaggtatctttaaatcctaaccattcattctccctcttccatttaatcctaactcttcattcatttcccaatcccaatcccactctccatttcccattatccaaacacaccctcggagactaattagtagttggcaatacatatttatttgtaaaagatggaaacctttgtactatgaaagtttgacgtgttaaaacaaaggtggttagctgattcttttaattgttattgtaagccatatttagatctgtaagaaaaaaaaagatacaactaaagattaagtttgagtaatacacttgacatccaaatacatacagttttgttctaagaagaatccaataaaaaagaagaagaaaacaaacgaagagaaataaagaggatcagattctcgtggccgagtttgctccgtagtccacattggaatcaaaggtgtgcattctcatgtctagcatgagagtgagacagctgacactaatgtttttacaagaactagcatgatggcccgcgcagattgtgcggctagcatcattatattttatctcatataatagcatgtatattttctcattatattattcaaatatattaaaatgacatcataattttaaattttgcaataactttatgaaactacaaatgtgtaatattcatattgtattttatatacgtgttagttattaattatttttaatatcaaattttagttatttgtaaattatatatatttctatatggactctagactcgtcttttaatatttctttttcttaattcagaattttctgtaaattgtatttctatatatactctaggctcttcttccaatattatttatttttatttctaaatttttattatttctaattgtatttctatgtggactctaaactcatctatcaatattctttaatttttaatttcgaatttcagttacttctaaattgtattcctatattgactttaaactcttattcccatgtttttcttaatttcgaattttagttatttgtaaattgtatttttatacggactcaaaactctacttttaattttattatgtttattctgaattttagttagttttaaattcctatatggattctatactctacttctaatattccttatattttaattccgaatttctattttttttcttaattgtatttctgtatgaactctatactctacttctaatattccgtatttttaattccgaatttatattatctcctaattgtatttctatatggactctatactctacttctaatattccttatttttaattccgaatttcagatatttcctaattgtatttctatatagactctagtcacctcttctaatcaaggttgtcaggatcaggatactaggtagtatcgttttgctcaaagtaatatcgtatcataggatcgtatcgtagtatcgggatactgtgagattttctttttttaagtttaatttatatttatattggttatatatagcccttctatattaaaa

SEQ ID NO: 39357 - DNA, 935 bp, Oryza sativa
acaaatcacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgcgacatgtctatctcctcggcgtctggtgcgacgtagtcctcatcctcctcgtcctcgtcgtcatcgtcgtcactaggtggagccggcgccttcccctttcccctcccttgcggaatgcgtgacgacgacgagccaccaactccttcacgctcttctattctgatggagtgtcgagcggtacttggacgcgcggattgaggtagtggtggtggtagtctccgcggttggtacacgtcgtctaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacagtgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaaaaaaatttacgactctgtctctaagtggggcgtgctccatttgatatccaactctagtccggacatcatagggattccgcccctcatcggagtcgcggtcatcctctatgtcggcttccgtccaagtagggcggaggaacaatctatatgtcctatgcagctaatgaaggtactctgagaaaagatga

SEQ ID NO: 39358 - DNA, 2315 bp, Oryza sativa
ctgcagccctcgcatgacatggtgcggaagatggtactcaactgcccagaaacaaatcaatgggcactggtacatgaattagtcagagtcttgattgcacatcgagttcagggtcaggcttgaagtctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttgtatgccacatcccggtgagcatgtgcagtggcagtactctcaaaaaggtaggccactctcttctccatgtctggctcattgtagggccaaggagtgaagctttgcctccacttaggccttccaaccggtaatcttaaccacatccacagctgaatcaatagcacacaaccactcatgttggatgatagtgcctgacgacaacaggcctcacagagttgtccatatgtccatgccaacactgctgagccccaactgaaacggcccagatcaccaaggttgggcgaccaaaggaatccatatcgccgaagcaatgtcacccccagcattaggaaacagaacccctcccaacaagtgcaagatgtatgcacgagcataacactcaacacgccatggctcagcatcgtcgtcaagatgtgagaagttctaactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatagtcatctcaccactggggaggtggaagctatgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggggggcatgagctctaactcggagcggttgaagtacctgcattagcaattgtaaatcaattagttaatataatgtcaaatacacgctaccgatacttatgtacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttatttacctccctaacacttatattttttttggacttcttcttttttggacgcttaggacacttagttttcttgtgaccctcctggtgacacaacgagcatctattttgcaccggcgcagcatcaagttgaatgcatgaaggtggtttccttccagaaccacccagacccgagtccatttcgttcttgaatcgtttcgatctcctcttccctatttttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattcctcatcaattgcatgaattagataaacgtggataagatgtgagcaaggcatatggtagagcaatggcctttggcaagaacatgagttcacctcaccttcaactttgaaagctcttgcgccaaatctaacaccaccacgcgttataccacccctctctgtgacctcgtatgtctttttctgcttatcgaaacaccttgcagtgtgtttgttcaccttacttttttgcaccttcatcttactatcaaccttggtggaccaacgctgccctacctggactcgcttcaaagcttcatcatgtctgttcacaaagtagtcattgcacttcatgaacgtaaatgatactatggccgtcactggaagcttacgaacaccaactagcacgctattgaactgttcggccatgttggttgtcatgtaaccccaccggcggccatttctatcgtatgcacgggaccaattatctttatccaacaactcatcttcaagccatttacgaggaccttcgggaatacgctgccttagtgcctcaacgcatccctctcaaatatccacttctcgtcaatctgacatatccttaggagctcttttgtctgatgcttgtccgcaccggccttgtggaaattagcattgaagtgcctcatg

SEQ ID NO: 39359 - DNA, 1534 bp, Oryza sativa
gcatcagctgataatgcagtcatcaaggcaccaccgtatttcccagttaggaaggttgcatctatagctagtactggcctacaatgcttaaaagcctcaatggaaggaccaaagcaccagaatacacgcataaaaattttcttggtcactccatcaacgttgacaaccctatcaagatgagtatcgatgtggtagaccatactgggattcctctgcttaatggcttgcagcaaagtgggcaaacggacatacgcttcaccccattcaccgtaaatgagcttcatagcctcctcttgtgccctccaagccttgccatacttcaccctatactggaaaacctcaaatatatacaaagctaacgcagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcaatgcgaccatggataggaactctaaaccctttctgagaccatccacctggaatggttctggcaactgatttaagttgatgccgccatctagtagtgcaccatgggcatgtgttaggtctctaaactcaggaatgtctggcttcctcccaaacaccttctcaaacgcatgacattcctctaatgctaacttgtcattattagtaagtggagggaatggacggtcatcatcagagtcttcagcaaattcaacatcatattgctcaacacttgcctcctcatcaacatcatctctattgacttctactgagacagaatcgtgaccaccactcaattcgacatcaaagtaatcatctggattcacatattggcctgctacttctgtcgggtattcagggttgcctccatacgacgaccaatgaacactcgccgacaaatgttcacttagatcaagcctctcttgtactaactcccttttcatctccctcactgcatccacatcatcagtaccgcaatgtctctttgatggtcctgtctcccataaatcatttccaagcaaaggtctcttcttctctccttccccctccaagtcttcttgtaccaactcagtcttacttgcaccccctccacgacgagaataatatgtcacaaaattcttctcaacgtaatgataagaaggagatttgtttagatccaaattttctacagtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacatatcctcggtccatccaagaacttcttt

SEQ ID NO: 39360 - DNA, 2207 bp, Oryza sativa
atcaaattaaaattactttcatacctcaaccataatttttcatccatccatccatccaaaccatccaaaaatcaacattaccacatatatggttaaaaaaatcgtgacaccaatgagtacattgcaaacatgtagcactacaacaaaccaatcctaagaacaaatgctaaaaatcacaaattcgggtaaaaaaggggttctagggttacccaccgatctacaaattcaaccaataaaaacaaaaaaaaagaggggtgaatgaaggagtctacctttctcttcgatttccacaaaaaaatcccgcgaaaaacgagttcaaatggagtggatttgaggtggggaggtgagagggagagagagggggagagctgctgctgctcagctcgggttggtgcttgggcgaaaatgggagtggggaggagataggtggtagggcccacggggtttaaggggtcggcccacagaggaggggcgcgccagccatgctggcgccgtggtatgaggggcggcgccagtgtggctggcgcccccattctgcccagtcagcacctccacgacagccctagtgccacggtggcacgggcacggcgccagtgtggctggcgccgccatgttggggtacggcgccagccactctggcgtcccaaaaaggaccatttccggtttaagttttttcaggggtctatttgtaaaataagttttcaaaaaggaccaaaatataaaaatttcagtgattttgctctgctacacaaaagatgcacacgtggttgactgatgctcattaatctgttcatctgccagaacattaaaagttcgaaagaattaatagtcgcataaataaagattacgatattaacccacacagtcgatcagcaatctcatgcttggaccaatcacataggcaatgatcgaggatttttgagccttcgagggaagagatttttcgtcgtgtttgataaggattttaccaaatgttcgtacttgtagccctgcagggagtacaagctaatgagctatagtagcaagtacaagtgcgtgttcgtcgtcgcggatgccctccggctttggaccggagttttgctgggtcgtcagccgacatgacgatgatgagttcaagtttaatatggagtactaagcctaaatcaattataaagttattcggagaatagaacttgaaaaattaaaatgattagctttcatataaaagctaactctctacgtatatatactcatttaaaagtctctagtggtggtgatagtaaatctggcactccaccacggtttatagtttttacaaatttaccaatgatattttctaatattatgaaacaatctaaatatttagttaaaacacgtgaataccatatattcaaaaatgcaaacaggtgatactccctcttttctatcgaatcggtcataaccactgcctacattccacaaaatagtgcaccacaagtaagcactaatgaataggcctgcgattccgtagaaagacatcacgaccccctgtagaaaaaaaagaatttgttgagatggaagtacagatataatattcttaccaagataactgaaagccccaaccactaagaatcctattgaacctagaaaaagaatacaggcccagaaaaaattacctcttacacaataattcttttgtctattacatattataatatattttattttgtccaaagcaaaggttgagtattttgctactatatttcaagataaatgcattaaatatgtatagctcatctactgtacatattaactctaatgtggatctatataattagctctactattacacttgctctaatgccccccccccccccaccaccaatcgtattaaactgttaactacgacagttgactatattaagagaagactttccaacactattacagaagctgttgcggtctctttacagggagaaagaagaggagagacctacggatcggacgtccgatcaggagaaaaaaatcggacgctcgtcccagccatcggatcgagggattaaatctcgaccattgatagcgcgtcgtcactgttcgatgcaaacttctcccgggcagctgcatgcatgcaacttttcccgcgcacagaattgcatatgtgacagggatagttaatgtcccgcgcacaaaagggcttcgattgtgggaagagggcagcgccagccaccgtggcgccagtgcctgggggg

SEQ ID NO: 39361 - DNA, 3653 bp, Oryza sativa
ttacaccaagtataacggaattgtttcactaagtagatcgaaaatgttttagtcgtttaaatcgggcgttgtttcaccttatataaaaacaatgtttcagtaaatagcgaaagaatgtttcagttcaccacaacattagatctatacatagtgaaatattgtgagtacactaggtgaaacattttatgtgaaacaacaaataaaacgaattcccttaatagagtatttccaaaatatgtggttgatttgttgcaacgttgtgcgtggtggggacacgtggcaggagcgacgcagtggtggggacacatgcatgggcgcgggcacgggcgggaagcgcggcgcgtggaggtatcacccgattgtttggcgcacggatcgggcgctcgggttcaagcatttttggatattttatcaaatatcggacgcccgcccatccttggcgtctggcacattcgtcaggatgagcatcgtatgccgtttgcatgttggcttgtggcgcatgcatggcgtatgtcacatgcatgtatttttctactttctctctcttttcctttttctaaaatatgtgttcaatatataatctattacaccattttattcgtcataattagatctttataacaagatctcacatggatatattttgataaaaatatttattaaaaaatcaaacttatgttgcaccgtctaaaaaaagtttcaccacttgtgcagatgcgtcaacctagttcataaaatattccagagatgcaacatataaaaagtattgactgcaacggtaattatcactgcatgaaacattatgtcccaattagtgaaacattgaaaaaaaatcatatgatacaatacatttgcaaatatttgattttgttaaaatatttttgtatttagcttgcatcgaattgtaatcgctgaaacataaaatttttttttgctgaaacatataaaaaataatgtgcaacattgctaatgcattagtgaaacattaataaatacttgttggaacatacattaacaatgtgtgcaacatttaaaaagtaaaaaaaaggtcatcagaatatagtcatgtgaaatcttgttataaagatttaactataacaaatccaacgatataattagtttgaaatttagataaatagtttgagagaaaaaatcattttaagtttaaaatatgcttgcatgcacgttcagacttaccatgcatttggattgaggcgtccgattttttcttccgtgtcggacggctaatggtaagcattatcggaaagaagaagtacacggtgtgcccacatagaataggatggctcattatcttgatgaagcaacgcaaaaagtatcgaacgacagccacagaactgatcacattgccaggaaaaatataagtatgtaaacaagcattagagcatgttgaaaaacattaaaaatatatttttaaacgattttacatgaatatataagttggaaagaattgataaaaatatatcatcaccgctgaacgaagatacgaacacgtgacggcgcgtgagttcgctccctcccccacacacacaaaaaaaaaagaacaagttcgcactacgtgcatggaactaaatgcatgtgtccaaacgtagaggagcaatagcacaatacagagaggaggcaaaccctaaattatttttgcgtgtgttgcatagaggtgttgactcggttcatatggagatatcaggatgcgtgatcagaagacatgcacgatctccataagtcataactaaaccagataagccgtgcagtaccatgggtcgacatcgacatgtagcgcccaaatgtagaggagtgatagcgcaatatagaggaggaggcaaactttagattgttttcgtgtgtgttgcatataggtgttgactcggttcatatggagatatcagaatgcgagattagaacacatgcacgatccccaaaagtcataaaaccaaactagataagccgtgcagtatcaggtgtcgacatcgatgtgcagcgcccaaatgtagagtagcgatagcgtaatacagaggaggaggcaaactttatcttgttttgcgcatgtattgcgtagagacgacaactcaaatcatatggaaatatcaagatgtgtgattagaatgcctgcacatgatctccataagtcgtaatgtaggtgtaaggcgagtgagcgcatacacacgtgttcctctaattctctccattatacatggctcaagtcactaggagagccctttccattttaaagagatctctcctagaatgagtaaggtaaggtaatactaaaagttcacatgtctctcttcctgtgaggcattcctttgtgattttcatataaattacacctcatatggactttattccatactataattccaatatttttttatatgagcaaacttactttgctaaaaactataagagctcactactaattgtcagtgtgcatgcccttatttacaatctttcttccatgacagaattgatgtatcggtgtaactagagctgcgattttatcgtgttggttttccactcaaaatcattgcaaaagaatctctagttctactgttctagttgatacgttgtgagaatgtccccctgataatccacgagacaataacatgtagaccatggtaattacatggtgatatactcacactgcacccccaatagacgtggtaggctaacccgtccgttggaagagaagacgagttttctactgctgcacatacactagtacacacaccctatcctatatatcattgtcacaaatatgatctcctctcctctcatcggtccaaccaaatgaagtacccaactaccatgcaacacacaactagctaggagcctaattaaatcacatgcatggctaaaagcaaaagtagtagcccatggggtttgtgtcatgtgcggcctaattaacatcacacatgagccataagcatatcatcagtcaaagctgagatggtaggtgctcagatagctcagctgtccgacgcatgggaggaatagtacgtgggtacgttcgcgagacagcaagagtagtaactaaatactagagtattagaaaagaggaattttaccatactagctacaacaagatgggaggtcctaaatgagtacgggtggatagacaaagctcaaatcttgtggctcggatcaactcgtagcgagcacgattggctcagatcgattcgaacttgtagtcttaatgagttaaatcaaattaggctttcagcttgtgagcttaacaagatagctcgcgaactgctcaattagcttgttagtgcttatattaactaatatttagtcatctaattacattgtgaattctttattagttagtgtgtgttactatatttatatatgacaaaatgataaatttgaaattataaaggagggataaatatgttcacaagcctaactagcctagcagccagctcgcaagatgaattgcgctagactttagcttgttaaagttaacgagtcaagcagagctggctcgttaagacaatgagttcaaaagagacgagcctgagttgtctcgttatacacccttataaataaggatggttgatccacttaattggacgctcccccgctgctcctctcccgtcacgcaagagcacaatgcctcccactcctttctctca

SEQ ID NO: 39362 - DNA, 4090 bp, Oryza sativa
ctcattgcattgtgggaatctccaagctttgtcatggccatctcggttgctaagacaaaaccttgtgcaaggaatcaaataagagagaaacacccaatagtcatcagattcaaaatcgagccaggagatgctgggtggaggtggatgggttggatttccttaagacagtagggtctggatttcctagagaatgctattggctctggtgctggcagcatggacgtacgtcgggtgatggcgacggtggcagggcgacggtagggcgatggcggtgcgcaatcttgaactcggcgcgaaggacaaggtgtacaatgggacgagattaaaggtgcaatcagacaggcccctgaactcacttataatacaaataagcgggtaaaccggctgggtccgcaggtctgcccgcttacacccttagatacacttgtccttaccccctactagatctagttaccaacacaaatatccggtactaccatcatactcttttcaaattagtggtgggatatgtcactggtacctcctgtagtcctgttacctggtagtaatagcagttggtggtcctaaataaaatccctgttagaaaatagtataagatcctctaatatcccttcgtttagtcatacgtggttacattttataggatctcgaagtgatgagtgttgatgaaaaacacgaggcctgggaaatctgcttaactccagtgcatgtccaaagctcgccttcgggtatgctagcgtgccagtggatttgatcctgcaatcaacaagaaataaaggcaaagaaaccgcggttaaatctataaatgatagccgattggctaggtgccgatgacatatcatttatctttgagccggtgtcatatatgtatcgatcggcagccatgagtaaataagaaggaactaaatctatttgatcggctgtagatattaacaatatatactccttatatcgatatatacttaaatcaagtgattgggatagatcagtcgccatgccgagacaatataaatcacttagatcgaaatatatattaataatgggactatatatgttcatagcatagtcgatcagatagatctagcatgtatgggctaatactccgatactactctatattaagatattaaagcaagcagaatatatcaaacaaaagcttaatacacttaaatgccacaaaatcttaatataaagggcagatttaacatgtcagtaaagcatatataacaagtatagttaaatcagctaagatcggctaaaaccccgatactaccctaatcggcaaccaagaagcaagctagaggttgagattctaatcacgactcataagatcaaacaactgatgcagctataagtatgaaaagaaggacaatatctagacaatcaagccattggaattttcatagagtggtagatatcatgtacaatctaaaccaacatcgatatttaacctaatcggctgacctctactagtagatgttagctgattgtaggttagatgatgatatctatatattatataagatatatgataactcgacggattacataaacaaattagagtatcatagagatggaagcactaatcccgagaacgcaagccgccataacaagttttacctcttgttgaagatcgaaaccgatgcagctcaacccgaaagcaataacttgtcgaaataaaacgaaagcaaaaaagggtggcgatgcaccaagattgtattaaacgtgtgtgttaattgattacatagggttcggggtctatttatacccgagaattacaaactatgtccatatcggacatgactcttatctctaacaaactctaagataccataagtctttgcggcagacttttgcccaaacatatctctaaggaaattacataaaatatactaattaatagatacagttgccttctcaggactctatccacgcgtggcaatcatcttgaagcatatcgacccaacccaatatcgtacaccaagtcgtattgtcggaatcggctgcatcaccaaaccaagtctgactcgaacttagccgatccaatcgtagctgatccggactccagccgatttttactctgtttccgcgataatccttatctctgattccgcttcgatctaatcttcctttccgatgccgatattaccaaatttggtcgttaacaatgagatatattaatagtcttcatttatttgaacgtgtatttaaagagacacattcacaattatgtgtatacctcttattatctctgtaactgaaaaagaaagacattgttttgtacattgggtttgaagtttgtatattaaattatactaacggattaaaattttatattttatattaaattgcttgattatattaataattacaatttcatatcaattattacaatgctttagatagatatcacaagtgacatgatttaccaattttcttccataagtttcttttctcgagtacatctaaattattaattccctgcaacacgcgggtatatatatatatatatatatatatatatatatatatatatatatatatagacacacacacacacacacacacacacacacatatatatatacatacatacatacatatacatatacatacatacatatatatacatacatactacatatacatatatacatacatatatacacatatacatatacatacatatatacacatatacatatacatatacatatacatatatacatatacatatacatacatatacatatatacatatacatacatatatatacatatacatatacatatatacatatatatatatacatatatatatatatatatatatatatatatatatatatatatatatatcattttcttcaagagaagacgttgaaaatttttgggagaatattccaaagttcaataattaccaaagagcatcaaatatggtagatattctctcatataatccaaactagcatgaatgcagaagacaacaagtcacaatatgcttaaggtaaaaatccaacttctcgggaataaacagagcgcccgtgattagaagaagacatatgactctctgaaaaacccgtgatgctacagtgtgataaaaaatatgagtgaagattgagctccctcttcggcttctataaaaggggaagctagcgaagccagaaggataccaagaagcagcaaccctcagccagagtctcatgagccactctctaagctttagtggtagaaatctgttaagagttcacattgatagtatattgaagcaaggagtgtaatataaattgtgtaaggtaagcaacccttgtgtgtacaatccctcggggttccctaaagggaaaaccatatgtattctattttgtggtaatgtagtagttttattaagctttccttgctcgaccttgttatgtttatgttagtttaaattctacgctaatgaccctataggagagatgcccttcagtaagttctcatagttcaccttgcatgcagcaggtaaagagaaccttttatctgttgaagaagtgttcccttcgggtggaactgcctggggagacggtagaatttttatctcacatgaatagacccaaggacgggattagggtaaaagcttaagctactccttcagcaaaatagttagacatatggtgagtaccgagtaggattacacatctatcgttgcacgctcggctgtcccagtggtttcgccaacccattaagatcttgaaaatttaaaaaatatatacataaatatccatggagaaatatacattaaggtaaatgcagtccactatatggattcttctgccatctttacttgccaaaatcctacttttaagtcagatttcgagaaatatcccttggatattcaactgtaagtaccgagtggactgcatagatgcaggataatactagtatgatcatccaaactagcatgaatgcagaagacaacaagtcacaatatgctgaaggtaaaaatccaacttctcgggaataaacagagcgcccgtgatcagaagaagacatttaactctctgaagaacccgtgatgccacaatataaatgtaattactttcactaagctggg

SEQ ID NO: 39363 - DNA, 11103 bp, Oryza sativa
aaaggttgaagagttatataaagaacgaaaacaaatggtagagcaatattctgtttttagtactaagctaaatactgctttaaaattactacaagaatataaggcaaagcaaaataaaatttcacaaaacagtgattacatcaaggaaccaaaccatggctctgataccagcttatttctccacggataattttgctgccatgttccaaagaaaaatgcaaaatatatttaatggaacaaaatgggttaatgcataacgtataaaaaattcaattatatgtaaaatcaacataataaatcctaactacataattaaaacacgtccaatagaggcgaccccaaaggatatagaagaattattaaaggtagaggcaataagagaaagcaggagccctcatagatcagctgcatttatagtaagaaatcatgacgaagaagtgagaggtaaatataggatggtcatcaattacaagaggttaagtgataatacatttgaagatgcttataacattcctaataagcaagaatggatcaatagaatagtagacatttctcgaaatttgacttaaaagcatgattttggcaagtaaagatggcagaagaatccatagagtgaactgcatttacctgtcctcagggacattatgaatggcttgtgaagccactaggcctaaaaaatgcacctgccatattccaaagaaaaatgcaaaatatatttaatgacaaccaagaatttatattagtctacatagatgacttattagtcttttcaaaaacttacaaatagcatattgctcatctagaaatatttttttagaaaggtggaacaaaatgggttaatcttatccaaaaagaaaatggaaatatgccaggagaaaatcagtttccttggtcatgaaataggagaaggcaaaatacacctacaagaacatattgctaagaaatttttacaatttcctgatgctatgaatgataaaaaggaattacaacaattcttaggaattgtaaattatgctagaaaccacattcaaaatttagcaaagttagcaggaccattatatgctatattaagaaaaaatggtcagagatattttaattctaaagacattaaattagtaaggttaataaaagaaaaggtgaaagaactaaaacctctagaattacctttagaagaaaactattttattattgaaacagatgcatcgcagcagggttggttcctgtattaaaacaaagacctgctaaatactcatctaaatcagaggaaaagatatataggtatgcctctggaagacaatacagatcgagaaatcctagaaataatcaacgcgataaatgcttttaggttatatctagggtttaaagagtttacggttagaacggactgtgaggtgatacgtagatattataatcagcttaatagcaagaagaattctactaggaggtggatcttatttgaacaaatcattactggaaatgactataaagttgtatttgagcatattaaggggaaagataacaatttgcctgatctactttctcgtttacctattttgcaggtatgaagaaatctatgaattataatggagttgaattcttcacttttggggaagataataaactcagaatattcccaccaaactcttataaatttaaaccaaaggaccatataatcatatatgaagtgcaagaatgtattctggacaatttttggtatcaatataataatatgaagggctatatcctatcaatattaaatagtcttgctgaatattttcatttgataaatgaattaatgccagttgcaaaaaatattgaagccatacagcaaaagcccatttatgtggtttttgaaggaagagtaccaggcgtctatatatcctttgaagagataatatctcaaaaaatagacgcaaagctaacagtaggaatatcatggaagaaatataaagacattgaagaaccattaggacaagctaggaaaatattgggaataaattattatctagagccagcggcaaaggaatatattcaaaagtgcaagaggctagaaacaagaaaaatccagagcccccacattatacaaatataaaggaagaagggtcatccagaaaattgacatataaagaatgcttaacaaagggattagaccccttagatagtgaatatattgatttaaagataaatgaaaaaattgcagaagtctcgactcagtgaaagaaagatttaaaggaagaaattttcaaagaattaaagcaagaattaaatgaaaattttgaagctctgaagaaagcatatgatgagaaatttgaaatagccttttctgatgatgacactatggatatcggtggtcatgggcaaccagacgaatagttattatatataaagacctcattgataaggtattatcaattatacgggcatggtagaccatatatctatatctgttgaaaataaaaataagattacaaaggtctgtcgttatatcattttcttcaagagaagacgttcaaaattttgtggagaatattccaaagttcaataattaccaaagagcatcaaatatggtaaatattctctcatataatctaaactagcatgaatgcagaagacaacaagtcacaatatgctaaaggtaaaaatccaacttctcgggaataaacagagcactcgtgatcagaagaagacatataactctctgaagaacccatgatgccacagtatgataaaaaaatatatgagtgaagattgagctccctctccggcttctataaaaggggaagttggtgaaacagaaggataccaagaggcagcaaccctcagccagagtctcagaagccactctctaagctttagtagtagaaatttattaagagttcgccttgctagtatattgaagcaaggagtgcaatataaattgtgtaaggtaagcaaaccttgtttgtatcatcatccctcggggttcccgaaaaggaaaaccatatgtattctattttgtggtaatatagtagttttattaagctttccttgctcgacctgttctgcttatgtgagtttaaattctacgctaaggaccctataggagagatgctcttcagtaagttctcgtagtccaccttgcatgcagcaggtaaagagaacctttatctgttgaagaagtgttcccttcgggtgaaactgccttgggagacggtagaatttttatctcatatgaatagacccaagaacgggattagggtaaaagcttaagctactccttcaaccaaatagttaagacatatggtgagtacagagaggattacacatctatcattgcacactcggctgtcccggtggtttcaccaacccattaagatcctgaaaatttaaaaaatactccctccgtactcataaatgaagtcattttggacagcgacacggtctccaaatcacaactttgacttcttgtttctataaaaatatttattgaaaagtgatatatgtatacttttatgaaagtatttttcaagacaaatctattcatataatttttacattttcaaactaaaaaacttgagagttattcatgatttatattctcaaggtttgacttaaacattgtcctaaacgactttctttacgagtatggagggagtatatacataaatatccgtggagaaataagttactcggtgcgaaatcaacaagaggcagcaaaatagcaaggtgaccgtgtatctctactattataaaaattgaagatatttttaccggtacttttggtacgtcatccgtgtttgaatccgtttttaagttcaatcgcttttggaaatacagatccatgtttaaatcggttttaattttgttcgtttttaaaaatacagaaggagtcgtataagaaatctttttaaaaaacttgcgtgctaaattgagacgattggaccctaattgcggctcatgattttgtaaaaagaatatccaagcgaattcccacggtgaattttaccttagctataccgtacaataataatacgattaaaatagcattcacctgttgcaacgcacgggtattaagataatcctgtaagctatatccaaagggccaaggcgtagccgagcacgtacgttaggtatagcagctgccacgaagagaccgccgttgagttgaacgaagaaaagtcctagtcgattatatttacgtcatctcggcctggtcaaactctcccgcgaccgtatagtatgcgccgctgtccccgtgtgcatgtgctagctatcacgatatatagtacttactcgcgcatgatcgacccacaaaaatcgtttaaaatttggagcacaaactaattcttcttatcgttgtccaattttgatatagtttcgtaaccaagatttgttaaaaggggatgtttctagtttcataaatccttatatcgaagccgtgattatatttttttatttaaatctacggttacttcgatgtatatcattttggatgaatcattcttttatatattttccttgatgtcatgattcaatgtacattcagttttatatatagcaataattgcacttcataggttataaatgtatatgatgtacggatggttaaaattaaatttaagtataagaaaaatctaaaagttactactattatctaaacgatgcatgtgacttcatacgtatcaaacgttttattctttttattctaactatacatgatatatatacatactaccttcgttccaaaatacttgtcatttttatttattttttacgtttgatcattcgtcttatttaaaaaattatgtaattattatttattttgcttgtgacttgctttattatcaaaagtattttaagtatgacttattatttttatatttaggcggtgtttagatccaagggtgtaaagttttggcgtgtcacatcggatatacggacacacatttgaagtattaaatgtagtctaataacaaaaaaaattacagaatccgcctgtaaactacaagacgaatttattaagcctaattaatccataattagcaaatgtttactgtagcaccacattatcaaatcatggagcaattaggcttaaaagattcatctcacaaattagtcgtaatctgtgcaattaattattttttagcttatatataatacttcatgcaggtgttaaacgttcgatgtgacagtgtgaaaaatttttaggtgagatttaagcagggccttacataaatttttaaataagataaacggtcatacgttacaagcaaaattaaggtcaaaacgatatctattttgaggcggaaggaatagataggagcacaccatgcgtgtacgcacactgtgtaggagatgagtatcataccttagctactacggagtactactcaacatatcgtacggcaccggtaggaaattatggccggcgcagtgtctagctggctacataatttactacagaattggctatttttctaaatttatagtattagaatatctcgttatatccacataacgtatggggtatatacggaacattgggagtactagtagctaggtaggtcggtaggtgactgatctgatcctgaccgttgaatgtgatcaagtgatctgttgaaccctctctccaatgatcacattgctgcactactattagtcacgtgtttcacatgcatttctttgaaagaaaacagtgcctcatgttttttgttagaaaatctttcatacagttgattagttagttcgctaatttgttgggattagtcatcgtcatgtaacgacttgcacaacaaactcatttctaatttgctctctctttgttttgccgccgcccacgcaatgtatatatctactgcagattccttccatgcatgcatcttaattaacttctccgaattcatggattccaaatgaataatgaataagatgctaagctaggtttaccaattaattggctaattggcaaccaaatggctaatcatcatcaccatcatggcatcatcatcaaattttctaaacgttgcaccggaaaatcaacctagactggaattccttccaatccttcgctatagctagctagctaccacaacgatccaaaagttttgtcaaatatttagaacggggatagctaggcagtgtcgacgaagatgtgatgtgatctctgaatatctgaaccgtcgtctgatccacaaaaagcttcccggctccggacgctagctgctccatcccatcaattctctccattctcgcttgcatccagccaaaccaaattgaccgtggactgatcacatttatactgctacatcatccgccgttaatatatattttgagagaccatatcattgatagatacatgcatgcatcctactaattcgcccagatcaacggccggtctcgagacgtactcgccggtaatttgccggaaattgttatacgttttccaagggaagatgtctttttttatgccatctaaatagttatgaaacattttgattaattttcttttcacgggatagattaatatacgatatgtatcactctgtaaatatgcatgttcagaatttcaacccctacatgttattgtaaaatgataaatatgactgtgaaaatgcgtagactagtagagttttttttttcattttgttacaatgcaacttggtattcatgtttgtaaagtaatatatctcatattaatatatcttataaaaaattatatttttaagttattttggtggcttacaagaaacgatgggatcgatatattccttcgaggggaaaacaaggaacatttcccaatttgccattaatctactctcactcatcacagtcatcatgctagttgatctgcacgctgatccgatccggccggaaatttcgaacttaattagcacgtggattaattagttggcaaaagctaagtacaagtcattgtgtggtcaattgatcgactgatctgttgctccccgcttctgcggctttcattggctataaatacgcagatatgtgctcactgcctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatcatggaggattgcagcagctggatccatggctacgccaacgctaacgccaccgccggcaacaacggcttcatgtgcggctacgctgccaggtaggtgttcaaacatcttgatgatcaccgtgacacgatcgatcgattgatcgcgacgacgacgataataccatctgtaaattagtcgtctctgttcttgagtggtttggctgatcagttagttaattagctacttcgtgtttgcagctgcagcccagtagagtttcagcagcagcaacagctggtcggctcgcagattgagcaccacctcaaccaggcaagcttgatttgcaatttattcgatcaagaaacaatgcataaaatcaaagaaattttaggatttaatttggtaggtgtcgcgttttattacggcatgcagatcagcatgcagatggggatggatgacgagtcggcggtgtacgacggcgcctccatggtggacgtcctcctcatggcttcctcgtcgccgcaccaccacgccggcgccggcagcttccagtactcctcgccgacgtcctcctccgcctccttccgctccgcctccgtctcgtgcagccctgagagctcggcggcggcgacgacgcacttcctcggaccgccggcgccgtccgcggcggcggcggggttccattacccggaggtctcctcgcaggcgccgttgccactacccttgccgccctacgagccgcagcacggccaatacaccaccgtcctctcgccgccgccgccggcgccagagttgccggcgactactacgccggcgaccggcggcgcgttcaggcggtacgcgcggcacctccgcccgaggaggctgcccaagccgggagggtgcgggcagaggatgttcaagacggccatgtcggtgctcaccaagatgcacgtggcggcgacgtacaaccgccagtactactaccagcaggcggcagccgccgccgcgtcggcgtcggcggccgaggcgccgccgtccggcaaccagctgcagcacatgatctcggagcggaagcggcgggagaagctcaacgacagcttcctcgccctcaaggccgtcctccctcccggctctaaggtatacatacatacacgtatcaatacgtacatttgtacgtatacacatgcatgatcattcatcaacattttgttcttttgattagtgatcttgactagtaatatttgcttcaatcatttcttcctttttaatggtagaaagacaagacatcgatactgatcagagcaagagagtacgtaaaatctctcgagtcaaagctgtcagagctggaggagaagaaccgggagctagaggcgaggctagccagccgccccgccgccgccgccaagaacgacaaaggcgagacggcggcggcgccagcgccggaagccggcgatgagacgaagcgaaaggacctagtagagatcgaggtgacgacgagcggcggcggcgccggagcggcggatgcggcggcggcggcgggaggagatcaagagacctgcacgctcaacgtagacttgcgcggcggcggaggcggcggaggcatgagcacgacggacgttgtgctccggacgctgcagtgcctgagagagcagatcggcgacggcgccagcctcgtggcgatgagcaccagcgccggctccggcggccgcccgcctcgtgcaaacctaacattacagctcaaggtgtaattaattaataaaaaagcattctactaaagaagttaaaggaaaaatctgtctcacatctcagtgatcagaaaaaaaaaagaagaaaaagggaggtgccatcagtgcaaaatagcatgcatgcatgcaagcacattgttgacagcatgattgtacatttttctctcttaagataatggaaaaccttacacatatttcatactagtagcaattgattcagctggcatatgtggacatgcactgttcttgacagcttgattaattagtcttgacacttcagttaattaattcactctgctctgctgactatcctgcgagccgcggaaaagtctgcatgatgaccgataatgatggagggctaataaacatggcacttctgaagttagtgatttcaggtcaacattaagaatcaagcgtgcaagctgactattataattagttgtcgtacgatgacgtgcatcgtcagccataattagcagacacaaatattatactctgaaaagtaaaggaccgtgatgtcagactggtaaaggaattctacaccactgtaaaaatcctcagcaacgttcgtacgtatacacgatcgcatccatgaatcttcaggagttgaaatttgagaaatacgtaacggcgacagttcctttactcccttgttctatattacgagtccttcggaccttttttcgttattcaaattcgttattttaggttatgtatttaattttaaaacagagaagacatatcattatagtttgggcccatgtgtcagacatgtacttactagattatctaatcctacttgcctccttgtgcccgcaacgcaagcccccacccaagaaaatcagaaaaaagaaattcacaaaatgacctcgtgctttgtttttcagaaaagtcctactaccaacccatttccagtcataggggcaaagagaaaaatttaatcttcatatgatcaaatcaacatgcaacgcacggttatgctacaacagggagttaaaaattgtagtttttgttagtaaaaaatatatagctttctaataaatttgcttgttctggttgcatcctttaaaatgtatagctaaaattacagaaaatgacgattttaacttaaataaccgcatacttttaaaatatactcttaatggtctattcaacttacagattatggactctcacagatagtggtgaaaatgctacagaatattctgatcatacctgctttcttttccctttttccgaccatgttagcattatcttgttttcatccagaatttcgaagaggcaagatgtaacttttgaaaaacaaatcaccaacattttctttagaaatctattaaaattaactttactgctttctaatattaattttattcatttatgtcctcaaatgtttttgtcattaggtcagtttcatccctataaaggaattgggcccaacttatttaagtcatgacattgttcgtgttatgctaggtgatgcagtgttagcgagagaaaattgagattatggcattatcaaaggtgggttttgccacaatgccattcggcagattggtttcgttgaattgccactctcaaaccgtgtgccattgctggaatgcattctctcatgaaaatacccttggacttcttacacaacttgttttcttaccatgttagtttgctcatctgcagaatggtattttaacgaaacccacttttgacaatagcgtagtctcaatttgccgtagtccgtctaggctcatgtgaattattcatcgaaattatatataattaaaaaataaaaaaaattataaatattgtttatacgtcatgtttgatacaactccacatcttaaatttgcgctggatttaatgtttgtatgttaaagtatagccgtttaaaatttttatcttatttaaaatggaaacaaactgattgatctaaatgttatcaacataataacgaatttagatctatggatttgtggagctacgaatatatatatacagcttaaaaaaaactttgaatctgaagccgtgttaaaaagggccatttagttatgattgtttggtctctcaatttttttctaggtccgccattaacgatgacgggatcaaggtaagaggccgggacagccaaggacggcaccgtggcatgcaatgaaaggtcgtcgccggcgacaccttttg

SEQ ID NO: 39364 - DNA, 3194 bp, Oryza sativa
gggtacgttgaaatttcagcacgaatggtacgtataaatgatgatgatagggcgcgctgacagatgttttgaaaaccaccgtggtatgtacgttaggccttgtttagtgccaaaaattttttttcccaaaaacatcacatcgaattttggacacatgcattgagcattaaatatagataaaatgaaaaactaattgcaagggggggaaatttagagacgaatcttttgaacctaattagtccatgattagccataagtgctacagtaacccacatatactaatgacagattaattaggctcaaaagattcgtctcgccgtttctaggcgagttatgaaattagttttttcattcgtgcccgaaaaccttttccgacatccggtcaaacgtatgatgtaacacaaaaaaaattttatttcgtgaactaaacaaggccttagtagttagggcctagctaggttcgtacacgactacaatagtatattctcctatccatagccacaattatttttaagaatcttagctgagattaatgtgttttcatgaaatctgatattactttgatgcatgtctcttagaattattacgacagacaatagtactctataaatatgtatatgggataaattttagctcataacacgccgattagctcatgaaatgaacatatccaagccatcatatcttacaattttttatttttttttaaaccccatcacttctttagctactgcagaaagtctcctaataaaattatttccctatggaaagtttatgaatataaacttttcttttgtagaaagtttgtgtgtagagaattttaatataataggcttttatctaaatggagagtttaaaaaattggacaaaaaatattgaacaaaaggtattcacgctccaatggtggcatgctgatttttcaatctgcgcatggagacgataattctgaataaatacaccctagttatatggtagttattcagtggcgcactaattacgtaatgcgtgctagcctttgccctaggtgattgggagattagcaatggaacccgatctatagacgctaaaaaaaactaaaactctctactcataaactttctacaaaataaaaatttatgctcaaactttctacatgaaaaaaaaatgtacgatgaaagtttctacagtaattaaaaatattctagtggaattttaaaaaaaattgtaagactgttaatatgatgaaacaactcagcaaatagaagttattatgatttcatctaataaagaatattctactccctccgtttcacaatgtaagttattctagcattttccacattcatattgatgctaatgaatctatacatatatacctatctagattcattagtatcaatataaatatgagaaatgttagaatgactttcattgtgaaacggaggaagtatatgtggaaacatgcgtgtaccatgggcaaaacgatcttgaaaaaatcccacatggccccactcaaacaaactaattcatccatcccataatataagatttttgaaagacaaacatatttatttaaaaaaaaggtaaaattaaatagaagaatattgtgattggatgagaagtggaagtagcagaaattgaaaggaagagaatgttgatggataagtggttatattttcgaacatctgaagtttaaaaattgttatattttgagatgaatgaagtagttactaagatggagctacacagcatgtgctaaccctaccgcgtgacccgcccacattcccgatctgtttgcatgaatcgaatcacacaaacgttcacacaatacggtttctgcactcgttggcctcctcccctcttgttttggtgcaataagttagcctagagtactactcctacaactacaacaatagctttaccaacactggattgggatgttcatatccaacacctagagctctactccctccatcccagaaagaatcatcctgaagtggatggatcactacctaatacaacaaatttgtggtagtgtcccatatatttctaagttgattctttctgaaacagagggagttctaagttgattctttctagaacggagggggtattgcatagattccacaattagatccttgttatgagtcaacattgatgtgtgtgtattggtatgcttgtcttaattagagattttactgttattgagacaataattgtaggaactaaaattttacattaaaagttttggaacctcgaattacctagtacatgaaatactaaattttatactactactagaaaacatgacacctcggtatcatattaagatgataaaatcaccctagtcttaataaattataaatttcatagaccaattttggatgaaagcatgtaactgttgaccagatctataattttataattttgtagtggacaacttttttaacttaaaaagtttagatgctcaagtaatcgtcaagtcgtttgaccttcagacaaggttaataagtaaaaaaatatttagatggtgaaacggaattatactttgcaatttatcattaaaataaactaaatattcataaaatttctaacaaaataaagtttcaaaaggaaaatactccgtaaaaaacaatttctttttcttggggtatatgtgaatgctactaacattgatatatataggtgaaacagtagatagtcttcgcgtgaaaagagctcatggattgaaatcctagaaactacgcgcgcgtgcctttattctcatttcatgccaaaagtcatatgacttgctgcataaacgacactaatcggcttcgcacctgcaataattagctttcccgtagcagtgtgtacccgattttatgtcgtgatttcacatttcctctttaattcaaatatagtcacatccaactcgtcactcaatgcatatgccaaccacaaagttagcggactagggaaccggataggattttgtaagtctcgcaagaatcatcacggtgaaagagattgcaatgagaaaaaagaacatagtgattccgattggggaaatgtaattctaaaaaatagcatattatatgtatcgcgtcatatatccgctcgatcgctctcgctagctcacgtcagctaagcagacaattgagcaagacattctacagagagcgaagtgagcatgagtataacttaaatcatcatcaccacctgcggtgattaat

SEQ ID NO: 39365 - DNA, 6685 bp, Oryza sativa
tgctctagctagtggccagaatgcgtgtcgtgtttgatttacctacaatactcttgtatacatgtatgatagaatctctctccaaccatatctttttaaaaggacagatgcgttagagacttgtattccacgatttttatattttcagcagacgccttgcctaccatgttaatatttttaatggtgcagtaacagacccgtcttccaattaataatttatcttctttgctatagcaacgtaacgaccgtcaaatgttcactgcagagagggatgacctcatccttcgtgccgtctgtatcaggtgatcaattttattaggaaatcagctaagctgcccccaaaagtaaataagattagcttaaggtgataaattagtatatagtaatcccaaagtagcaagtcagcaagtggttttattattttaaagaaggacggaatctttccgcttcccttactagttaagatttgcaaccaaccggcaatgcgatgcgattagaccagaccactattttaacgtttcatacacatcaccctacaagatcccgaccatagtgttttgacgacttgacctaggtttacatttgcaatatcttaatcccctcgaactcccaacggtgcaacattagaaaaaaaggtgcgcagaaaggaacttaccaggaactgtctcgatgcatgaattttggcggggaagcagaagctgaactgacgactgttcaaaggtccaaggaaaatgaaggcctaatcctgatccatgtcccccctgcactgcgagtgtcctgccaccataaaccggagcctgcaacagctgaccagaagcaaggacaagaatgcagagcagaacgatcaaactctacatacctggacgttggattcttagctctcgagctatgtgaaatacccttctcatctgtggaaaatacacaactaaaggggtggacaagattgaccagagactcttcttcatcatgcactgccgtcatatgcaatacaatgttgatatcatcatatacggcgtaagacgaacatcttccattgaaagttacagcacattagtagtctcctttcaatcagtaaactgttgtgaaaactggaaagtatgcagttaaaatgaagttatggcccttacctgggatagcaactccattggctcctgatatttccacgaaacgggaattccaccaaacaagtaaatttcataatactgcttacttgagaatagtaagcaagtcataatcctaaagcattggtattctctccttgacctacatgtattatactggtttaacgagacatagagaagtcatattgtgtcagtccaccatatatagatgcaatttcacatagactagtcgatagtattacattgaatagaccatggggaaaaacaatattccaaccagatggcaaaactcttgccctgcctccaatccgtctaaaaggaaaggaagaaatgtgcgcacgttttggaagtcagttgctaaaaaataaggagtctactactctattctgtactggtcaattatgatgcatgagaggaaattagttaaccaatcaggcagtgcggtaacaaaatcccaaggtcatcctaattcctaagggaagaactgaaaattcattaaccaatcagcgagtgaggtaagccggtaacagatttcagggcacggtaggtccacgtcaacactctgtaattcactaatttatgcctcaatcttccataggtaaaaagtggtaggctaaccccataagcccctccaggcctccactaccaaaaaaaataaacacacacacacacacactgacacaccaacccccgggagagagagagataggtcgttctcaaaagaactccagacttcatgagcattcttactatcaaagctttgaagattagggagttttgtcgttgctcgatcgacacctattagacatcgtcactttgcttcattttctactcgcagattatacatcatggaaggatctcattacacgaaaaaaaaaagatactttccccttgtcgcttgaatggtaaactatatgaaaatgacagtcagagaggaacaattggttcatctgttaccaagataatcgtatagaaggaagaaagttgcttgcttagagtggtggtgaccttgagcaactgccaccttttggtcaataggagtggctctaaattaacaggaatttgcgtacagtactacagtggtgtattaaaaaagaacccgcttacatgcctacttagacaagccagcttctagaagtttattgctttaactacatatgctttggtcccaacaatagtattacagtgtacgtttattatgaaaagttgctcctttgcatcccttgtccattcatttgtgagcatgtgatgcggtaagcatttcatctatatacattagcttgggaggatctctgcacgatccaggcacattgccaccttatccaactccaactcgggaacacattactttggtttgaaccgatgaacccaataaatctcagttttggttttctgtttactgctcaaaggcaaagaccaaaattagtgttggccatgagagctatacgactatccatcgtagctcattataatgcggatggcaaatgtcatgtaactggtagtagtaggactactaatttgccatatgtggatggcaaatctgtactgattttgcatgatatagagcaaaataacctccataatgtattgttagtgggacaaagtaagcagcagcagatgctctgcagaacaagaagatgggggccacaattgtttcgaacgctatgtgaaccagtatagaaagcacatggagaaattttcattggcataatggcgtttctcaatgcaatgcagtctgtatcccaaaaaaagcccatggtgaggaattaattccgcagttcagtatagagtagcacatttccaaatgcaacgtgtgtgccgggtcagagcagcacatttcctaaagcataagcttaaacgagtggatgcaaaatgtgtgtagcaccagaagaactcctgcaacgtagattgtccagtctccactctaaacatctccaatccaacacccaaacaccctagggaaagtctctaattactttggtccgatagcatcctgtgaaggttacagcgtaacctactaatcaggtccccaaatttcagagaacctactaatcacatccccaaattttagagaagtacagaaacgaattaatgcatcaatctactgtctagaactcaaatcacgcgacaggcatcacatcacattgatccgatcaacgatcgatcggaacgcgaagcgcgcgcgcgcgcgcacacccatcggaatctccgagcacccaaacgcgcggtagatcccgcaaccgagccaccagaaaaaaccctagggtgttcgcggcggattgtaccttgagcggagccagcccgagagcccgccatcgcggcggcctcggggaagacgaagcgcgggtggaggaggccgttcatccatcggcagaatgccactcccctcgggccagaactccggcgtgctctgctcgccacccccaaccgccgcggccgccatcgccgccgggaccgggagcgcgagcgcccgagaagaagtgtgggttgggcgcgggttgccgaggcggcggcgcggcgtgagttgggccgagatgtgccctcttgggcccagcatatatatgggcctcgagtcaggaccgtctaagaaagactatgggccttactctcgtggcccatccaactcgaccgcattttacaaaaaaaaaaaaaaaaaaaaaaaagagcaaatttcagctaacctcacgtttttgcataaaatcctacttcctccgtttcacaatgtaagtcattataacatttcccacattcataatgatattaataaatctagatcaatataaatgtggaaaatgctaaaataacttacattatgaaacggggagtacgtattataatcagtgacacgtaacatgtgattctaaagtttcacaaaatcctacgactatatatttggtaaacatttacttaaaatttcaaaacatagaatgcatataaaactttgagtggtcgatttcttgattaagattatcagtttaactcttcactactttgaaaaatattgttttagatatgttgaaatcaattgcattttttttaaaaaagtaaggttttattaaacatttagacataaaacatgtagttatgtaccccaagtcataatacatgacttccacgtagaagttaactgcgagacaagatcgttgttattatggagcacaaagaaatcacacacaggtaacagggcattgattctcaactcctgaatcaagtctagtttttactttctctctaccaatttggtacatgaaaacaaggggaaaaggctgcataacgttgacaaaagttggataaacaagagggattcgctgcaattcacagccctggatcatcgctggatcggatccaagacttcctgtggagccagcagcgcgtgaaacacgcccagtcgccatctgaaatgaaaaagctcttccggccccagaccgaacttaacaatgctcacttgacacggctcgaataaacaatgcagtgtgacagcacagttctgcgtgaatcacacactcagatcctgcaaaaacgaatgggaagtatctcagttttcatacaagagctgcataaaaaaatgaactggaaaaaatggaaatagcagataaaagcaaaattgcagggcatgaggtacttcaggattcctgattgtttctgtttcagtgacctttcaagttaacttattaggtggatcgtgcgcaactaaacaagacatgttgttgctgtcttgctgagtatatcatctggtacagtggtgaactcaaattcccaattttctacacatttacgaatggttaattttctacaaagaagatttgcaattgtcgatgtaaaaatttcaagactaaacatcatgaagtttccaggtaaaagattgacctaacactcaaatacaagggaaacatacaagaaatacatgcacacgtaaagcatcgtatgaagaaacaactgacactgaaaagggaagctgtaaattgccattatgatactgtacgaaatgagatggtagtggttagacaaacaaccaaatagatgacaaagtaaggagtacaaaataatttgcatttgcagtcaacagttttagaaataatttaagaagctccctctaagaaagaaaaaaaatatagagaagcggttgataagtccaggtccaggaatagtgtatctgccgggaacaaagaaaatggaaccagaacaaattgcatcaaatcttctgaaaactacatttgaattcagctcgttatatgtatctgtgttttcattatctagttcacatttgacgcacaaattcaatgcctcgattgactgcgtcagcaaactaataagtgagttcgattaaattgttggttagctggacctaattccaagagaagtggtgaatgggtggcctcccacaacttcccaaactacatatctcataaaaactacaaggacctgttgatccatagatttccatcaaacatatcagtattttgctccttcatgatatccatgtcttttggttgccattaataatttggcatcaatgacaaccagacaaacaccaaaacaatcgacaaccagcagtgcagtgttatatcaggcagtaatgagatggcatgactactacgattctaaaaatccctccgtttaacctgactggctgactataatgaatgcttgatatcacaactcacttgtacagttgtacttggattactatttcacccagatcttattgaaattttctgcattcctaaaagtttttcagatgacaaattcagatgtttctttcctttgttgctacaagccattgataaatcaggtaagtagcatgacaaatcatgtaaatcaggtaatgtgtgatttttttttagataatgtatgaatacaagagtaagttcccagtatccatggagcaagcacaagttaaacatgtactagcaattattatgatcaaattgagatccaaaaacagcgccttagctgctctatctactactacacaattaaagtcttgcaaatcattttagcaaagaagcgtaaaactgattgtgtccacattaaactgtaatgatcacaatacaaaagaagagattaacaaattgtacacaattcagcggtaaaaacagaaattcatacacaatactgacatttgtaggaatggaccaagaatgaagaatcggaaggcaacctcgaactagtgagccggctgcgggggcaccggcgtgtaccagcggccgacctcatcatcgacgttctcctccgccttgtgcagcgcggcgtgcagcacaacgagcaggaccccgatgagcagcgaggagacgatgttggcggtggcgccggtgagcaggaggaggacgagcgtgacggcggcgagggcggcgagcactgcgccgtccccgacgacgcggccgaagagcacgatcggctcgtcgcgtaggaagtagaggacgagccatgcgaccatgcagacgaggaacacgatgagggaggccgggtgccacaggagggagaggaagacgacggcgaggaccacgatggcgtagttcatggcgtagtgggcgaggttggcgcgcacccggaggtaggcgtcg

SEQ ID NO: 39366 - DNA, 19330 bp, Oryza sativa
atataatatttagggaaaattataaccataccattataattttgcaaaatttgagatatgccatcctgacccacatgtcattgaatcatgtgggtcctacatatcattgagataccgatagcatatctcaaactttaaaaaattataatggcaaattataatatttatggtactgagatttgaaccttggtgcgtttcagcaaaacatctccaattatttgaatataatgtagaaacttgtcataattttgacaaacatattttgatgtcctgcgaatatgtgatattttgcactttatttattaggtgtgatctaatgtatactgacattcacaatattacaccaaattatgggaatccaatacacaaaatgctatattggtctaaattttgttttcccttggcttttaactttatctgtctttgtactctatttcgttcctataaaatcggttactatcccatctctcggatatgcagatagttcactccatttgtcgcgagattgtccatgtaaccactatactcacattacgccaaagttgtatgtgcatgcacgtagagctagtaactagaatgttaataaagaataaagttgaaagaggagaaagctacaacagagatagatatgaccgtccgaacaagatggcgccatccttaccgttgctaggtaccataaagttgctgcagcaaacgccgccacctacgtcgtgtccccagtttgcgcttctagctccaatatctcggtcttcttgtcctcccttcgcagcttctttgtcaacttactctcgtccatgccaccgcttatcactagctagctagcagcagacaattcacggcattgattctatgtcgtcttatgcgtaatgcactcaacaacgtcgcaagatccagaagtactcacggtgggaggacgagggaagccacaaccattgcgctaagggaggacgaaggaacgccaataccgacattgctcaagctcattatcatcatctccgggtgggagaatcagcgcatataaccatccccatctcttcttcctcctcttttcagcttcgacctgataccctaggtatcaactaatattatttaggtatggtattgataaggaaatagctatgcgtccgacggatttgtacgacatgcatccgattgcggcttgcattggttcgctggagagaagccaaagatggtgattgatgcacatggtatggtcggacgcgggtcgtacgaatccgtcgtacgcatatcagtgctgtattgataataagatattatatagttgatatatgtgacgagtatctacgagtatcaccaatttctgaactatatttgacgtgttcctccaatttccaaccaaaaaaaccaacctttatgtcggcatgtcgctatcctatgggctttgagcccacaagaaaatagatgcgactgatcttgggccaacacatagcccatactccaagcccacgctactggtggtaggtacacgagtaaaacaaaacgtgttcttgcctgcgtatatacggtgtacgtacacacgtctagtacacgatcacacagtcacacgcacagatccacacgattccaaactcccaactctcgactagaaccgactccaatggcggcggcggcggctgctgctccgcccttcgccgccggcgactcgccgcccccgaccgggttgttttctcccccgcaccaccaccaccaccgccggcgccgcccccgcgccccggcgttcctccgcctcctcccgcctccacctcctcctcaccgccgcgctcgccgtcgcgacctcctacctcctcctcatcctcccccgcacgcccctctccgccgcgccggcgcctgcggccgccgcgcgggcgcaggtgaagctcgagaagccggtggtgatcctcatctcctccgacgggttccgcttcgggtaccagcacaaggccgcgaccccgcacatccaccgcctcatcggcaatggcacctccgccgccacgggcctcgtccccatcttccccacgctcacgttccccaatcactactccatcgccaccggcctctacccttcctcccacggcatcatcaacaactacttccccgacccaatctccggcgactacttcaccatgtcctcgcatgaacccaagtggtggctcggggagcccctgtgggtcaccgccgccgaccagggtatccaggccgccacctacttctggcccggctcggaggtgaagaaaggcagctgggattgtcccgacaagtattgccgccactacaatggctcggtaccattcgaggagagggtcgatgcgatccttggttactttgatctcccatctgatgaaatgccgcagttcctgacgctttattttgaagatccagatcaccaggggcatcaggtgggtcctgatgacccggccatcacggaggcggtggtgcggatcgatgagatgattgggaggctcattgctggtctggaagaaagaggagtgtttgaggatgtcaatgttatattggttggtgaccatgggatggttgggacttgcgacaagaagctggtgtttctcgacgaattggctccatggattaagttggaggaagattgggttttatcaatgaccccgttgctggccatcaggccgccagatgacatgtcgctgccagatgttgtggccaagatgaatgaagggcttgggtctgggaaggtggagaatggtgaatatctaagaatgtacttaaaggaggatttgccttctcgacttcactacgcagatagttatagaatcccaccgataattgggttgccagaggaagggtataaagtggagatgaagcgatcggacaaaaatgaatgtggaggagcacatggttatgacaatgccttcttctcaatgagaaccatatttatcgcgcatggtcctcgttttgaaggtggtagagtcgtgccatcctttgagaacgtggagatatacaacgttattgcttccattctcaatttggagccagctccaaacaatggttcatcttcttttcctgacacaattcttttgccgagtgaatgatcacatatacatgtgactgctgtggttttggatgagaaaggtcttgctgttggtatcctcctttagtcgtaattgcacttgtacacttatcatattagattcgtgtcactagtggctattcactgcctgaatgcaaatgctgctagtagagagtatctttgtccttatggacaacatttgctgttgttatcatgtcttatccttagcggttttcttatgcttaaattttcatgcaagttcaattaagctcgcattctctgcttaaaatgatgtccatcctgttgataagagattaaccagtcctagttctatatttaatttcagccaaccttttacccactgataataatttgatttatgtatctcctgttaccctgaattattcatagtcactgttagtttcttctgatcttctggtgatctaggtgtactcattccaacatatggaactgttgggaatcataatagacgaagtggtgtttttactttcctggaggatcttttcatggctttatcaataaattgtgtagcaacgtaacaatatgcacatgagcattaacaggcctttatttctctggtattagtattacatctgttatcagttctttgttgctttgttcttccttgttattcacttctgtcaccactttgctccttgccagtaaatcaaagcagttgctatattatgtttgagtattttggaaaaggccaacaattaaacatagatttcactcttccttttttttttggtatgagcaaataggatatctgattgggaagactatttcgttggcccctttttaactcttgaatcagaaaaaaaaaatcaggtctatgaatattccgttccattcccagaagaaaaatatgatgataccaacttcttaaaagcatagtttagagtttggagggctgcaaattgcatagtgtaaatatgtcgtgtccataaatagtttccttgaacacatcaataacatcattgttacttacttacttttgcatgcctctctgtgtatggttaaaataaccaactaaacataaaacattgttggccattttcctatctgaaaagagccatcgttttgtttgtttgccaacttttttgtgcattcatacatgtgtctctataagcttccttttcttttgtctcatacctatttcattatattatttgttctatctgttgaatccaggctgatatgttctaccttattttcacctgttggtggtcttaggttctttattttattgatacagaggttcaacctcttgaaaggtgaaacttgctaactgctcccatgccgttctgagaatgcttgttagctttcatcgaatactattatgttacattctaaagcctttttttttgtttaaattgcaaccatggtcctttgttgaatttccatagatttgtaatgtttttttctcctctaaaactatagttgatgcttggtactataactttgaattggttgctttgccgtctgtttgggcacatggtctgcacagtactttcttctacttcattttatggttcttgggaagtaccaagagatattggtacatctgactgtaatttttatgtgatatcacacagcgcctcctagtgttgaggaaccacagatgaactctatgaggtatggcaagttagctcctactgttgttgtattgagatgtactacaaattaacactacaagctatagtaggtatcttctcaaggaccacaaaaaaaaacttcacttcttcagttcttaaaatgtcatggatgtgcttaggatttcattctttttatttagatcaaagattggcaactcctggattttctcctccctgaacaataaaatgaaactgcaaagtctgctgggcaatctgtaattttttttgcaatatgggatcaggcaatgccccgtcgtgttatttcctgagggatgttgaaaacttagtacatttgagctactaaaagagttgcaaattataacttggttcatttgaattaactcatcttttagtgggtgcaagttgggtttgtgggtgtatctaccttgtcattgcaagaaatcgtccaagcatgtagcacagcaaccctttgaaacacttgacttacctattataatggcaaggatctgcacatttactattcatgaatacagtttcttgtctctccatatcttattgagttggttgtcttatgtgcaattgctacattagctgggttgtatatgcaattttgtcaagaaagatgatctaagcatttggttgtatttagtgtacagatagcgcatattgaaaaacacaaccaaacctcagtacctccgtcatgaaaactctgacaaccttgatagtttctttttgctattagttctgctagagctcatttttatgtgatttttggaactaaatacacaatatattgttgtttgttgatttgagtttttcaaaagttaattgtcatggtagattctgcagaggttggtgcaatcataaatcttgttctggctcttctgattatcctgggttaggttctgtattcaagaacactgccagttagagcttagagggcaaaattacttcattgcaggtaggtaaatgccttcatattctgcactgcacatgtttgtttgatactgtagacatttcatgaattagtacttcataattattatccaaaaatctttaagtttcaagcaatagaatgtcctgaatggtgaggctgtttctaattcttttcattattgaaattttcttgatgtacttctgatattttccatccttttaggtttaaaggaaagtagaaaagacagaaaaatgtgccaggcctgactgaatagattcctgatttcctgtaaactaaatcacatggttagccgaagtgatcttgatgaggtaatctgtatagtattttctttagtattcagtcagcaagatcagtttatggggatggaacagtaacactagttcttgccccatttgatataaagattgtattagttcataactttgcatgttaaatagttactgtctttctaaaagcagcataactttgagaaatcagaaatggtatagataaatagccttggagagaacatgtttatcttgttttttactgtacctcattattactgtacgtagtagctgctgataatcacccagcctcactgataaatgcaacccgacaggagcacaatggtcatacaatctagtgggcctttcagcgtagttgggtgatgtcctgcaagcaggggggccataagttggtctctgaaactatgccatgaacagatggagataaatgtggcaatgaacactagcaaacgtggccttattctaagaatcggcttgcagggaccggtaacacacggtaacagtgcaactgtaggggctataaagagtgagggtccagttgccacccaatttcttagttttaataggttcttttattggttcggtgatgcaggcagtcgatatatttgttgtccactaacttgcaagctttaattgctttggttcatattagttgtttgttcatgattatggtgtgtgaccttaaagatgctgctgtatgaactagatctgtcaaacagaagtgtagggactttctatactgttgtcacagctccgttgtttggaaaaatctatgttgagtagtgctcttcctgttttatcttttgctattcgatcatatggctctattcatgattgacctgcatgatttgccaggataaacaagtggtacactggtgcatgcatcgtattttctcttacgtatttgtattttatgttaattgagaatatctagctagttcctatgctatgcacttctgcatatcacttggctcattggctgtgcagagcaattgttcatcttttgtcttttaccattgctcactgttgaagtgttccctccatcatttgcagagttctgtgataatgtggcggtctgccaggaggaacaggtgtactgcaatcagctgcaggaactaccagccgattattctgtaggcaataattcccagaactgaagcctgagcatgccgaacctactgtttctctatagatcccttggtaagtactattgtctgttgattcactcgaacaataaatttacctcagccatcccacactttttccccaccatttctgttccgcatagatttcacatccattattcagagttgcacaaaccactatcacatatcttcacctttaccgttcgggagcactcccatggtaacaagagaatactcaagcttggcagtgcacaatggtgcaagactgcaggataatctgtatacactcattccaaggaccaaaagtgagcctgtacttttcttctgttacccccatacagggatcctttgctcctggctttgttcaatcaacttcctagcccattctcctcctgttcatgtgtcttgcgcccacactcgtaaagccctaaactgcacttcgccagtgtcctcgtcagtcgtcagctgcatgcaataggagcacgggccctgggcaaggtcactattgagatcccttttggcttgctgatgggtactgctaccaagaaatattgttctaacctttgtccttgttgcactcttgcctcattgattccttttgttccttcctttatgatcccaatgtgatgcttctctgtgcgtacgctagggcctgctttgtttttgcatgtgactttccttctttcttccactaacactgcccaggattgagcactcggtcatcatctaatcggtatttcaagcttcaaagtgttttgatgcctagctagcttcttttgtttgttagggttagggtgagaagaatgttcgaatgattgtggggatataatcaagctgcttttcctgtcaccttaatcatgcaatttctggtaaatcctaatgattggtgtccatctatccatgagtgggcagtctgagccacatccaccctaccaccccatataagtgctaatatgtgcaggaaacaaaatttcctgaattattttcgtgcaatgagtgatgcatatgttgaatttaaatgcctaaactataatcaattgtgatatatttttctaaagagttgttcttatgcagaactatggctcttcatatctgtactctcagcagcctgcttcatattcaggtcaggagtcttactctcttttttctcagttacaggtctttgtagtaaaagttgcaggctccaataaaaatgaatttgtaggtaaaacttttttatatgtgttcttggtgacttaaaagccaatgctaaaaaagaaactacattgaaaatatctcaaaattaaatttgaaaatttaaattttggcttattctttggctgtttaggccatccgatgggagcctgcatcttacttttttccatagataaatcagctagaaagaatattgctttgaagagtttttttaccttaccgaccggtctaattatcacatcatattaatacccaaagatgcaaccaacaactcacggcatttctttcaaagggattttaataaaaccatggcaattccagctaatacacgaaatgctttcccttttgctgcctttgctctttcaccgttgttgttaagtgtaaggctctttcacttaggagtcctagttcaagctaaaggcttttgaaaaggaaagggggagctctagtatgccactaaggccatccttgcacttggctcatcacttggtgccttacaacataatcaaaagctccgatccttgcgacctcctattggacctaaaaggctaaaaccatgaatgttctcccgtgtttgttaatcaaatcactggtccaaagctagagtagaaaattcccgcgcatgaggggcacataagcataggggaaaaagcacccttgatcatgactaaacaagtgatcagagtgtgatgctaatcattttagtaccgtgcggtttgggtccggccacatcattgccttataccagagtctgttcaagaactgatgcagagctgtcacttgcatgaatattattccctagctgatcaatggttttgctcttcatatctgtgggctgtggaactatggttgatatcataggtggccctccaaaattgcactgcattggcgccaacttggcagatagtgtatataaaagttactccctctatcttaaaatataattatcctaacatttaaattttgtttcaaaacataggtacttctctgtttactccttatctcaatcaatcataatcatatcttatttaacattttcacatatttcctcattgtaaccaaccataattatgtctcatttaatttcagttatctccttaatccctataaaaaactctagaagtgcttatatatattttaggatagaaggaatattatgtaaacggttagtgtgttcaacatcaatcctgtgatacagtatcactgaaaactctgttgatggattagatcactctttactgatggcgaagtgtcgcacgagccgagtgactgatatttccctgtggagccttgtcggaagcgagagtaccagtgctactagtgagtgatgtaacgcggcatctcgcatggtccgtaagtttgacgggcgatcgacacgacgcagccgggattgcgtttgcatgcccttgcagccctggaggagggagtgcgtgtgcgccgcggattgggccggagccattgcgtggtttcgtaccagcggcaaaggaaacgtacctgacctgcagcgacgtaccacgtacctatcgcttgccgttgctgcgtgtcgctgctgatctctctctgatgttgatgatgatggtgatgataatgtttgtgttgttgctttgttttttaattaattacttctacctgcgtttattcttttggggttcgtttccgttcgtgattgatgtgatgtttgtttgttcgtttgtttttggagcagggtgtcgggcgaggagcgatttgtttttgatactgacttgcaccaatctatttggaaacagtaggtaagttactgcatctgcgtactttgatttactagtttggaaaacactggagttgcaagaaaatacttctacgtctcctgtgtcatcctctattctttgtgaaatgggttgaggttagccatatgtccaaagattaccaatttatgataaacaggaaacgcatactacgtagctatacgtgtgtcaggttcgtagttacgatcgtgtttcttatagacggaggggtacatgatatggtaacattgatttcgtaaggtttgtaaacgattcaaatacttaggattttattcctataatgccctttggatttaagtgcattataatgtccttttgattttcataagaatgagcttttaaaattatatggatatggtttcctatagcccattctgaaggaaaaataagtatgagttccttggccccagttgatttaaattaatgagctagcagattatggatttgattatagggataaattacatattttaagaaaggttaagttgcattcatggtacattaatttggcatgcgagtgtaatttagtacatgaacgtgagaagtgagagttgtagtgtgataagggtgtgatttagttgaagaactaataagtgagcatatgggtacaacaacttacaagataggttcgattatggtacaataacttaaaaaatgatataacaattaattttttcgagcattttgtcatacatattcagtttttaagtactaattttgtcaatataatcgtgaatatttgcatactttaatttgtttattctagtaattaatatataaacttatgatggtggtgcaaattggatgagcaacgtaattccttattcttatagattaaatttaagattttaaggtaatatatgtagaattactatgtgatggcatattgatatcacgaaaaaactcacctagcattcggtaaccaaaatatttcatatttaaacaagttgatctaccaaaatagtaaattccgaagttcttgtaatagtaaattacactcacttactactgttgtactcggacattcaatttaaggtcttgtactggattacatccacttattaattgttatgttgtgagtgtaatttactcttaaaataaacttaacaactggagtagattgagataagtggtctatcaatgcactagaagatttttttttttttgagaaaacgtactttttgaagcgtgaatatgacctagttattgttttattttcccttgagaagagttattgtttctctccaaacaaaattccttcaaatttcctatgatatatttctcttgaaccatccaaatgcattaatattactagtgcattccagaggagcttttagacctgcattccaaactcatgtgctcgatgttcgatttctaatttttttttccttcctatgttttgagaatttttcttccaaaagagcttttattttggacctactatgagggtcattgcttgcttcaattaaatgactattttctctgttccaaaataaattaatttttagggttcaaaatttgattagaaaatatgatttatactctcttgcctaccatttctccacaagtcgacaagttttccattcaatacccttagaaccaatagttttttaattaacttggggtactttggatttttttcctcactgttatttttttaataataaaggaatctctttattttgagacaggagttgtgtggtgaacatgttttgagtcttttattataccttggatagtctatagtactatgagggaggatagtatggcactctttttgttgggtttcagtgggtcctgttcttttcttcaacaaaagttggataaacttttggatactcgtgacacgcttttgatactactaaacggtatattttgtacgaatattttctatatgaaagttgttctaaaatatcatattaatccatttttcaagtttgtaataattaaaactcaattaatcacacgttattaccacctcgttttgcgtgaaacacttaatctttatcttcatcttcaggagattcaaacaccatcgtgtatagaaatttgctcctttggagagttttagccattttgaaccacgtgaaaagatagtaatgcccttgtccttctacacatcatattagggctgtgaaaagatagtaatgcccttgtccttctacacatcatattagggttgtgtttagatccagaggcgtaaagttttggcgtatcacatcggatatacggatacacatttaaagtattaaacgtagtctaataacaaaacaaattatagaatccgcatgtaaaccgcgagacgaatttattaagcctaattaatctggcattagcaaatgtttactgcaatcccacattgtggcgcaattaggcttaaaagattcatctcgtaatttacacgcaatctgtgtaattagttattttttcgtctatatttaatactccatgcatgtgtcaaacattcgatgtgacagggtgtaaaattttaccagtaaatctaaacggggcctagatccatccatccatctgttcgtcgggttcgttgttctctactctctctctctccccatctcttctaatgtcggtcgccgcccgggatcaagagtaggaggctagtcgtcgctaggctcaaccctccccaccacttccccttctttctttccctgcctttctctccttctcatggtccctccttgtcgccgtcggggagccagagcaagagtctggtcatggaaggacggaaagagagcttgaaaggaggcttgttggccaacttttcgtccgtggagctcaatttctcttgccctcgccagcgacacctagtttcgtcaaacgtggaaaaaagaggccacagaggagcaaggggcattatcgtatttagatgcggttaatactccctccgttcaaaaaaaaaaaaaaaaaccaacccaagaggagatgtgagacaatgaacttggacaaagggctgtccaggttagcttttttgggacggtggaagtatgtgtcaagaagacaaacccgagggtggcaaatcatcggtgtagtagtaatgaagtgagtagcgttttatccattgcaacgtataaactaacattttatcaaaacccaacatagagagtagcatattcgtcttttttcttattattgataacggatttagggtattctttagttctactatttgtgttcctggtcgacagcgatgtgactggcttcatctccaagccctttcaaaccagtcgtgtgcgcaaattaagatagcgatcgcactcaaccccgtgcacaaatttgtcgttagacgccctactactgctgctactactaactactcccggcccctgcctagcactaggaatcttttgctagcctagtggtgaatgctctcactctattctagaaattggtctcagctcccgtctcccggtgccaaagaaatcttttctaaagtttgttggtgtgatgtgaacggtgtgtccgataaatcaatgtgctgctgcccccgggttgaccacgatgtaaaatctttccgtgcgcacgtttttaaaattgctaaacgtttattttctacaaaaattttctatagaaaaattgatttaaaatatcatattaatctatttttttaaaaaaatagctaacacttagttaatcatgctctaataagtcattctgttttacatgtaatgtgtatgggatgagtttccaactcaatattggaaatgaacctttttcaaaatagtcaattggagcactctcggcaaaagtgacaccaggcaaaagtcaaattcgtcctactcatgcattgaaccgttgcctacacccgaattacccttctcaatcatattagagctctaacttctaaatttagcttcagaagttaagtttggagtatagttgtggagcagcataaacccaacttcacatctctagtacatttttgtgtaaatgttttactcaattccgctcctattttaggtggagctgaaactatttggctgggctctagctccacgagaggtggagctggagttgtgctaaacaagcctaaatcaaacatagtgtggagcttaaacattaatttgtaaggccaatgtgaaagtatgtgttgaggtattacagtataaaactcaggaactacaatgcaaatttcctaaagctggtgggctggtgaccaatgttagcctctactccatgagggcatgttcaatgcgtgcccctggagattatccttagcacactccatcgatggccgtttgcttttttgtccatgccgtcctcttgcgatggaacgtgtgcctctgctggggacgtggccctcgctcgcttttggcaggggatgcgcgttgggcgcgagcatggcttgtggacaccgttcccaccgaaaaatttcaccttccaccccttgcccctctcactcatcgccctcacggacgccggtgacgggagagagagggagagagagaggccagcagcggtagcggcgagggagagggagagaggtgagagtctgcggtgagagggagaggacaatgacctggagacgatgccgacgacgacctgcgtgacctcctccgccggtgccgcgacctcctcctcgatgcggcgtggccggcgtcgctccattcgatctagccgcgagggggccagatccgcacacgacggcgccaaatatgctgcctccgaccgccggcggtgacggaaccgaggtcggcaacggcggcggggcgaggctagcgcgaggcggggaggacaatgacggccaccgcaacccgcgcgccactcttcgtcggcggcggcgacgggcggcggcgagagagaggtggcgaaagggagagagaggatgagggagagagccgcgacgcgtgagagagggagagagaagggagcagcggcggcggatgggcgggaggcggcggtgacgggagagtgcgggaggaggcgatgagcgatggtgagagagagggagggagaaagcgtcggaggaggtgccgaggaggggtagttgaggaaatttaataccgtgactttcgtagggatacccactgtgagctagagtatcttcatccagttttttcggattttgaggaacccatctagttgtggcctttattgagagacgagtgtccatatgagtgtcttcagtcagagaggacaccctgtgtcttccattgtacatgccctgaaggaactacaatgcaaattttctaaagttggcggggcggtgaccaatgttagcctctactccatgaaggagggcagggtagggtgggtttcgtgtcccttgtctttcatcgctgcacaaagaggagggcaaagttgtttgtcaaacttgatggccttcttcatccaactcttgttggagaaaagaacgggaactatatttcaactattgcataaaaaaaatctagtacggaatgtgatacagtctagacatggttctttttatgtgacgaagaaagtacattgaccaggttgccaccgttgcagatagagtaaagcatcgtgctagtgcatacacgcgcaagattataactattcacttcggtggttcatcatcgcgtgcatcgtgatgtcttaaaaaaaggggtaaggctagtgcaaacataagggttatcatacttttaacttgttatcacatagatgaaccatcctcacacacacaagattataactatggcaaaattggttatatagcatcgaacttcggtgagaggatttttcccctccatttttaaaaatttgtcgctgagagtttatatctcaagtttggccaatactattttaattgtgagtttgcatatacttagtagttatgcattacatcctaaataaaaccatatagtttttatttggaaaaaagtacgaattacccccctagctatcgcggtcgtctgaattacccccctgaaccacaaaaccggacattcttcacctcgaactacacaacccggacgaattactcccctcgacccaatctgcggtggttttggtctacgtggcatacgcgtggtagtccagtcagcgttctattcattaaaaaaaaatgtgggacccactctcttctctctctcactctcactctcactctctgtcatctttctctctctctcactctctctctctctctctctcacgcgcacagcggcgaggacggggggccggaggcggcctttatgatagcggcacgcacgcacgtgaccggggaccggaggcggcagcgaggacggcagcacgccccgcgtgctccgtcgacctgcgggccacgctttccttccttccccttcaccttcccctccatcagatcggtaccgccgccgcaggagctccatcacgcggcccgacgactgacacctccacctctgggaaggcgatgtcctcttagccgtgctccccacaggttggtctgtttggctcggcttcgctggctcgttttactggtgacgcacggctagttttcgatgtaatgtctcattgaggtggcctgactgcttgcatgatcgtttttgcatgttgttgggcagcgcgatgcatattgggaggccgtgatgcccaacctgaagccatcggtgaccacgacggcacgagctttggagtacagggaggagatcctcagagcgctgcgccgctgcctccggggcctgtccgcgtgcgtgcgcgccgccgcgccatgcgtgcgcgccgccgcgccatgcgtgccgccgtgcacgtctcggccatgccgccgtcctcgccgccacctccggcccccgtccgcgtgcgtgcgcgccgccgcgttgtgtgtgccgccgtcctcgccgccgtgcgcgtctcggccctgccgccgtcctcgccaccgcctccggcccccggccgcgtgcgtgcacgccgctgtcctcgatgccgcctccgaccccccatcctcgccgctgtgtgcgtgagggagagagtgagagcgagagagagagagacgacagagtgagtgagagtgagagtgagagtgagagtgagagagtgggtcccacatttttttaatgaatagaatgttgactggactgccacgcgtacgccacgtagaccaaaaccaccgtggattgggtcgaggggggtaattcgtctggtttgcattgttgagggtgaggaatgtccggttttgtggttcaggggggtaattcggccgaccgcgatagttcgagggggtaattcgtactttttcctttttatttattaaagggtggatagtctatgtctcacttaaggctcagcttggttcttatgtttcaatctgctcttcttagtcctttaagtttttgttttaattcaaactcatccttagacctacttaggaagccagataactaaatattatcaacatgtctcgattaaatgatccttttacccctcgttcatatatatagaaaataaaaaggcttactatcaatacggtgtaactgtatgatgaaaactcctatagatctgactatcataaatacatctaataattatatgatgctattttttttaaagagtaaagtgcacggacggtccataaacttatattggtgtgtcacctaggttcttgaactctcaaaatgcatttttgggtctctcaacttgtctcgggtgtcatataagtccaaacgggctctaaaccgctccgtgtgctgatgtggcatgccatggtggtgcctacgtgtcagtagaacccaacccatatgtcagtcacatatagaaaaaaaattaataacatatttttctcctctctttttcatttatttttcaaaattaaaaacttccttttctcctcaatctcccctcttttaaaattttattttttatatgtgagtgacatgtggatcccacagacacataagcgttagcgtggcatgccacgtcatctcacgaagtgggttagaactcgtttggagctatatgatacccgagacaaactgagggacctaaaaatgcaatttgaaagttcagggacttaagtgacacacctgcataagtttagggaccgctggtgcacttcactcaatttgcacacaatgatttttttttctataagtaatgcaaagtaatttatattctacgaaagtaattatgtatatgatactatagttgttaaagctcaaccctttgtatgagcaggttaaggttgaaataacgggaagcgttttattcatttttattctcttttgtagagtatgtaataatgtaaattaagggtaaaaggatatttttctaatacaaccaatgactaggatcagccatttggcacaccaagtggtccaaatgatgatttagggcctgttttaaactacattttggattggttaaatcctcgattttcgttagtcacttaatatgaaaactttttatatagaaattattttttaaaaatcaagtaaatctagtttttaagtttataataattaatactcctgtacgcctgatcatccaaattatgttacttgttttcttttctgtacgcctgatcatccaaaacacaaaccaccttgaaacgtacgcagccctaagctaaaaacaaatatttaaaggatatgtgtggatacaataaaaagataaaaccgatcaaattaagtttactagattagttattcacccttcattcttcattaaactttgataatgtaagagctattggtagtcaaatcaacatcattacgaagtaaggatagctcaattagttaggttttttttaaaaaaaatcaacctatcctgatttaaatcgtagatttgatatgagtgctcgtatttatggttaatttttttagtggtacctgttgataaataggatgtgtgtatttatagggacgagtatgcgaacgtgtgtttagaaaaattaaaacatcatcgaccaatagtgttgggcaaactctaggccagcagtatggtggtggtgaccggtgcgcggcaatgcacccgtctctactcccccacttggccccttttatgggcgtgggccctacgcgtgtgcgcacgaggaggtgaggtgagacttagagagagagagatagaagggactcctctgctctgctctcctctcctatatccatccataatccattcctccccgccgtggccgtcaccgtcgcccctcgccggaggacgacgacgagacgaacaccaagagactgttccaccatacgcaatcattacacagacgtggggactatactatactatactcctatttaggtgcggatcaacactataatcatcggtgtttaactttcggtaaaacctatagcaaaattgtttatctatatactataacatcatgtt

SEQ ID NO: 39367 - DNA, 33761 bp, Oryza sativa
  unsure (1)..(33761): unsure at all n locations
gggcatgggtgtgcatgcatggtgcaggcacgggagcgcggtgttcaggtcgcacctgttcgggtcggcgacggtggtgacggcggacgcggaggtgagccggttcgtgctgcagagcgacgcgcgggcgttcgtgccgtggtacccgcggtcgctgacggagctgatgggcaagtcctccatcctcctcatcaacggcgcgctccagcgacgcgtccacggcctcgtcggcgccttcttcaagtcctcccacctcaagtcccagctcaccgccgacatgcgccgccgcctctcccccgccctctcctccttccccgactcctccctcctccacgtccagcacctcgccaagtcggtacgtcctccttcttctccctctccggcgagctcctcgacgagatagagtgggtggatgaattggaggaggagcagagtgggtgggcgtgggcgagcgccggcgtgcgtgcacacgtgcgcgcccgtgtcaccacatggaagtaacttacacaaggccgggaaagggaaggcccaaaaggagtgggcccaatcacacacactctctctctctctctctctctctctctctcatctcatattctgactctagagagagagagagtggctcacctccatgtgggccccaccccatcggagtagagttaccactaccagcagccgaaaatccacgttcctgttcgccaccagagcgtgtgtttgtgcactcgtaaatgtttattttttctctgcgtattcctctggaagagatgcaaatacagtcttgaacatttgtaatttttagagatgaggatggaacgaaatgtaattgcaagaaatggtgatgaaatgcaaatgcaggtggtgttcgaaatcctggtgaggggcctgatcgggctggaggcaggggaggagatgcagcagctgaagcagcaattccaggaatttattgtcggcctcatgtccctccccattaagctgcctggcactaggctctacagatcactccaggtactctctctctctctctctccctctcatctaagttctctttctctctctacctgtagtactccatgtaaacctgcactgcaccacacattgatctctactactctcttctgtcagccactctgtctctcctttatgtctgatgttgctcagccctactccatgcagcatcagcagcagcatgatcagtgtctcagctgccatcaccattaacctctcttaatatgttctctctgtttcacaatcttggattaaatgtatacaattgcactcgatccattgcacatttttgacacattattgtgtgtgtggtcatcaggccaagaagaagatggcgaggctgatacagaggatcatccgggagaagagggcaaggagggccgccgcctcgccgccgcgggacgccatcgacgtgctcatcggagacggcagcgatgagctcaccgacgagctcatctccgacaacatgatcgacctcatgatccccgccgaggactccgtcccggtgctcatcacgctcgccgtcaagttcctcagcgagtgccctctcgccctgcaccaactggaagtaagcctgtatacctgaaacctctcttacaacacagtaagctcttaattggatcaatacctgcatataattagatgctagagatgaatcctgaacagaaaagaaaaataaaaccataccctaggaagtaattaaggatcctctgttgctgggcatgggcagtcagcaaaaagggtccagaactgaaaagagttggattttctttcttttttgtctgaaaggaacatgatcaactattcattttgtcagagccatgtgttgtgcatgatatactactatcactattgtctactacacacaatggcagaggatctgtgtccccaaacaaaaactagatcataaaaagcctacgaataagggagagatacgtaggtgggcagaagggatcagcagcatataaagggttgtgccaaccttggtccatccctttcttgttggcatcttagagctatcattattatttgttatctaatgtgccatctgaaaagaaatactactactacttgtgtttggaccaatctttgcaagatgacgtgcgttgcatcattgtcaatgtcaggtcgggtacatacatatcattagaacagagtcgccttctcacaaaagaaaaggcttactatcatgatgtatcatctacttacatatcattagtttgtgctattatgcgttttttttttctaaccggctataaacgcatgtgcaaggaatagtttttttggttgaagtatggagggttttttatcaactggggaaaaaagaaggttacataatttggctatttattctatggagattagaaggcagcagtaatatttcctagctagcatgtcctattacaccagtagcattgtgtcatatgctagattccatttacatcactacagtgctaagaaattactcgcgtgtcgactgtgtttctgttttgatgccatgtgagcaataaactcattgaaacctctgcatgtctaccactgttagagaacatgcatatcgcggctgaagataaaatccaccgtcagtaattacttgttgtaacaatgatgaataataacaccaatcacattctaatgctaccaggaggagaacatacagctcaagaggcgaaaaaccgacatgggtgagaccttgcaatggacagactacatgtcattgtcattcacacaacatgtaagtatagttcattaacactgtaacataaatttctatagctcaaaatctactggccccgtgtggtttttttcccatgaccccatgcgatttggaaaattggagtgtaggtgataacagagacgctgcggttgggcaacatcatcggtgggatcatgcgcaaggcggtgcgcgacgtcgaggtgaaggggcacctcatccccaaggggtggtgcgtgtttgtgtacttccggtcagtccacctcgatgatacgctctacgatgagccctacaagttcaacccatggaggtggaaggtaagaaagagccccacatttggtagagatgttcatccaattgctacccctttaggcaacaccagcataataaggatttgatgagtgcggttttggtgggactcctaacatgtgggcttacttctatatcagtaatctcatgatggatttgacattgccttgtactaacacttagtattgcagaaaataacagagattccctcaaagttgcattagtgattgatatatacacctaggcagaagtcaattgaatctcccaaaataactggatttggtagttctttgaactggtaaattcagacaacataagcttaagctgtccaggaaaggaatacacaccctttttttccctctattgtgtactttgtgtaagctctgaaaatgatatgcaaataattaatctaggcaaatgatggtgctgtactactgttgaggcatcctatcattatgatttgatttgggaagtctaataatgtgctaattggtcaagaaatcaatcaatctcaacaggagaaggacatgagcaatggcagcttcactccttttggtggtgggcagaggctgtgcccaggcctggatctggccaggctggaagcttccatcttccttcaccacttggtcaccagcttcaggtatggatcaccacatctcaatcttggccattcttagtgcagccattgattccaactccttagctttgtttcatgatcacttggcaacaatagcttttttttctttctagataatggaatacaaactacaacttttgcataattttccatgatcgctcggcaccgatagcatttttttctagataaaagaataaaaatcacgacctctacatcatataatgaatggaataaaaatcacggcctttgcatcatataatgcacgcaaccgggcaccaatggcatgcatctcatgtagtcatgtccctatcatttggccatgccctcttcgcatgcacattcatgttcctagtaataactaatctctgtagaacaatagaagagcggaacagtagatgaattatgcgttgattgacagaataattgtgggggggtatatagatcgggtacgtacatgaggatttgaagatcaagccgaatctttccagagataaaaaaaaaagaaaaaaattatgtcagataataactggtcctaatacgtcactagggatagcatcacgaggctttctcccatgcttatacctcctctgttatcatcttccttgagggagtgatcttactgtgcttaaggaggtatctaaagcggtggtgaagccagcgacatcgtcgagcccggataactaatagtgttttgtagtgatcaatccatttttacacgcgtcaacggtgattggtagtggagacgccgacagcgaagcctagacggtcgttcgacctggagccgtctccacctctgatcgaaagatatagtatggtattttcgcctctcacactgggagatacaactttcggcctacaaaatcaacttctggttttaaatctaagatatagattatttctagattcaagcttagaaattgttttttttaagagacagagatagtaccaaattctatttctataattttcttaaatacagtaaattatttcttctcgcgaggaggattacactgcgtaggaacactaggtcatttttcatgtgaaagaaaaaaatggaagctacgaggaagacaaataatttcggcgcgcggggcgaaaaagaagaagatcaaggaagatacccaaggtgggaggtcggtccagcctctattgcgaatagagcggggtgttgttccgcgcgtggggccacacgtgcgcgcacatgcggcgcatatccatcccttcccccccacacccacatgtgtgcatgcatgcggactacgccgctgtacgcgtgcgtggcttacggcgcccgctgctacagctacagcgcccgcacgtgtcagctaccacgccacgccctgcatgcccaccgccgctgcacctccccttgagacgtggtcgctgggcggtggtgggtctcacatgtcagtacgtctttcgtcaaaaaaaaaattcaactttaatttgtttttttcatggtctcacaaccatgtagcttaccaatgcaaacagactaatctaaaaaaaaaaaaataagcttagctataatgcacgcttcgattaagcaatgttacgatgcgtgtgcttagctcaggatagtgcctatattgacacgaaaatatactacatccatataaaaaaatataagcattttttactataaatttatatatttattcatatttatagctaaaaatacttatattttgggtcggagcgagtatcatattttgattaccagtcgtccatcagctatggagtctgtatagggctacgtcctacgttcgggaggtagaaaatatggtgatttattttatttttttgcggggaaatatggtgatttattaatatatgattaattaagtattagttaaaaacttaaagaataggttaatataaatttaaaaataatttttatataaaaaatcgtattgtttagtagtttagaaaatgtgccggatcgggttgagttgggaaaggaggcgggaagaagcgtggtgtagtaattggcgaagggggtaagaagggggagaccggagacatgggtgtgatggttaggcagccggaatgggctctctatcgactcgaacagttggatgagatgagacgagatgggtgacatgcgtgcgtgcatgcatactttgtgccttgtccggtccgtgactgaactgaatcccaggaacgcgaatataatactgtagcacgcacgcacgcacgcacgcatccagctgatctagccggccgagatgtgccactttgaccggtcgtcagacacgctgcatcaatgtaggagcacgtgccagggtatggtcgctgcatgcctgcctgcaaacaatactatactcctcccataaacaaatcaaactccaacaagagaatccgacttgctagaaaaacatcatatcactttaaacaatggagattggagagtccatcagtccaatgtgtttttctgtcttctttgaccatcttccaattccccattatgcttgtgctgacctctatctaattgatcctaagagaagcgttttgcaacatcttgtaaaaaagcaaatcacataatattactcgtgctttatgtagctaagctacattggatcaggatcctctgcagtcaaagtcacgtgactttgtcactgacattgtgggtccgataatcattgggtccacatgtcttacaaagacaatccggctacatcatcatgccagtttccgtaataaattgaccagtaatttagtactatggactttagaacctggcacatgcatagcacagattcatgcatgcgtgcactgcatctgcacgcatttgcattggttgcacaagcagctagctggcctacatataacatattactgtgttatgcgagcaactggccactgtccacatgaagccagtaaatcaactatcaacattgatagtagtaaagctcttgttcagagttgcaggcatataggtgctccctgcatggtttgctcaaacttaagatagatgatactacattctaaaaatgcaagtatttctggtatgtatctggacaagatggttaggactctagctataacatagaaaatgcttatattagaatacacttcattcgtctcaaaatataaggtattttgatcggatatcgatcccatccggttaaataccttaagtagggagtggcagtggcatcaccatcgatcatgtgttattgataaatgattatgattatgagatctcttatctacaatctctttctgaataatcgacctgctgatccatccattgcatgcatggttgttgcctgacaaggacattgaaatggactgctaattgctgccatggatgcaggtgggtggcggaggaggaccacatcgtcaacttccccaccgtgcggctcaagcggggcatgcccatcagggtcaccgccaaggaggacgacgactagccactagccaccactactactataccgatcaccatactcaactagtagaggagatccatcagatgcatgcatggatcgatgcagatcggtcggtcgagtacgagtagcccacacgagtcgacacatgcatgcaacaagccaagttgcacacaccaagatgcacatatatatcatctatatgtcgatctatactgctacctacctatatatatatatatatatatatatatatatatatatatatatatatatatatatatatatcacacgtgtactagtactactctagcaagggatatgatcaggaggggcaagctctgagcaatggtccctgcaagatggccagttgctctagccattgatagaggtgcttacgtatggtgtaattatacaggaagggtaggccagcattagctaggaggcagctttgttaatttagccaacatgtattgatgtataagctactgatcgattaattaacagtactactattgtagaactactgctcattggcctttgatttgatgctggtgctcatactatattagtggtgaccactcatactatagtagggttaatatgtgtacatggaggcattggtccacaaggagcaagtgaaatgaatcaatgggcacaggaaaagggaccctatgcaagcagcaagctgataggactttgaccactgagaagctgggggcctggggcagtgtggtgcagctgcggctgcatgcatctgctttgctttggagtgggggaaggaagagaagaagagataagcatatagggcctagagagagaaatccagcatggaacatactgcactgtagtatacatacgaatacaggacaggagaaagagagaatggactggtgaattgagtttcccttgatgtagcccagctttttgtgtgatcttttctgcaaggttcagctgcagacttgcagggggggtaaaagccactggatccttttgggagatatgccttcatcataaggctgatggttaaggcaccacacaacaaatgaagagcaacctaggggaaccaaactcaggttgccaaacataaaacgtcgtggctaatgattcgtctcaagagtcaagatcagatcagctgccctacttgtttgtttccctttcttgagctagattttcccggctttggaacatttataccactgaacatgtatcaccgcctttgtcttcctcgtgtcagatgctattggaaccctcatcttctctcacgaggatgatggtaagcatgatagctcgatgtcctacggcacgaaaatatgggtgacccaagatcaaatagcggcagcacaacgatctaacataatatctggactggacctcccttctgcagttccttccaaggtatgcccagtagagaggctaatgagcccagcttttggggagcaagggaggcaggcacgcacacacgcttgccctgccctgccttttcaattaactctcatgtggcctaatggtccaattaccatgggctccttactttcattaactctcctgtggcataatggtccaattaccatggacaagcctcctccgtttatttctttctttcctctggcccacccgcatgtgtgcatgcttgccaccgtgcttttctaaactaaagttgcataggatctccctcttttttggaaaccactacatttccaaaaccgcggccatacatatcaacagatgattacagaaaacatgctaatatatgcagcagcaagctcaactacacaagctttaaacacccctctcttattagcattattgaattcttaccatattgccaagctgtacggtttgcagctacagctcttggaccaccagagaagccctcctagcgaaccaaatgcatccccagatttattgtagctctgcttcaagacggtcctgcaacagaatagtacaatcgcaacaaaaaaataataataataataatacggctcaacgtgaccaccacagaaccaaaagaacatcgaaatatcaagctgcaaaattttagcatagttactggttaatacacacaaataatacatcaggtcatgtgaactaaggcatgtacatgaaccaacagatggactcaataacatcaaagcagataagatgcttaaagtccaaatcagtccactagctagacacaaaaattcaatgatttgttcatagccatgattttaagccccaaaaaactacccaccagaaaagcctgaatagtagtgatgtcatgaaacatagaatgaaaactagcagattttgcaaaaagtagttaaggcgcaaacagaatgcaaactgtggacctacattcaaaacagatagccaattggcactaagagttacggattgatgtacctatggtgataagattcatacaaattgtggatgttaacaaagtattcatggaccacactgcagcaaaagggtctctcttcatagaaacaaaattcaggtttctggttatcatcatatcatgccaaataactccaaatgacagatgtattagatttgcaacagcagcaaggaccacaaatccattgttctggcagatccttgtttaccatattatcttggattggtacagtaaaaagctggtaagaagctgaaggccgtactagcaaagatgtggatatatcaatagcagccactacagagggaaccacacgccctacagggccagaaatttcagactgcaatttcactccaggacattgacttatgatgcacagcacaactgactatgggacaaagttcctaaacccccagtcccagcgcacagagatgtttctcaaatactgtaaataactgcaggaatagtatagatacatatgaagagcatcctatgttcgggagagagcaaaaattaaactgtcttcataccagccgcaccgcatggccacaccagacagcctacagttattgtcacatggcgatcatgagctgttggtttggctttcagaactcagaaggcaagaaaaatcatactgtccaagaaagccatttcagttgatcaccacacagcagagaaccaaaaggaagtgtaaattgggaaaaggagaagatatgcagagtaggcatatattgtacaatgctaaacaaaatagtagtgaaattatgccatcagtgttcaggcaatcaaaccaaattgcatgaaaccaaggattcatcaatgtctggtcaaaatcggtaccacaaatatgattaaatgatggtctaattaactatctttctaaatggaaatcaaaagggcttcatattaacattaatggatccaaagtatgagtcggcacactgaaaaaaatatgatagagaaaccgttctaataactgtaagcaaaatattatatgccaatgccacagtttgagctattgacacagtggatgagaaggacccagtcatatctcataaaaggggcatggtgtttaagttatataaatctacctttaccgatcattagttaaaagattcagtgagccagaaatacacatagccatccacaaagaaaggccaaacattgctctctgcaataacaacatatgaaaatcagctccatgaccggccacctccataccctctatatctatcacggtggcctgcaaagatgtgacaatagtcagtcacattcagaattttcaaattcttaggcagcactataggtgaaaagaaagtaggcagaaatcagaatctgtaaacttgcttctacaataatttgaaaatagttagataaacagagagcttgcctgaagaagggggtggtgcaccacgacccatattagctaattcagggctgaccttttgtccagcttcttctagtatgttgatcagatccttggcaaatctggcattagcagcagtgaaaaacgtgtaagctgttccttttgctccagctctgccagttcgaccaatgcgatgaacataatcctccaatgatcccggaaagtcatagttaatgacatatttaacatccttaacatctgtttccagatataagtggcattagtttacagaaataaatataattcatcgatctgggaggatttttgtatacctaagcctcgagcagccacatcagtcgctgtcatgatagggcttttccctgatttaaattcagaaagaacccaatccctctcagcttggcttttgtcaccatggatagacagagcaggccaaccatccatccgaagctgtctagtgatttgatcacatcccttcttcgtgtccataaatattaatatccggctgccatccattatatcctccagtagattaaccaaccttaacatcaaagaatttcatcatcaatgcattctgaatgaatcatttcagtgtgtaatgaagagaaaaggtcacgcggatcctacttattgtacttctgactctcggataatatctccacatgttgagaaatggcatgattagctttcaactcctcagaaccaattatgacctgcagcacaaaaaaagcaattgagttcacatgaagcagataccgtagtctgccataaattcatctgcaaaatgatgcattggcaaaaataaccaccttgtatgggtcgaaaagaaagttccttgctagctgttcaacttcctttggccaagtagcactccaatataatgtttggcgatctggacgaatctgaaaaggcagatggtaatcccttaacactatgtaaaacaatgttggtatgttgtaggcacggttcatggaggaaaactctgcctatggctgggcagtgttggctgctagggatgagaggactaggttgatgcaacaaacttggggagagattataggttgatcttcatctgattgattactaatggatacatgctaccctttcattctgttgacagtgtataagtaaaagcatgtaacatgtagcaagcataattattagaaaattgttgagaatggaataatagattcagaagaagaggcatacctgagaaacaattttcttaatctgaggttcnnnnnnnnnnnnnnnnnnnnnnnnnnnnnnnnntaaaacaaggtaagtgaccctccgcaaatttgtatgatgtgattctatcatatcaatcagtcttcctggcgtggctataacaatttcaacgcctggatgcaaacagtgacaaattaaactaaatatactacacaggatgaatgtatcatttaagctatagatcaataggatgtccttttgaacagtgtcatttcattattgaccaactgaatgtccttcaaacattgttcatgacttcatgcgtgcagtacaaaagattccttctggttgttgaacttcctagcataagaaagaaagagaacctttttgaagatcgcgaacttgaggaccttttggaacaccaccatatatgcaagtactttttatttttgatgacgcaccaaacttagttgcctcttgctgtatctgcacagcaagttcacgtgtaggggctaacaccagaacaattggaccatcgccaggtgctttaataacacacggaaaaatgttagtagattaccacaaaagaagtccagaatgtatccaagaaaatcggttaagaaacataagcaacatttcgcacctagaatcggctgagcattaacatgaacaatggcaggtaaaaggtaagcaagtgttttccctgatcctgtttcagcaatgccaataagatcacgtcccctcagtgccattggccaaccttgagactggataggagtaggttctacaaacccagcttttgtaatttcttgcaaaacatattctgcacaatggaagttaagtatcttggatcaggaaatatagaatgtaagatgtccaagattaaaaaagagcaaaataataaagaatgtagttcagaaggtaaaggggctcataaattatcaatggctcaagtccaagaatgcaagcagaataatctttgaagagcacaacagatcttaaatgaataacaagtgacatattcatatcctttcctcctgatgaatgaattggctgatgaagtgatgataatgggatttaatgagaggaccaacaaatcctaatcggagttcaaagaaaaccaaatgatactttcaccatttagtgttcagcacttgagctggttgcacatgttatcgctgttggctgtttttctttggaaaaatcattttacaactgttaatcatggcctaactccagtttccaaccctcaacttcgaatagttcaccttttgaccattgactattagaaccacctactgtttaacctttggcctcattctagagtggttctgcagttacatgtcactaatgtgacaatgtggctcaaggttgaaatagttttgagtatttacagccaaaacaaattccgccaaagcagaaattgtggtgtgaaataactgttatgatacttcaattctttgatgattcaatgtagtttacaacacaaccagctaacgaaacaaatagacctatacattcccctcctgaagcacgtccatctaaattccaattcctcctggagcacgttcatctaaattgcatacatagtactatagtaagtgcaggacaagggtagcagtagcacgcagcaaacgaaacctgggaatccgacatcgcggaactcgcgcactggcttgggcacgtcgcggccctccacggtgatctcccggcggcgccggtaggcctccacctcctcctccgtcatgccggccacggagggggactccacgtagaagttcttctcgaaccgcggcagcccatccaggtcagcggccgcggccgcggagtccgccttgctcgtcggggcgaacgccctcgtcccgcccccgaacgccccttcgctgcaaccaaaccccaacccaacccaacgagcaatcagaacccccaacacttagggcttagggtttagaaatcaaaaccacggtggtggagcggttacctgcggcggtcgcggtacgagccggggtccgcggcgcggccgtcgaagcggctcatggcggcggcggcggtcgccggcgacgagagggaggcggggggtgcggctagggtttagggcggggcgcacgtggccggagagtttggtgggttctagaagaagaagcgaagcaaacggaggacgcgaatcgaatttggaggatttggatttggagggcatttcagtggcggcgagttcaagcggaggggaaaagtgtggggagaactgatggagcctatgacgtcgaaaacgtactctgaaaaagcacaaaacccaccagaaaaacgtaatactccctgtgtcttggtgttttttttttcaaaatattgttttcttcgcttcttaaaacggctcaagatggggaaaacgaacttttgattgagccgcggtcgattttaattaaatttagacctagataaatggtttatgggtttcttcatcttccttctttaattatttttcagccttttgactttggactgataacagtagaattgaaaaactacgaattacccccccaactatcatgatcgaccgaattaccccccgaaccataaaaccggacattttttaatcccaactatgcaaaccggacgaattacccccctcgacccaattcgcggtggttttagtaaacgtgggagtacagtcagcaattcttttaatataaaatcagtgggcccacctgtcagttcgccacccctctatctctctatccccaatcccccccctctctctcttctccctcccctcaccagctcaccagcatggcagcattgagaatggcgacggaggagtggagggcgatgctcgggcgctggcggtggcgcgcggaggcggaggttgctcggacgccgatggcgcactcgtgcaaccagcaacgaaggcggaagcgaaggcgagtagcggcacgcacggggcggccatggcggagaggcgatcataccacctgtcatacctcctcccccctctctctctcaggcataaagctcgcacagcggtcggcgtgtgggcgccggtggcgcgcgtcagacgggcagtcggcgtgcgggcggtggtggagtgcggggaggacgcggcagcggcgggcggcgtcgaggagggtgttggaggacgagggcggcaggacagcggtaggggcggatggagcttgggggcggcgggcggtggcggaggccgctcagggcatcgaggacagcggcggacagcagtggaacgacggcgagcgagggaggtaggacggcggcgaggacagatgtagcttggggtggtaggatggcgacgggcgatggtggaggccgctcggggcgtcgaggacggcgaggctgaggcagctcggggatgggcggcggaccgcggactcactgccggagcccgatgttgtgtccctcctggcatccctcacccgccctattaagcagaagaggggaacaacgctgcaagcggtggcagtggagtgggggcggcgacgaggggacaggggaggaggagctcatcctcggccaccgacggggtgcgccgcgagctatgtcactgcccccattatgcccgctctcccgacggtgccacacatagagagagagggggggaggaggagggaagccgcgccgagggggtgactgctcgtcgtggccgcatccgccgacgctgcctcctcgttccccgtccctgccgccaccgccgctctgtgtcccccgcctgccaccgacccgtgagagagagaagagagagagaggaagagtgagacagagagtgagagagaagagagaggaagagtgaaagaggagtatgacaggtgggtcccacacatttttataaatagaatattgactggactgccacatattatggattgggtcgatggggtaatttatccggtattgaaagcatagggtaaacgatgtctgattttcgggtttagaggggtaattcggtcgaccgtgatagttcccggtgtgtgtggggtgaggggggggggttggttaatttgtacttttcccgtacatttttatcctagttcgtttttaccaatcatgtgtttcgacttactagacgtaaccgtgatggccaccgacgttgatgacatctatgggcgcaaatgcatcatgcaccttcttacaggagatgatgttgatgttcctttcttcaccttgctgccttgagagttgagaccacaaaaatactttccggctatggtctctcagtttgtacctatgtctcgtgaatggcagacgaaacataacatttcatgcacaaatattctattttgctttcccttctcgtcatcgttgaagcatgctaagagtgatctactgttgttatgggtggggagaaaaaccttgcataccgtggaccgtgcgaagctggtgaatataaataggctctgtttatttcacaaaacaaaaattctcacgctgtcatattgaatgtttagatacatgcataaaatattaaatatagataaaaaaaacaattacacagattgtgtgtaaattgcgaggcaaatcttttaagccttattgcgccatgatttgacaatgtggtgctacattaaacatttgctaatgacagattaattaggcttaataaattcgtctcgcagtttcctggtggaatctgtaatttattttgttattagactacgtttaatacttcaaatatatatccgtatatccgatgtgacaaccaaacctaaaaattttccccaactaaacaagtcctgattagcaaacaaccttcttttacatcaccgtccgtacgttgcctccactcctccgaattgtgtccaagttgaaattttcacatgcaagtacctcaagggtgtttcagatatatttccttgtattccctctcttcaccaaacaaaatgaacaaaatagtaataactgtatccagtagcaaatatttaacttttgataacatctttcacgatgttctataactaaaaccacgaagtcacaatgtcaataaaaaatatcttattggaaaaaaaaccgttttgacaacaaacacacatgaaaacacttgaacaaactttgactgagatcttataagcatttctcacgataaccaatgggttcaaatcttttcgccatcatacgttgcaccggttactcttacaaataataaaacatcctcatctctgctattataaaaaattgaagatatttttatcggtacttttgatacatcatccgtgtttaataggtttttaagttcaatcgtttttagaaatacaaatccatctttgagtcggtttttaattttgttcgtttttaaaaatacagaaggagtcgtataagaaatctctttaaaaaatttacatgctaacttgagacgatcggacccctaattgcggcttatgattttgtaaaaagaatatccaagcgaatttccacgataaatttcaccttagctaaaccgtataataataataagattaaaatagtcttcacccgttgcaacgcacgggtatttttctggttgtataataaacttatcatgacagtaaattaaagattggagagaacttagctaatatggtggtggactcagacgtgggtgggtatgaagtgatcaagagtttatgctaggcctttcggcagccaaatacatagtgaaagtaagagcaggtataataacaggctataagtcggctgtaaatatattttaagaagataaataaggagagagaaaagcagcgggctatagatttgtagccatatgtagcacggactccaagacacagtgtgtgtataacaggtgagaccaggtgttaattgtgtagtatgtaactattgtatgaatgagttattagattggctatagatgaattggagctagtagttagctataatattaaacttgctctaagagtgtgttcgctagttcccaaccagaaccctccgcacgaaaaacggagcaatccattagcacgtgattaattaagtattagctaacttttttttttcaaaaaatggattaatttgatttttaagcaactttcatatagaaatattttacaaaaaatgcattgtttagcagtttgaaaagcgtgcgcgcggaaaacgagtgagaggggttgagaaaaagggcatccgaacacaccctaaggtagccccactctctcctaaacaccccctaaataaggtagcatgtgcttttacatcgaggcctcatagcggtccacccctgagactgagtctcaatctacccccggtcgtgggtacacgatgatcccatctgctagggtataaatttggtgctcatagacaatgtactattgatgtttttagataatagaagcattgttgtgctcagttaattaggaaaaaaagattcatacctggaatactcttagcctctgtataacttggacgcatgtaaccaagcatacacccacatgctagcttttataacaaaggaaagtatagaaaaaaatactaagtaccatcaatccacgtaatatactctcacctagcgaaagtgaacataattcaaatggttagtttttttaacctgttcatgagtatatctaggttttaagttctagaattagcacgtgtactcgtatttacgtctaattatttaatactgatgacatatctgttgacagtgaaacgcgtatattgaccaattcaacctcaagacatgcttataaagataggatgtgtcaaacgctgaaatgaacccaaccaaagtggatgaacgttcactaaacaaaacacatcacacgtcacgttcaatcaaactcatctacaggctgcaaccaacgaagaccgagtttagttctaaactttttcttcaaactttcaagttttacatcatatcaaaacttttctacacataaacttttaacttttccgtcacatcatttcaattttaaccaaattttcaattttagcgtgaactaaacacacccaaagtaaagccctatatcggtctcttcattctccacctcgatagccgccgagatcgatactttgggtctatttggagagctaaaatcacgagaagcggctggttggttgtcagctttataaaaatctagaaaactagaatttttagtttttaacttccaattcattctatagtctgtacaactataacttttattaagatttaaaaatctggataaaaaattagactgtttaagatatattgattcaagagactaggatgtatttagttcatactaaaattggaagtttgattgaaattgtgacgatgtgacggaaaagttggaaatttgtgtgtatagagttttgatgtgaaaagttttctttaaactaccaactttttcatcatttcaatcaaacttctaaattttagcgtgaactaaaagacatctcagacctagtagctaacagaaacgaaacagatcctttgatgtttcatccttatccgtagaataccttccattgcagctccaccactagaaagtctagactctagagtagctcgaaacaccgaagcaagcgaaagagcatcgccgtgccgcgcggagcttttaaaacgccgcaacttccttccttccttcctctcctcccacgcttcccacttcgatttcccaaccgcactccagcgagagaaaataaaattttaaaaggaaaaagaaaaaaaaaagatatatcagctcccgcctggggatgacgacgagctctcgccggcgatggactcaccgccgcaccaactagcactcatcgtcctcctcgtcgtagccctcgcggcgctcttcctcgccctgctgcgcggtcgctgccgctgtcgcgagggcgaggctcatcagctgcccgagcaggcggaggccggcgcgggggtggcggagggggaggagggcgggagggagaggaggaagcggcggaaggcgaggaggcggcagcggaagggcgccggggacgacgacgcggcgggcggcgagggggacgaggcgctgcagctgcagctgctgcggcggcggccgcggttcccgctcgcctcggtggccggcgcgctgcagcggcggatcaccgcgcggtacgacgacctcgcgcgggccagccaggcccactccctcaccatccatcaggtcagcagtgcgccgcgtctctgattccatatcacaaatgtcgcttcagatgcaaggattttgtgcattgcgattactcgaattagggatgtataaagatgtgactccagtagcatgcttgacttatatatatatacaactgggtgccgttcattgtttgtttgtttgttttgctaattgctttcatttcagactttcaagatagaatcagacttaggttttgatattatggatttaatgatgttggttggtacattttcactagtgcggcaagtattaaatcaatggttttgctgactctacatgcggcaagtttgtttaggacagaaataaaaaaactacactagtgttattcacactgacagcaatatatcttcagggttacagtgtcactgttacctgctgaaaaagaacccaaactagagcagtggtagacttctattttgctgtgttggtaaaactagataaatgcatatatgactttggcactatgcagtactcaggccacatgacagtggtttggcaaaacctcattttatttcgtagtttttacgtaggcagagggccatttcctgtgaagtataaattgcacggcgtggtttcatctggtaggtctgcgtcctcttttgctttcttgggtggcacataaactggaatagattagcacaaaggctgagcgaatgttttgtttgttttgctcgtcaattcttggtgcaactttctaactttattggtgtcattggctgttaaagtgttcacttgccttgaaaatttttagaaaggaaataaatctcaaagttgaagattgaacaacgaactattcaccatattcaccacacgcccttctgtaattcatactgaattcatttactacgtgtatgattcatgagatgtgtgacacaccacctatgtattttagtagtagaagtgctgttccatgctccacaaccccgggtcattgacccaatcgacacacattcatggtaactgtgcacggcatatctaatcagaactgaagcttttaatgaaggaaagcaagcaaaagccattttcttttttagaaagcaccaaatcctctaccattgactcaaacaagtgccaagcaaacggagtcatcttaacccctcccccccaccgcccaccgcccaccgcccacccacctccgcacccacgtggccacgccctcctaggaacaaataaacaaaaacaaaataatcgaaatagatctagatatagcttgtgtgaccggctcctacggccctaccattgagggttcgcctccgatcttctgccggaacccatagccatgaggacttcccttgttcgtttcttccttactatcctcgccaacacgtttctccattccccctaccagcactcctcacctcctgaatcatcccaatgttcgacgccgcttggtagcgagagtggaggaaagaggaggcgggggaggagggggaagcagaagggcttgggtgaggtggtgtctgttcacgagaaaaaggaggcaaaaacatcacctttccccctcctgctgttgtgccgtgcaacgagacggcggatcacagaggtgtatgatgagatgtaccaaattgttcgtgctaaaaggaatgatactggcaaggttagtaatattttcttgtatttgtgatacagctagatctggtggatttatttaacagtcggattttagtttgagttgggaggttggtctgttttgagtatatgcaagaacaagaataggaaattttggtgaatgtgtgaagtgttcaccaccaaattattcatcgcctgtagtttttgtgcaattcaagcaggtgctatcagaatttgcgtttctaaccagtgattcagtgaaattaaggtgccagtgtttccaactttctatttttcgcagatgaaccttgattttctattaaggtgccaattatttaaagaattccatttttatgcatcttatgggggaattttgctacctagctagagttaactactccttacagcctcactaacttggtatggatccaatgtatgatccatgtcataaaaagatcactcttagaagttagacccttgtctttacccaattaagtagtatggagtttctattgtgcttgtttcagtaaaaaaatgattcgtaaagaggaatcaaagtgtcgagtggagctcactaatgaaagggagacctaactgtaagttcataagtgttttttcttgcttttatggacataatcttctttattcatcactttgctggataatgatatgttgagcacgtactccctccggttccataattcttgacgttttggacaatgacacggtctccaaagtatatcgttgactttgttttcctattataatatatatacaataaataaatgcatgtttacttttcttatactttgaaagacaaatctatatatgttgttttagttcctttaaactaaatatttttgaagttattgataatcaaagttacaaaagtttgacctcaaccttgtccaaaacttcaaaaattatggaaccggagggagtagtatcttagctgcttgctctgttcctgggttgatcacaatattttggaccatataatctgattaaatggccacttcttcagtgattagattccttggtctgtgtgctctacattttaaccaactatataccagaaataggaatcctgtttgtcaaccgcctttttgtagtagtgttaagactccagaattttgtttcgagttaagagtgaagccaccaactcaaaggacaacacacaattcatatgttctgttatgctgcctcaaccaggtaatatgggcttgagacaacgttgagctgctcaaaagaaaccaaagcttcttttgttcagcgactatttgtttcttttggcttttagttttctacattctgtaacagcctctacgaattagattctaccctgtaatgttgaagtgtatcatgatttatatagcttttaactttttttttcaggttcacgagttcattaactgtttggtagatgcaagaaatgaactgctgcacaagtatgttgctatttgcatgaaatttagcttcagacatccattactccaaataatgtgttatgcctattaggtcggagatggttcaaagaagctgcagaataaagaaggccttactatccaacccttgtagtcgcagggctaacagttatgaccgcctctgcgaacaggtgatgcatttgacaaaaacaaatttcgtaccaacacgactaagtgatacatttgcgaccagaagatctattcatgcaaatctttgctaacaacatcttttgatgtctcttttatatactgacgtctcgggtattggcataggtgcataaattggaagccgagcacaaaaggctaaagaaggatgcggatatctacaactatattcaagagcagcttcagatgtcagagtcatacaaactggtaaacttttactatgttcttattaaaagcaactctgccctgttatattgaaatatgaaggttgtgataacaatgccatttaccttggcagttgattgagcttagtgcgttggtggagaaggccgaacgtgaggatgcccttgccaccgaggccgcagagatgacattcgaggagctgctggctcaggagaagagcgacgccgccttctggcagcgtcacaggaagctgacctcaatcttacccaagtagagtttgataactgaccgcgcgatttcaccatcgtcaatagtagcccgaacccgtaaccagaatttgttcctggtggagcttttaatgttgctagttgcaaccgtggtgtaatgcgcttgccaagctcttgggcgcctgaaagtccagagtccttgaccataaaacctgagagattcaggtggttggctgacgaccagcaaatgctctcatatatcctatctggtacttcggccatgaagatttcttgcctgtggatgccctgatggaattgagctttcttcaatgcagaaacaactgggaccgagccatttatgccacagcctgcactgatgggtgaattggtgatggcttgctgcttgcttcggatttcttgtttctcttttgaggaatggcttgagaaattcagaggcagtagaaggctactaggctagcagtatcatccatggtgcattgctgttcatctttgttcatcttccatctctgcatatagatcatcgagcattccgaagacatcctcagctccggtgagattcggcggcgcgctcccggcggcgaaggcgaccaccttgttgtccacttcaatccagctctgccccggattcttcctcaatccggcctccttcgtcatcaccctcaccttcttggactcgtcccacatgccacacatggcgtacaggttggtgatcagcatgtggttgccggtgctctggtcctcggattgcaggacattggcaatggtggcctcggccatggctgcatcaccatgaatcctgcaggaattcagcaatgctccccacacgcacaggtcaggtctcaccggcatcgtctcgacgagctccgacgcgtcccggagcaagccggcgcggccgaggaggtagaccatgcatgtgtagtgctccatggatggggagatcttgtgcgctctcaccatgcgatcgaacaggcggcggccctccgtgacacgcccggcgtggccgcacgccgacaggacggcgacgaaggtgacgccgtcgggctcaaccgtagctccggccatgtcggtgaacagagcgagggcttcgtcgcacaggccgtgcatgccgtagccggccagcatcgagttccatgagatcaggtccctcgtcttcattccatcgaacaccttccgtgcgccggagaccttcccgcacttcgcgtacatgttgatgagcccattctcgaccagcgagtgcctatctagctcggctttcatggcgtggccatggagctctcgacccagccgtaacgccagtaggtcgacgcaagcggagaggacggtcgccatggtcaccacgttcggcgagagccattgctgctgcattcgccggaacagctccagtgcgcggtcagtgtcgccggacgacgcgaacccgccgatgaccgcgctccagctgaccacattgggcgcgaccgtgccgccgatctgctccatctgggcgagcacgtccaacgccttgtcgcacagccgagccgcggcgtagctggtgatcagggtgttccatgtcacggtgttcttcgccgtcgcgtccctgaaagctttcttggcgtcgtccatctctccgagcttgccgtacatgcagatcaacgagttggtgacgaacaggtagccatgcatgaggcccttcacgacgccgcagccgtgtatcgccttccctttggccaatgcaaggtcgccggcgtaagggcacgccgagagcgccacggccatggactcggcgttcccctcgcagccgctcctttgcatttcaccgaacagctgaaggacatccgcgtgcttcccgctccgcgcgtgcgccgagagcagcgccgtccacgtcacggcgtcgggacgcgcccctgcggcggccatgcgcgcgaacgcgtccctcgccgcgtcggggtcgcagccgctggagtaggcggagatgagcgcgttccagtggaaggtcgtcctccccggcggcattgcgtcgaacacgcggcgtgcgtcggcggcgcggccgagcctggagtaggcggcgaggatctggccggcgacgtcgtgctgcgcgtggaggccgaggtgaagggcgtgggcgtggacggcggaggcgacgcgcggggaggcggcggcgcggagggcgagggggagcgtgtaggagttcggcagcgccggggagagcgcgcgcatgcggcggtagagcgcgagggcgaggtccccgcgggaacggccgaggtgggcgcggaggaggcgattccatgggacggcgctggtggtcggagggtggtgatggtggatcggttggtcgccggcggcggtggagagatggcgcgcgccgcgaggccgatggctgggacgagaggtagagccgcgagcgcgaaggagacagcgcatctgggagtgggtcccacttgccagtaaaagcaaaagttatgaactccggattatattataaatcgattgacttttttatttatcaaacttttttttaagtttaatcaaatttgtaaaaaaaatatattaatcaatacaaatatatcaaaatatatttaatattaaatttaatgaaactaatttaattttatagatgttgctatttttttctacaaacttgatcaaacatgagaaactttaacaacggaaaaaaaatcaaacgacttctaatataaactgaggaatggatggctgaattgaattcagggcaaaaattagcactgcaatctcgccgttaagtacctttttttttaccctcaaaagttaacaaaacacgtacaattctgggttgcttcacaaattacaacatgaacatacaaagtcagggaggggcacatcaatctggaacacatcagggtgtaggagagaatggaaaccaagggaaaaaaaaaaacaaggataaggtagatgagttagctgtgaagaaagtttttgtcagctgcatcggtggccgtcttctgaacattcagaactttgagatgatccctgaccagcagaggatgtcatgagtctctgcggagatgtagaatagaaccaagattagcatgaggcatataacttgcattttgcacaaacgatttcacaggcatagtgtactaaagagatgcttcaggatatgcatactatttactggaagtgtagagcgatcatgtccttgagttgctagacctatcataatatggaaaaaggttgagcagaactattctatggaacagccgttcaaaaaatgtacctgacgatcttaacatttctgaaggacagcatcacagtaagaatcaaggtaaccatcgcgaagcaaaggtgctccaaggaatggccgctgatgaagtaccggttcacactgtatacctttctgtcagcaaggccttcaaatcttgcaagaaggtaaaaacctgcaccaagatgccaatcaaacaacagttttcgttcaagcttttttttgtagaaagagtttctgctaacataaccttactacataagatgttaacggttacctgtggcaagaaaccaaaatcttgagtgtgtatattttggaggaaacaagaatagcattgcaggaattgcaatgcaaggagcggaattcaaaactacccataaccgcatatcatcaagaaccctgaaatcatcgagaacagagcaagaggactcattttattatctgatatactgacatcaacaatggaacacgctataggtgctggggcactattacctttcacatgcgctgctcaccagtatgagagataagagtgatagcaaacaagataacccagccctttcatcaactctttcaattaccaatatagacaacattgaagaagctgatatcatcatctgcgttcatagcatccagtgaacattcatatcgaggaaaaggatagatacatattcattaatagcattggttatgcacgataacatgatagtcagattggctgcctagcacagtagtatggaaactcagacacatccttttttttctctttttgcctatggttaatacttcgatgatattaaggacattcaagtaggtgaactgcattttttgaacatgaactacttaatacagttttttctcccaatggactcgaagcataaaatgacaacatatcaaaaaaaattccaagtccagaaaccatggaaaacaccacgaaataagtaaacagtagatggggaaattacagaaagatgagatatttagataccggcaacctgtcccaaattaagcggtcatcatctggtttgaggtgatagtaagccgagccaaatgctgctgctacattcccagcatagaagaggaaccatcccaaggcctcccatctcaagctgcacaattccacagtaaaaacaaaatattaaacaccagatcttacctgctgatctgtttttctgttaaataaggatagcaaaataggaatatctctttaagcatcatgccctcaataccagcctagttgtacaataagcagtatttcaagaaacatgaagatcacacacttgttaaataaaatttcaacatcaaatttaaagatttgagtacacggtttggtggaacaccctagctcaaattccattatatacccactctataatatagcaagattacagattattaaagcaattagatgaataagcatgtaatagctacaggcccaggcaaagttatactagcatagcagcaaaaatattatttcactggtcaccaacattacagtccatctttctctcagacagaagcagtttattagagccaggggagttcataaccaccctttcactttggtggtaactgtaaataagttcataaccaggggagtagtaaaatgagcagttatgaaacaattaggcacaagctggcctcctctctctaggttttcgagcataatcagggtaaattgacctcctatataattttgttcaagctcgtggtactcgattctcgaatactttaattacagctcttccctcgctgcaaatcacgaaacaatgtaacttcacgcacttctttataatcctttaggcgagacatttcaccgaacagcagccgagcaagggcaaagggcggagcgcgcacctgatgccgaagcacccactgccacagaggcagaggacgagcccgggcacgcccgccaggaggagcgggtaggcggtgagcacgttgagcgtgttggggacgccgaggaggttgcgcatgtcggcgaagaggtggagcgcgggggagtggcggagccgcggcgtggccaccaggagcagcgccgaggcgaggacggcccccccggcgagcgcgcggcgccggtgctcccggcggagcgccgcggccgcgaggtggccgaggccgaggccgagggcggcgcggccgccgccgccgcggtgggggtggtcggcggcggcgagatgcatgtggccagggggagtgctcagtggagcagaagaatgcggtgaattttttctggtgttgggccgccttgcggttgtgggcctgcttttcttggggattcttttttagccaggtcccttccattcatcggccatacaaattagtccctgggattcttttcaagttcggatgagtttatagaaaaatttagaaatatctagagcattaaattagttttatctagtagtattgaatatattttgataatatgtttggtttgtgttaaaagtgctaatatacatttttataaaatttggtcaaacttaaataagtgacttataatatgaaatggagagggaattgtatctttttaatcatcgaccaaataatatttttttaagaaatattgaatttcatgatcttaggattatacagatttgttgtccatctcggattgatatcttcttctccaactttggtgagctcaaccaactattttaaatatatatggcaccattggtttttctctaaattttggccaatgatattattcaaataaataaataaattgaataaaattactaatagatcatcataattaatttaaacgtgacttgtacctcaagtgtatttgcacaattatctataaaaagccaaattaagaaaaccaacgatgtcatatatgtatctaaaattggaaatgttgcatttcatatataggacatttggaagagcggtagagtctgagaaacaagttgcgaggtgtgtgcagtaaaagtctaacaattttggtagtttggagaagtgggagactctcttgaagcagatgtagctacttaaaaactcttctttgcacaacttttccaacttcactatattttctgcacgcacgtttcacaaacagttaaacatcgtgtttttcataaattgtttctctagaaaagctgttttaaaaatcatattaatttcccttttcaagtttttttagcaaattttattaactaataatgcgctaataagagatctcgttttattccatgtggaggagattaattagttcccaacacaaggaaatgaaacagcctatatggtaatgggcatgaggcatagggcaagaggtgtgttcatggcgtaccataatatgtttagggggtgtttagatccaccccaaaattttacaccatatcacatcgaacgtttgaacacctgcatgaagtattaaatataggctaaaaaataactaattgcatagattacgactaatttgcgagacgaatcttttaagcctaattgctccatgatttgacaatgtagtgctacagtaaacattgctaatgacgaattaattaggcttaataaattcatctcgcggtttactaacagattctgtaattggtttttttattagtgcccgaacaccacatgcgacacccagccctatataatatccgatgtaacatgccaaaactttacacccctagatctaaacacccccttagagaaatctaagattctcaaaaaacaagcaatttactagtgagaaacggccaaaatatttctctaatatatatatttctccaatttagattcgcaattgccgagtatcaactgccgagaaacggccaaaatatctctaatagcattaatatttcatatgctatattgtttcaaaaaaattatttcatatgcgatatacttggagtcagggcaaattttactttggcgtaccacatctgctatataagttggggtgatcatttggcgttcaaatatgggaagttgggcggcgtcgcggcggtgaccgaaaatggaatgctcatgcaaccgcactgcccggctgcagatctccggttagatacgcagtactagtacttgtcacattgctatcccaatctttttcttaaaaattcagatcaccaggtactagcttactactccagtgatactaaccactactactcctggagactataataaacatatatatatatatatatttagatttattctctatcaatcgccttaatttgaatcaattatgtgcacatgttgtacaattaattcacgtacgcatcgaccgacgccggccgttaatttgtttcagttaattaaagctatcagctaagttattatgtgagtgcatatatatagtggtttcttgtcatgcgcagacagatcgagtgttccttgtgcaaacagaaagctactcgatcatatttcggtcctcaaattaattaccaattaattaattgataattaatcaagtcgttgttggaactaaacacagattggccagctcaaaagcaaccaacaatgtcgttgttatccatgtgatatatcgatgatgatgtgaatctccggtgtcgttagccgtcgtcgtcaattgtctttctgatgattggcttacatcgatcgatcgagctctgcaaggtatcaggaaaaggccagagtttctttccccagattcgcctgaagatatcctttgcttcgatctccctctttctccatcgatcttgactcgtgatcacgtacgcctttctgggatctcgtgtctcttgtttccatatggatcgatcgatcgatcttacgtcaattctggcttgatacacagtacgtgctggatgtggaagatctgtaagaaaagcgggtagatagctaggtatatactgtatatactccccctgtctcataaaaaacgaatttagatcggatgtgatacgtccagtactatagatctgcatagatatgtatattcaaattatttatagtgctagaaacgtcacattcggtactagatagttttttatgggatggaaggagtaaatatatatactgaagctgcagacgtcaaaccaaatgtgtacgttttttcttcgtgattatcttgcaagatcttcgtaccagatcctgatttaatcgcatatatcttatacggtgactagaaagtactacagcctcgatctttcggagtaaacgattgatactgtatttgtttacacataaagcaaacagctaaagctaacagatttagccgaaacagatcccaaacagtatcatacaaaataaagctagataggtctatatacctatataggtcatgatcctacatcagccaggaaaatgtcctgaattgatgcagtttaatacaaggactgagctactaggtgtatgtatgtgattaatttaaatggatatcataaaatttgatacgatagagtacgatgatacaagctcttacataaacacgtaaatctaaattcgaccaaaaataacaaatgctaattgcactgcagatgtttagcgatgtactacggctagctgatttaacttttttttcctagttgtaaaccgaatttagtttatggacttattttatcatcttaatcgataataactaattttatatttttttaacatacttatttaagtctcctgtaaatatcttaggtataaaataaagtaacttttgtccatatatatatactcctacacagttatgcatgcagtactgttcctttcagcggtagtaccatcggagatctggctcggatctagcttgtacacccaacatcgagcactaataattcaggataggtgacaagtcgtcactctcacagtacagattgctactgctgctgcatgtcgcacaaaatctcttcacgtcacaaatctctccacgtcttcatgacgtgaagagattttcaacgttggattttccatctgtactacgtacagcgctgtacgtacgtgcacgtagacgtacgggccccgttgtcacgtactccctccgtaaaaaaaaacttaatctaagagaaaaatgtaacccctacatcttctcccggtataaatttaaacatatggttgtctagattcgttatattaggaggtgccacattcgattcaagattgaatttcttttggactgatcgagtatgtgataattattagtataagctgacttcccttttcgtgagaaatactgtatgagaatggactttggagcatctagatctctctcccccaaaacaaaactctctcacacacacatatacatatacatatacatatacatatacatatacatatacacacacacatatatacatatatatatatatatgaatgaatttagatatacaagtattctagaagtaaatttttttttcttggacgtaaggagggatatcttactagcattcatatgcatggaaaaatattgcaaacttataatacatataactaagattaatttagtttacacccacaagacgacgatagatatgcatcatgatgcattcaagcatgccgtacgtttgagatcgacatgcatatgaaggcatccatgcatgcatgcaaattggctggtagtacactagtagtacgtagtactgtactatatatttacatacatgacctaattaattaattaaaaaccaacttcttctaatcatacatgcggccacacacacgtacttatcacctattagttggcatgcatgcatcacagtactactttgcctctccttttagtaggcaaacacactacttaattatctcgcactacatatatactactactccattatttatattagcttgactagagcattgt

SEQ ID NO: 39368 - DNA, 9780 bp, Oryza sativa
ttttttactacttgtgcaagttgagtttaagattacaatgtttatatagtgatatataatatatttatgtatcatattaattttttatttaaacattttaataagttttcagacgacacgcacaatatgaggggtcgtcattttgaacgaaaaaatccaccccgtaaaaattatatacatgtgtatatgtagtaaagctttttattattattattacttgttgcggttcatggggtagatgaggacggggcccatggcgggggtgcggctgaggatgccgtggaagacgccgtcggcgaaggcgaggacgccggagcgggggaggaacaggttcagccatgggtgcggcacgtcccagagccccgcggcgcggagcttgagctcgccgtcgtggacgcggtccaggaacccggcgtacgccacgtcctgcgcgaacacgaacccgcgctcgtgccgcagctcgcgacgcagcacatccatcctctgcaaataaaatcaagcaaagaaattaaagcatatatgttggtaaaattcatcaaattctttgcagagagatcaccgaaatttgatcgagttattaattttgccagcactagcagcgtggatggacaggtggcgacgtgacgtcatgcaaggataaagtgaggcagtactttgtccacatgtgtgtgtgacgtgtcacgtgtgggcatgcaggatcttctcggatcacatagcaaaagctatagctaggaaatgcaaactgtatatgcatggaataactagctagctatctatatagagccaacatagttggtcggtcgtgttgcaaaagatgggggctcatgcatgcatatgcatgtgtgtgctaaagctggctagctagggttataaccatacaagctgatgcatgcactgtatctagtggcgcacagatctttggctggcctgtcatccatgagagatccatcatatccatcggtttccagcttctagcctagctagatacatgtaactatgatcaaaagctagctagctagcacatactatgtgatgtgtcaatggccacatgatgcatgcatggatggtaggtccaagctggcgatgctgatttctttctggcaaagctctaattcctcagtcccgtaataaggcagcgttcgtttggacgacattgagggagaaagcacctcgttttccgcaagtacgctttccaaactattaaacggtgtgttttttgtaaaaattttatataggaaagttgctttaaaaaatcatattaatccatttttgaaatttaaaatagttaatactcaattaatcatgagctaatggctcacctcgttttgcgtatcttcccaatctcctcaatccccttctcctcaaacacaccagtttatattttgctcattccatttattctaaaataagtttatttttaaaataatcattgcatcggagtttgtgaaaatagagaataaccgaaatttgtagtactttctattggtatgtgtgagatggatgaaaagtgaacttattttgggatggaggtagtacatggtattactagtatatgtccatgtctaaattcattgtattagggtatgtcccatccaattttaaattcttatattttaggaccgatgagtagtagttttgtgcagaacaacagatatgtgcgtagacatacactaatctagtctagctacatgctcaaaattgatactccctcactttaaaaaataaagtatttttatatgcatttgtctagatgcatataattagaaatgcttatattttaaaattgagggagtatatatatgaaccctctttggtcaagatgaaaatgtgatgtttaagtcaacttttagtaactttgaacatcaatatgtatatcttcataaacttttgattggttatatgattttccttaaaaatatacttttacaataccataattttattacctttatttttttttaaaaaaatataatacaaaaatacctgttaaagttgtgcgttctgaagactgtaacagtgtttaaaaagacaagtttttccttgatgtgctacaaatactgttaatgatataattcgtcctggtagctactacctacactagcacgcatgcttttcactgttttggacgaaaaagttttcaccataagtagctaaaagaatatgtcacgatcagacgatgcatatattttatacacctgtttaagcttagtgagagcgactaacctaatactccatatactagcttactaagttgctactatagtatctaatctttgtctctccgggaactaaggaagataaaaaaaaattaacacagaatcgaataattatttaattacttccagttaggtgtgtgatagcgagaggtgcatcgcgtggcagacaaaagtggtaggccaagtacgacgatgtcgacggcgcaagagacttcaatttcatgcaccgttagggtctgtttggtttccacggacttattccaagtccatgtcacaccagatgtttgaatactaatttggagtattaaacatacactaattataaaacatattccatatcttggactaattcacgagacgaatcttttgagtctaattatgtcatgattttgacaatgtgatgctacaataaacttttataattatagattaattaggcttaaaaaattcgtctcgcggattagctctcatttatgaaattagtttttttattagtctatatttaatactccaaattagcgtccaaacatccgatgtgacatgggctaaaaagttttagccccatctagaacaccccttaattgcatgcgtgcgtaagcgtaagccccaggtggcgccaaaagtttttgcagcttagttgttcccgccatcatcacgaggtgggacccgctctggtcggctcagcgcagagcaagctagtagctagctagtataccttgtcaacgtcggcggcggacggcccggcggcgccgccgaagtagatggcgccctcgaggaaatacagcacgccgccggcctccttggcgagcgcggcgacgcgggcctcgtcggcgtcggagaagaaggatgaggaggaggaggaggacggcgaaggcggctgcggctgcgtgcgccaggtctcgaccaggccctggttcaggtggaccgagccctcgacgtagtccatcagcccgcccaccgcgccggcgccgccggcgcgatcgacggcgatgaggcgctcctggtcggccgtcatcgccgccgccgtcgtgtacacgaaccgcacccaccgcgccctcgccggcgccggcgcgagcgggatgcgcgcccgcgtgatgacgccgaactgccccagcccgcccagcaccgcgtcgaacaggtccggcgccttctccttcgagcacgtcaccatctccccgacacctgcagatacatgtatacgtcaaaacacctataccttaattacctcgatcatggcggcgcgtgtcttagtagatgtgatggatctacgtaccggtgatgacgtcgagctctagcacgttggaaatctgggggccatggcggaaggcctggccgctgatgccggcgttggacagcgtgccgccgacggtgaggtggaggtagtctgtccacgacaccggcgtgagcccgtgcgccatggacgcgcgcagcacgtccacccacagctgctcgccgccggcgtcgacgtaccgcccctccactgacacggcgaggcgccgcgcgccgccgccctgcaggcggccgagcgacgccatgtcgacgacgacgccgtcgggcgcggaggcctggccgtgcaccgagtggccacacccccgcgcggacaccgcgaacggcgccgggcgtgcgcacgacgcgcgcagcagcgcggcgatgtcggcggggcgcgacgggtagagcacggcggcggcggcggcgagccgaggcgccccgacgccggcgacggagaggttgccaaagtcggcggaggcgcgcgcggtgcccgcctcgtcggcgcggatgagcggcgcgatgccgaggtcgccgaggtcgtcgaggaaggaggcggacgaagccgacggcggccatggcggcggcgccgtggccttgacgaagcagttgagcatgaggagcactgccatcctgacctgctcttgcttcattatcaatcaatcaatcgatcggtttgtgtgtgtcagtgtgtgtgtgaatttgtgtgttcttgcaccattgtagaagggacaaggtggcctataaataagcagattcttgtgtagtttgtgtgctgacgatggaaggcagctgatagatagctagatagacagtagagctgtggtgaccgagacttgaggctctctgagatctgtgtgacaaggactgaaagatttggtttggtttggtttgtcgttttggagattaggggagagtctttttaaaggctaattaagggtgatatatatccttctagaatctagattacatggtgttgcatgcataccatggtttgtgagaggtaattaaagtcgatataattaaacacgtaaaagaattaatacaagtgggaatataataggtcacatatatacatacactaccggaatccagaattctgggcggccattaatttgtactccacaagggagttgtatgcaggcagttcggccggtaacacatttgaaccctcgagggatatcctattatgtattcgaaaaccattcatgaaaaattctcaaaagaatttaccactcgacaaaatttagtcaaaaaaaaaactaacttgggcctaatggctagcagcacggttagtatagccaccctaggtttgattccttccttctccatttttttttatattcagtccaaactagctagaccacacatccaaaaataaattaaaaaagttgagacaaattcagcatataaaccctatactattaacacattgagatgaaagagcattagacaaacaacccgttaattttacaaggacaaatatataagtgaaccagtaaacttaaaatggaagataaagaaatttcacatcccccgcatagaacgctaggtatgttcagccaattagttcacctaattagctttctcaaattaattagttattaggttctaggtataatatttttaggataaattttaaatagtagaaacacatcctttttgagacggatgcaatagtcgtcgttagcccttgcatccctaccatgcaatcgatccggccatagagaatcccataagaggatgagtggtatagagagattgcacgtctatgctgcatagtgtgccattacctatagcttctcgttcaccctgaagtgcagtgcctgcgataactaatcttcactattataaacattaaaaatatttttttatctaatattttggtaccttgctcgagtccatactgatttttcatccatcggccctggcccgattgtttcggtgctgtgtgtctttgtttccactcctaatcagtgtgcgttgtgagttcaagtgcacgcgttgcgcgattcagtcacgacgtccccatatctcctgctgtttccaggactcgacatatgtgcactttggcacatctcctagatggaccgaggaaaaacagaaaagacgatacgtagagccttattatacatacggaactggtcgaatattggtcaagacatgcttatgtgatgcattagcgatcaaatattaattcgtggataatttttttttatattttttcgtgccgacttaaaagctcttgcttaaaaataagctacgataaaaggaaaatcaaaatcaactccgaaaattaaatttgaaaatcagctatatttgttttggaaggggttagatcatgaaaatcaaaccgtgatcatctaaatgctaatgcaatattagttttccctttgaaatgcacggatcttttttccagtgcaaagaagaaaacaaattggtacgagagatgacattttgccttgcctcccattgtatcgcgtcgcgtcgcatgcaagagctgccaaaacgaaacattgtacgattatatatactccctccgtcgctaaatatttggcgctgttgacttttaactatatgtttgaccgttcgttttatccaaaaactttggtgaaatatgtaaaactatatgtatatataaaagtatatttaacaatgaatcaaatgataggaaaagaatcaataattacttaaatttcttaaataagacgaacggttaaacatattttaaaaaagtcaccggcgtcaaatatttaggtactagtattatatttgcgtggcgatgggagctactccatccgtttcaaaatatttgacaccgttgactttttagcacatgtttgaccgtttgtcttattcaaaaaatttgtgaaatatgtaaaactatatgtgtacatgaaagtatatttaacaataaatcaaatgatatgaaaagaataaataattacttaaattttttgaataagacgaatggtcaaacacatactaaaaagtcaacggtgtcaaatattttgaaacgggggaatatattggtcggccaaaacctagtacgtgcgtgcacacagcgaggcggattcgtagcgaagcatatgcatgcagcgcaccgacatgtagatctttgattctttggtcgatcgtttgtcgtcgtgcagggcaggtggcgctgtcgtggccgttgatcgatcgtggtgacagccaaacgcacgttcgatcgatccacggatccatgattttatttgccgctggcctgcgcgcggctgcagacgtacggccaccggccggccacctgatcgcgctctcgctctatagctctcgtacgcgacgcgcgcgggtaaccagccgcgtgtgcttgcacgtactcgatcgtatacgttgcatccagctgtccgcatgcattgcagccaggagagccgaggagtgtcgctgctggaggttctcgtacagaaactttttttttaataaaaaaaaacacaccgtttagcagtttaaaaaatatgcgagcgaaaaacgagaggagaaagttgggaaccagccgtgccgaacacacccaaagcttgtccttaacccttgtttatttccctcctctcttatgaatacatgccactctatacatttagttctttctttctaaaatatatataagaacctatagtatcggatggaacactttagtttttattactacgacacatttttgtgaccgactctggaatatatataactttaaactgatcaaattaaacggttcaaaactttgttgctaagttgattttttataattttaatttaaactgattaaattaagtgcatggttgagaactttgtttataagaattttatatgtagcagtgctcatccgagaaatataacctatcattatctaatcagtattacagatcttaaccaattaccttttcttacagcagaagagatgcacgtagatgagtgaatcatatatatacaagtcgcaatcaaagtaatggatccaatcaaggtgaaaagacgaggtgtggccgccgtggaaattctgaattaggagatatattgcttaacacagtattatatataattagttgaagatcgtatcctaattaagtcatgaatgaatgaatctctatagctacggtggtcgaccgtcaatggtcattcctcgacgtactaattaacaaatgaatatattcgattgtgtacgtgctagatcgatcgatgatacgcaattatttatgcttctttgtccaacatgactcatttcacatcctgcccgaatcttgtcgccttgacaattttggcacatgtacgtacagtggcgtcttgatctttatcttagtggcctctctacagatagatatcgatccagctgagaacttgtcaggttttatcgaggaccaagttgccctgccatgtgtatagtgtttgcggatggacagcttttacggtatgcagtccaaatatatcacataaatatacaaattgtatatttttcttattacacgaaagatgtgaacacatgtgggagttggtttcattcctttcccaatcaacctcactcgttttcatgcgtacgcatttttaaactgctaaacggtatgttaaattttatttacaaaaattgcttttaaaaattatattaatattttttttaaaaaatataacacttaattagtcatgcactaaacatcactttgttttgtgtgctaggagtgaaggttcccaacccttgcccccgaacttagtctaaagttctattaaaagtgcacctcctactatgtgcatgtgtatcataagggagtgtctaaattctagctacctgaaactaaattttctatcatttttttcatgcatgataatccaatatggttctcatatcactccctattatttattcatttaaataaaatcccttcttagtataaacaggttgaacaaaaaattggtaacatatatacaaagatttacaaaattacatgaaataaaaataaagtaaaaacatatataacaacaaaattgctgttaaaacggagtaaaattgcacatatatctaaatattctaggtgtccagcgcttgaaatcaaccaaataccatgtatgtgtcatctaactaaccctacattcatgcatgtgttgaaataatatgaaagttttttctgtttacgcgcactatatccgtgtgttgtgacggagataagaatttaagatcacaagttgaagaatggaaagcaataaaaaaatacaagagtggcggaattggtgcagagcatactgtcaccctccaattccaactcccccttttgaaacataatttttatatatttcgcacacatcatctcgatcagatttgcagaaacatatggtgcccagcatatctaaagcaagagatgcagatgacgtcaacaaaccgttcaatttgatgagatttgttcgtataagatcttcacgaggatcctgaataatcctgatgcaggcgtagacttaattacatatagcatccagtgagtttactcgcggcaaaaggtgaaatttgcgatctccaaaaggaaacaatactatatcaaaccagaatataaattaggacaagcagttcggttcgatcagtttgtcactgtcacacacgcactacatgcattttttaatacgatttcacgcaggacacattatacgatatgcatcaatcttcaggatggcgatagtacacattttacagctatatatttcagatcacaagcttttacacgtgtcacatacacaacatactccctcgatctatcccaggaaaaatagaaaaaaaatcaatttttagatttgaatctggatattgcctactccaggtcctaaaataaaccattcttatacgggatgttaccagggtttcccaaaccgccggggccggggttactgtgccccggtggtaagcacgtttaatgtgcgataactgtggaaaaccgtactgacggagcgtggggctcctcaccgggagaccgcgcaggtccccctttaccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagaacccattccccagagtcccaacccctcttcctctttttctcctcttttttctccctcttttctccttttttcctctcctaggcctgggcctcctttttatcggg

SEQ ID NO: 39369 - DNA, 2896 bp, Oryza sativa
ggtcacacaccgcgaccggtcacggaccggataagcgtgcgctgcgccgcattaaatgcggcctggcgcgctcgtccaacccgctataaatgcggttaggtgagtcccgctgtgctcacctaacccacacacgtggtgccaaaaccacagggggtcggggcgccccagccctcggggccgaaacgggagcgcctgagccctcggggccgacacgggagcggcccaacccctcggggagacagagggaggggtggccacgtcaccctcgggcccgatcccccccccccccgagagggtcaggccacgtgggtgaccgcggctacccaagcctctagtcacgatacccccggccccatgtcaccgacacgtacgaaaccatataaaatttatcaaaatttcaaatttcgaatttaaaagactaccatggtttttcttttaccgtaccccgtggtaagcacgattatcggcgattttgggaaccttggatgttacatatcctaatacaaagaatttgtatacattccgttcgaggtttagtttgttttgggacgaataatagagtatgtctaaattcatagttagaagtaatctttttttttatggatgaagtatataggtcagtgtcacgcccagaaattcccggatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaagagctaagccttgactaaaactgaagcgggaacaccactccacaggcatcctcgacggcacggacaaagcctactcctcggagaaaccttcatctgacccgaacttgaactctggggttgggaaaagtagagtaagactgagtactacccactgtactcagcaagtcataccggaataggggtatggtgcagggaatcatcaaagaagagctaaagtggttcatttgcataaagcgagcatttataaacagaaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcagatttcacccccactcctcgcaaggcagcgggaagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtgttactaatccaacaaaaccattagaaccaacagtctaaacattaataggatttttccccattgtgaactagttgaactaagcatggctaagcaatccctagtccaaactctaatcatgttataaccccaagctgacaaagaaacatggtacatcaatagcatggctacgacaataggtaaacaacccatagtaaccttataaaacgatgcagtatttgaacgaaaacaatagagcatttgcattataggatcaacatgttcaagtgacaagcatgacttgccttgctctgctgctggaggaacctcgacgactatttcgaagtacaccggagcgtcggaggaatcggaatctagcgacatacaaagcaaacattgcaaacaggctataagactactgaaacagggaacaaaaccatttttaatagattctacacatttttcttgatttactgagacttgaatgggcttaaacggagctcggatgaattagttatgaattttagaagattcactgtgtttattactatacaagaaaaaccttaaatcatttattgcgcaatatattccaggactgacgtcatcaaggcggggcgcggcgccgacatgcgggccccaccggtcagcggctcggggagggaggaagggcgccgacaagcgggccccaccggtcagcggctcggggagggcggtccacggcggatcgggtccacggaccggggaggagcggcgcgccacgcggcggccgaaccaatggccccgatctacccaagggtagatcggacggcgccgggagctcggatgaattagttatgaattttagaagattcactgtgtttattactatacaagaaaaaccttaaatcatttattgcgcaatatattccagggctgacgtcatcaaggcggggcgcggcgccgacatgcgggccccaccggtcagcggctcggggagggaggaagggcccccgacaagcgggccccaccggtcagcggctcggggagggcggtccacggcggatcgggtccacggaccggggaggagcggcgcgccacgcggcggccgaaccgatggccccgatctacccagatcggacggcgccgggagctcgcggccggtgcgcgcgggcacggcgcaaaccggcccggcgaccatggcgcgcgacggcgcggcgcacatgcggtagcggcgcacatgcggcagcggcgcaaga

SEQ ID NO: 39370 - DNA, 2240 bp, Oryza sativa
atcgaatcccggccatctcgggcgcgggcgcgagcgggacagagaggggagtgggcgcggggaacgcggcgcacgcgcgggcgtggtcgacgtggcctggaggaggcggaggcgtggacgcggcggcggtttcgggcgcggcggttgctggcgcggcttcggccggaggtgggggaaggacccgacaggtgggccccacctgtcggcgaccccgggagaggagggcggcgggcggcctggctgggcctcggcctgcggccggcccaacagggagggggggaggaaggagagaatgggccggcggcccattcgaaaaaaagaggaaaaagggaggaaaaagaaaaagaaaaaggaaaaaggattttccctggaattaaaatattgcttgctcaattttaattggttaaaattatttctagagctctgaaaatttcactaaaaatcctgttaatgaatttcgacatgtagaactcaagaaaaattccacatgtcaaatccgattattatttgcattactttcttagggttttttcttgatttgcacctgtattttcttgggggtcgtttataaattaaatttttggcttgggaggagaacttcggggtgtgacagtcagacacgaagtctgttgcagtccccatcaagtaccgatcctcactgatccatgcatgccaacacatgatctcagaggatcttgagaatgtagattggggtgttgatatcatgtgatatatttcacacacaatgccaacgacagtatagctggcgagtcatgtggaagtcgtctctgaacctgatccgaaacatggtacagattctgctgtagatgatcgttcaaaggaaggtgatccatatgtatcagtcatcgtgaccccatcgcatctccccaaagatacgatcgattcggagctttgtaagatggagaagccaccgtatacctatccatgtaactaacgtgagacttcattttcgtagacaaattcatgctacctccgttttttcatatatgatattgttgattttctaacaaccgttagaccatttgttttattcaaagtttttgtgcaaatataaaaaatttcaagttatgcttaaagaacatttaacgataaatcaagtcacaataaaacaaataataattacataaaatttttgaataagataaatgatcaaattaaaaaaatcaacgacgccatatattaaaaaacagaggaagtacgcactatcatgccaatagatatcttttatggatgagcttttatgtagcaggttaaggatctaggctcagttaggctctattcgggagcgagggttgggaaccctgtaaccctaactccccggcacacaaaacgaagcagtgttttagtgcgtgattaattaagttttagctatttttttaaaaaatggattaatatgatttttttaagcaactttcgtatagaaactttttgcaaaaaacgcaccgtttagcagtttaaaaagcgtgcgcgcggaaaacgaagatgaggagttgagaacttgtactaacaaacggagccttagtcgagggatgcataaatctagaccacccaagttttaagttctaattgagataaatttgggtgcatgccctttaattttagggtaagtcgagacatgtgatcgaagcaacaaaaaataatttgagtttttttagtcatgcccaatactccctcaattctaaatcaactttctaacgaatttagaaatatgttatatgcaaattcctatatgaaagttaatttattataggacggatggagtaacttataaccgagatatgagatcgaggcaacggaaaatagttttagaagtcaaatatgacaaagaaaaacttaaaatttaagcttgaggaaaatttgggtactgcatatagatcatatggctgcacatgtctttcccagctctccttgattcgttgttgtccaaacactgtactggtcgcgggcgtatctccatgtgaatctcgcgaggcagatgcatgtcgagcagtcgaggtaaaatagctagctaggtgacgtccctgtccatcaggagcacgtcacggctgtcgttagctaaatctagctggattgtattgctagctcactctttgtcactcagcttgcccgtctttgtctaacctggctaaggccctgtctagattccaacttttttcctcaaacttctaacattttcgtcacatcgaacttttctgcacatacaaacttttaactttccg

SEQ ID NO: 39371 - DNA, 2809 bp, Oryza sativa
tagcatgctgtaaatcgtcttgaaaacgaaaggtagttaattagcacgttaatcgtcttgagaagggaagatcgagtcgggcctgcgtgtgctcgtgtgattctttgacggtgttggccggaagaaatcgtcttcacaacgaggatttttttttactttgtagtccttttttgaaaacttaatttataaatatatacctaaaaaaaacttaatcttgaaatggaccttttttttatgacgctaatatcattggcgccgtggttcaacatgacattgcgccgtccctctttaccccttcttagaagctaagacaccgatacaaaggggtggatcagcaccaatgtcattgacaccaaggatttatttgtaataaaaatatttataaatagatctttggtacaagtgaaaaattcctggcttcaatctacctactgattcctgaaagagaaaaaaactccttttaaatcctatacgttccagtcaggattttaaacaactctagttcccaacagagataacctcgtaccatacagaatccatgctgtccattttgcacaccaacagtgatgcatacttgtgcccattgtcacactggacactgcgcttacagataatcactagttcactacagcaggttcacttgaagcagccatgccggtataaacatggcccataataatttttctagtagtactttgtcccacatgttcatgagaagtgctaaatcaccagcttaaaaagtctgctcctaacattactgctacagtacacacatacttgatacaatagatagttaatttggtggtagtagtccataaacacgacactctacctgcgatgatccttcttgatgatcttgcgaagaagtggaagcgagcagagcgcggtgtcaccctcgttcttgagcgcgtagaagtggcacagcgcgcggccggcgaccttccaggcgaagccacacctgctggcgtcgttgctccaccgtgctttctcatacacaatctggtagatcacgcaggcttccgagaacacgtcgtcggggtccctctgtgtctgctcgaattcagatgcatcgtagagcatctgcagcaggttcaagggttcgttaggttaaaacgaaaacggcgagccgccaatttcattgaatagagaagaataaaaccgtacagaaaacaaacatgtacaaacatagggccacagcccgactaagggctaattaccgcgccacccaggcggcgagatagggttcgttaggttaaaaagctagctgtaattaattcgaccattgaaaacgctgttactcaggaaatttggatggatactcacatgcttgtacttctcgtagagttcttggaacttcatgttcctttcttctttatctaccattgcgcgatagagcattgtactgtcagtcaagtactcctcgtagcggtgttgccagaggtgcctggctgctggaggtgcttctctttccatgaaacatgggagcaatgataccccttattattgtaaaaaggaaaagagggaaaaaagtaaggcatactgttagagagaacattcatattatagtactattctcatcaaacatatgaaaccaatttaattgaaaccgtgttctatgccaaaatcatgtctagtgcttctgcagaatggtaactaacctctgcttctctcattgaacaattttgacatctctccctcccattcattttgttttgaaactaggtggaccatatgagtaaaaaattaacggttgagtgcataagtagatagtcttctccataattaaaaacagcagatgattttttttgtaactttttaatacaattttagaaataaatctttccacaacttatttctaggtctgaataagtgtaaactattataatttaagattatccttatgtgcgtaggtaactaattagaatagatgtaattgttcatcatcacttctataaataaattaatatatataaacatgaaactataatggtttattaattactatttccaattaattgactgccttacaattaatcattttttcatgcaatgaatgcaaaccgtttttttttaaaaaatggcatagaccctttccatgataccacatatgtatatactgagaacaacatcacattttctcaatatgcttgccatttggcaataccttaactactgcaagctcagctcataagttatagcctatgtgctacaagcagaacaaataatgtatgtcatctccctactgcagataaaactataaaagaactgaaaaaaggaacctaaataaaacagacaacataccgattggttgaacattacaagatcgcagagattctacatcttctgctttatcatagatttgtccaagtatggatgatgaatggtacgaaaaactgcggcccatgaagtgggggtattgttttaccatcagatcacttggaatattgacctgttgggacagcacataaactgttgaagtgcaatatgcattcccatgtaatgaactttggtcttacaaagcatcaaatataaaataataaagatacacctgcacatttcatctattatctttatcttgtagccctacttgatctcactgcttcatacgttaaacgtattcctgtcaccatgcaactattccaaccaccatggtgccctggacaccgggtagctggtccatttctaacttatattgaactatgttaattacaacattatccaataatcagcttattactatgtactggacacccactgcagctatccgtataaaatattggcagtttatgaatcattgtaatgaatcacg

SEQ ID NO: 39372 - DNA, 2511 bp, Oryza sativa
tttttaaaaagtactgatcaggttcatataaaaagaaattcaagcacttctagaatattgaattcaatcaagtgctgaactcctcaataaattgcctactaaaaactaaatgagattcatgctgctaagttttctttatagtgaaatggttctagttaccattccaaaaaggaaggctggtgacaattattactgtgcatcagaaaaatcaagcttggtattaatacctgggagtaaatcttgttttcaagaactcatgaaatagcagcctttcaagtttggattcattacaatcctgaggtttcttttgcttggtcttttttggtttaatagcttgtacccacggttcagaaggtttgaagtgttctaataactgaaaagaacattttcaggatcagtcagcaataattctttcaaaagttaaagacagaatgtgctgttattatatcagtaccttattatgcaagaattataatttaaagatacagtgaaacaacaatgccaaatttactaatgaatcatgcacagcaaatctgtaatcagtccaagaactagcaagcataattaaaacggataggtcaatattccaacacttttggccactgaacttgggcttcattagcgattggccacctgaaaccattctacattcgggccaagtttaaaaggtgaaaagtgaatggcttcgatagtctaaatttaggaaaagggtccactttttaggtctgaagatcagggttgtaaaatggacactttcctcattaaacatgaaggcatgcaatattatttagtttggtaaccaaattaacccctcatgtctaactggcatcccaaccaagccaacaccttccagctatccacttggcggtgtttatcctctatgaaaccttgcccataacacatgtttggcaaaaggtccaattttgcccttaaggtttaacaagggccacttttcttacaaagaagagagtgtttccaagaagactacatggatagactcaataaatatagaccatagttaaaatagcatcacggccatatggatggaacaactacactatgaacgagggtggaaccaagcaaaacttcactacggattttaatgagaatgaaagataatcaagcacaaaggcacaataaggcaaaatgtcaattagaaattaacaaacctttgggttttttgagacccaataaatgtcaccgtcaaaatcactgttggccatctcatcagccaaagaccgcggcccagaaatagggaagagtatagcatatttagcatatcccacatactccttttctagatccctaatatatgttgctttcaagacatgtatatcaccaaaatgtaacccaggatgtttataaacaagaacatctccagaaaactggccattttcactgttgaacagcagataaagctaataagtaaagaacaaaccagaatgcgatcaaacataagtgatacagtaccaaccaatggatgcaaggaagaaatatgacaaagaacattagttcttaacattgacaaattcaaaaccttttaataatccataatatcttctatttgagattttttttctatttattaaaaacagtcacacagattcctgatgtctaaaagactacatgttcaagttagtctaaatttgggaaaatgaacttaaaaatgcaattgaagtcctgaagccccaaatacccagatgtatttagtatcataagttactagtctaaacattttctttagccgctgtttaccaacgaacttcacaattgcaatcaaaatcattgccagcaatatataattgtttgaatacaaaaatgcgttctcattgctaaaaggaaattgcaaaaactccatctcaccttgttaaagtgcaaaatttatggtgctaatcagcaagaacttggaagaaagcatggcaattttggtgcatttctactaaacaaaattacaagacattaaagcagttccagtggtgtccatgctggatagtggatattcctatgctatatggtgactggtgaatagtaaactgaggatcactgatacatataaaaaccgctgaaaggatatgcagatgcaaaaggggtaattctgtaactaacagtatcacgcagacttcattaggtctgagtgttccggtagggtctgtagtatccattagataatagcactcatcaattggtatctttccttgcttgattccttttctttcctgttgagccatgaaatccagcctatgttgcaaatatgactcttctagaggaattccagaaagaatcatacgtgctgacattgaatcttccatgtcagcatagctgaatgcaactgtaagaacaacatgagaataatagtccagatcaaacataaacaggtgactgaaaaacataaataaaatggaaatcttatgacaacatgtaaattgcactgaatgcaacaaatgtattttgaacttacttctcagtgcatcttcataatcgtaacatgcattctcagccccttcaattgca

SEQ ID NO: 39373 - DNA, 6255 bp, Oryza sativa
aaaaccagagcttaagtactaaaatgtattagtacccaaggatgctctacatataaaaatagatgtaacaactaacaatgcaactcagatttttggtaccttgtagagactatttcaaaggaattcacggactgaacaccagataaacttttcttggcatttcgtgcagagactatttccgatgagttgacagaccggacaccagataattctggatgagtttctatttttaccattgatggtcggatgagtatagttgcaggaggaagctgcaacagaaagagatctattcttattcttacaaaatacacttgaatgctagggatagtagctaagataagatagcaaaagaaaattatctgtacacaaaattgtgtaaaaattgaatagattgaaaagacagtgcatgatgtacaacaagaggatatctgaaaagatgacaacaccagcattgaacaaaatgaattaatgatcaacaattattagaaaacagtgaccttgtatgagataacatgtctatcctgaaagtatataaatcatgcaatgatattctgaatattgcttgaatttacacaatcatatagtattagttaaattgccagatccgtaatagaagatccgattgtattgctatcaggatacaaggaaggcacgattgcatagatgcttaagaaactatgaatcaaaattgggaacaagaggtgataacacaagagcaaacaaataacacaaaactaccaaatttcaatgtataagtaatatcatgtcaaaaactcagtacatacccgcctgtcaactaggactgttccctttacagcagatccattatagaacagacggaactgcataagaagaggctaggaaaatagaatagacaagaacagcaaactcattagttgaaaacacagcaaagtcagaaaagagtagatcggaacaacaaggcaatagttaatacagtacatgttcagcggtgagagatcgatgcctcttcaaactgttaggcctcatcactgtttcactttcatcacaagttgcaatgccctgaacaaggcataataaaaaaaaaagtatatcagctagctacaagcatggaccaaaacatcaccattaagtttgagaagcatgattgtccagaaaggaaaacataactaaaatataacataatagggtggtgatgtcatgtataacacacagtaacggaacttaatgttggttgatgttgattactggattttcgaattctgagtcagtagcaacaacttttcagtccacccttactcaatgcagtggacagtaggaaaaattcctaccaggcaattgttacagcagtgggcaggccattgcagttacttagcactttagcaggtaccaaattaggaataagtcaaataaagtactccctccgtcccaaaatataacaacttttagcccttaaggtttgtcccaaaatataacaacttcttcaccaacattctcttcttaaccaatcacaaccctccaccattcaattttctcacctacctccacttcttaaccaatcacaaccttctatttaattttacctactttcttaatacccatgtccaaccctaaaaattgtagagaatagaatagatgtctcaccaatgtgggggaggtgatctctcatatatatagctgaattacaatgaatgctagtgctgagatacaatcaatactagtgagttacataagaccaaaggtctagaagagtaactatctaggagagtaaaggtctaggagataaacaggcaaacagcctatagattaataaataatcctaataaaaatccttatattctgggacggagggagtaggagattatctcctaacaaggaggtttgttatattagagatcgagagagagagagagaggattggtttaatatttgatattagttccatggaaataaatctctatctctaagccaaaacaggatcagtaaattcctagtgagtgatgaaatgaatcaacaccagtacaaggtaaattaatataagaggtattttggttaggaacaggaaagaaagtcacacagcagtaaactggtattgcaatacaatgtgccaacaattaactgttcgcccatgaaggacaccaagtatggccgtatatatccggttggatttagaggccgggtaaaaaatacccttctctaaaaaaatggacaccaagtatcaatttaattaataagaaggataagacttaaattcgagctttagaggacccaaacttgggtggtgagggtgtacatccacacctcctaccaactaagctcgattcctggtctgcttttctctgcccacatgtttgaaactttatctaaaaatttgtaattatgttgcatagtatctttatgagcaactccacaaattctgctttctgcacattcatgagatgtgtttgtcaaactttattgttggtttgcatctgttcacattataaacaatcaagtaatccgaatttgcttattagtatgtaataacgccttcacaaaaccataaccatcaggggaacacaaacatagaatgtctgaaaggttaatgtatatattttagataatggacttttcattaatccggcctctatatccatcaaggaaatacacagccacaacatacgcgagttcttggagtccaacccacacgcagaggaaaacacataaacacacaaaaaaagaagcttgaagacttagcttaagggaacagaagtcttagattattcattcaaggtgtatggagtgaggataaagcgcacctgtggtttcaaaaattttcccttgaagatactcgtggggcaattgagagccaaatccacagatacaaggccagtcccatcagtatggatcaacggctcctgatctttgtgaacaacattgccatgtctgtcctgaaatgttacaataaagaaaaatgtgattccagaagcaaaaacaagtattggagaggagggaattaccatgcaaggttcatctttaatccgtctgacataaactgctgatagatcagcatcccatgtgatagttttggagagtatcaaagcaaaccttgttacaacagaaaacacaggtttcgtaagtaagagaacaatcacatgcaagcacgctcaagttgagtccaataattgtgtttttctatttagaaagcctaatagttcgatagcagcaataatgaaatgtacatggaaattgaaaatgtaggcaatggacttctggaaaaacaagcttatcttctgactaaataaatcccagcccttctatgcatctccttttgtatctaaaaacgatacgctgctatcatggtagcaaaaccagaattaccagtaaggcagtaactaagcttgacatcgaccagtacatatgcccacattgcatcaatttaattagttgacactactaaacaaagtcataaggaaaaacctggccatatattttgccaaggtgggggcagaacttatgtgcatgaatagttcacgggcctgaccaactgttctcccagagagtatataaggttcatccatgttccacccagactcagtgcgaacaaagtagcacatgacaggtgaagtgcatttgtttttgtcttctatcttctcttgtttcaatttctcctctttccctccatccttgtaaactgaaaggtacatcgatcaatgtaaatccaacaaaaaagcaaccaggaagcatgatgggagcacttggtaactaggatacaacttgtaaagtagaattggtgtctcttagtcaaattgacacgttcagactcttaatggatattgcttccaatttgtgtataactacagtcaatctattttttccagacaccttgcggggaaaacacatctatgccatctcacgcagccacgcaggaatgactggatggacctgttcacacaaccaaataaacccaagtgtgtcttcgaaaatccatgaccattgtttctctgaagccattagagaactttgaccctagtggtgttacatcataaattgcagtaattatgtattacatgcattctccagtctactacttggtaataaattcaaatagattcaatgatgcaagaataaggaaacttaccgaaaaatcgatatcggcgcaaacccaaaacaataccatcttcagcaaccttatggtaatgttcacaatatgtagagaagtcagtcttggtgtctgacagtttccccataaactttactacaaggacattattattaccaacaactttctgtagatgagtccttgtattctcgatatatggtccctacattcagttaaataaggttacaaatttagcattggcacctgaagttccttaaaaaaatatcatgagtacggcatttgttgatatgggtgccttaatttttgttggcattggtcttcatactactactattaaaatcttatttgttggcattggtcttcatactactactattaaaatcttaggtggcctgcaaaggatgcatatgggtgatgtgcacctttatgtgcaagctagataggcaaacagtctgaacagcaatgaacaaattgaacactatacaatcacgattagtagatggtagaacatcaactagtaggccaactaaaaatatcgttattaaacaacgaacatcaataaacgctatcaaaaggctccacaaaccttgaaaattttgactacagtatcccctcttatcgcaacattacaatgatagacttttgtcatgcctggatctgaatcaaggttctgcaacaattaaaatggaggaatggagaatgatttcatcaggctcatgttataatatactatcagaggaaaagaaacagatagcagaaattagaaaaatgaaatgtcagtataatattctcatgatgttattgatagatcttgatgctcaagaatgttccaagttctagggaactgatgaacttacaagaactaggtatcattagcagacagtgtttctaataaggaacttttgaacaagaaaatatgcataagtgcatccctagaagattgtaaaagcatgatgcgttgcagaaaacttattacaggaaatggtttgtgatgttccagcttgctgatgaaccggccacagaaaatcacggtccaaaaggtggttttgctgcatttatcatggaatgccttgctagatgattggtaccgtttctatttgtttttgtagttctgaagtaaattaactcgaaatggaagtcaggaactacaagtcagtagtaccacctgtatggttctgctttcaacagaagcaggcttcttttcagcctttagtcttaaaaaaaagtcaaaagtgcatgtaacatacctagacactaacatcaaaatgaagaaaacatgatacttttaagatattagaagctcagatcagaatgtacaacagagtaagcatgcattatgtcctcgatgcacaagtaaattcaaggagaatgaacatgcataggtgcaaattatatatatttacttatggctccgtttagaattatccaagttctactatgaaatgggatcatcatctttgatcatttttagagatcgtcaatgaaatacaggaaatagaagtactgccattgaaataacctttgctctatccgaagctgcaatatacttgtggccaaatgttctccagatttgtgactcaaattgcgccatggacagaaacttcaaggatctaatatagtccacagacagaacattctctatcttttcactgaaacataaaagagaaaggtgtattagcaacagcaaaacacagacaaaagtcatctgacttaggaaataatgaatgttcaggtacaaaagcagtttttttttgttctccgttctatagaaaagcacaaaaatgaagagaaactaacctggcaaggtaagcaaaaaccataaatatttttctgaaccctaactcttccagcgctagcatctgaggactcgctgcctccctcaatgcattgtctgttgtatggcaagtcgttgtagggttttgcggcatcgccgtaatggggctcggcggacttactgaggggccagccatattctcaatgagtcttgaaatatcctgaacagagctcggggtggaaactcttcttggagtagaaatcatcggctggatggggctgtcaatctctataagttctgcaggccagatggcatgcaacggcatggactaccaacttgcatcataacatcattaggcaccgcaggagccattgctcgggcaggactgtcaatctacaga

SEQ ID NO: 39374 - DNA, 6267 bp, Oryza sativa
  unsure (1)..(6267): unsure at all n locations
ccttgattctgcgacacagaagatgtatggccacatggactctcaactgtcagctgagcaagctgtggaaccaaacgagcaatttgtctgacagaaccaccattgccatgtaaatggaacggcatctgttggttgggactcccaacctctaccatcccatggtttgagagactagtagccatttcattgctggggctttgatcgtacatctgaacctcgttgtcgaacagttgcgtgtatactgattcctctgtataacagaagcctcgttagtctaacaagcattacagataaatcagatgattaaataactactcctctgtttcatattataagtagttacgatttttttcagtcaaactacttaagtttgacgaaatttatagatggcaacatctacaacatcaaattagtttcattgaacatattttaataatacgtttgttttgtattgaaaatattacttatttttttaataaacttggtcagaagtttgaaaaaagtcacaacttataatatgaaacgaaacggagtgaatactacacttcacaatttggaaaaaaaatgtaacagctacagatctacaacaatctgagcaaagacattagaaagaaacaacatccaagcgaaatgcatatgtaactgcaaaactaaaggggaaacaccatcataataacctgaaccaacgaaggcaaaaccagcaaaatcccaaaaccacgacctcaaccttaaggatggtaaatcaagaacgtgaacgactcatcgacaagcatgaaaaccgaaaaactcggaaggattctcctccaaaatgagaccagaaactgaaagcgcaaacagaaaaatggactgaaaatacaaaagcaaaagagaaatccccttacatagtgtatgaccttgtgattacgagcaagcgcgtgactaccagacgaaacattccccaaatattgtgttactgtatgcgctttgcaatgaaaaaaaaaagaaagaacaagaaaaaaaaacacacacacacacaaccagaggaagcagaacgaagagctatccttccactgcatccagtgccactaaacagcaaaaaaaaaaaacgtgtttttccctcacaaattggtgcaagcaaccctagttaacgagaatggcatcgcaacccaactccagaaaagaaagaaagaaagaaaccgaaaatgtcacgcggcgaactaaaagaaagccctgaccttcccgggaagggccggagatgaacgcgggggcgctgagggcggtggggacgccccgcgcgtcgcgcctcgtgatcgcggcctcccgcttcgccaggtacttgatgaagccggggagcgtccgcacccgccgcgactccgcgaccgcgcgcagcacccgcgccgccccggcctcgccgagcaccgcgaggtggcgccgcgcctccgcgccggcgagctgccgcagcctcccctccagccgctccagctccgcggccaccgccgccgggagctcggccggctcccgcgcctccgcggagccgatggggttgtacatgacgagggttcgggggcttctagcccggcccccccgcgcctctcggcggcggcggcgaggagagccgaggaggaggaggaggcgatcacgttggcgttcgcgttggggcgcgcgatggagggaggaggttgggaaatttgggaggaagacgcgcggaggtgttgaaatggcggtgggtgttccacatggcagtgggaggtggattgtcgattgtgggccatgcggggtgtggggcggggcccaaggaggagtaattcgggtagcttgctcggcaccctacccttcctctgtgcttgactgcggctgtggttgacacggtgcttgtgtgttgtgctgcggtagaatcggtacggggggattgaggattcggattccatttccactgtgtcatacatcgactcatcgaatttaatgttgtgtttagttccgtgtaaagtttggattttggttataattcgagttaatgtagctgaaaagttgtgtgtatgatatgttgatgtgatgaaaaatgcctgaagtttggatctaaactttggatctaaacatagcctaaggtggtgtttggatccgaactttggatctaaacaaagcctaaggtggggtttggatccaggaacttaactttagtctctatatttagacactaatttagaatattaaatatagactacttataaaactaattatataaatgaaagctaatttgtgagataaattttttaagcctaattaatccataattagagaatgtttactatagcatcacataggctaatgctcaatagattcgtctcgtaaattagtccaagattatggataggttttattaatagtctacgtttaatatttataattagtgtccaaacatccgatgtgatagggacttaaaagttttagtcccatctagacagggtctaaggctatgtttagatccaacctttggattcaaacttccaactttttccatcacatcaacctatcatacacatacaacttttcagtcacatcgtaccaatttcaatccaaacttctaactttgaaaggaactaaacacagcctaaagataaagaaggcatagcatgactggggctgtgttagttccctttaaacttgcaattttttcctcatttggagatatatataatagagtattaaatatgtaaaaaaaccaattatacagtttgcatgtaaattgcgagataaattttttagtctaattacgacatgattttacaacgtggtgctgcagtaaagattaaccaaggaggagtagcttgctcggcaccctatccttcctctgtgctcgtgtgttgtgctgccgtagaatcggtacgggggattcggattccatttccactgtgtcatgcatcgactcatcgatggcataggattaagtagctcccaccgtcccaaaatactctatctatcccactctaaatgcaaaatactctatctatcctactctaaatgcaactatgagttttttatccgattttgatcatttgtattattttaaaaaatttataatcagaccctgtttatgatcggtttagatgggctaaaactttttaatccctgtcacatcggatgtttagacgttaatttggagtattaaacatagactaataaaaaactaatttcataaatgatagctaatttgcgagacgaattttttaaacctaattaatccataattatcaaaagtttattgtagcatcacattgtcaaatcatggcgtaattaggctcaaaagattcgtctcgcgaattagtccaaggttatggaatgggttttgtaattagtctatgttttatactctaaattagtatccaaacatccgatgtaaataagtccctgtttcacaatcccccttagattctaatttttttttgaaacttctaacttttccgtcacgtcgaactttcctacaggttagttcccaactttttcttcaaacttccaacttttccatcacatcaattagtacacacaaacttccaacgtttccgtcagatcgttccaatttcaatcaaacttctaattttagcgtgaactaaacacacaaacttttaacttttccatcacatcgttccaatttcttcaaacttccaatttcggcttgaaactaaacacaacctcggttcggtattttttgctgttatgagatgataaaatatgaacggtactttactcgtgaaaaaacgaatctacgactggacgcgatatattctagtataatgaatctagacagagatatgtccagattcgtagtgctataatatgttatatccaatactaggttgagtttttatgggacggatggagtatgtttttaaattttttttcaattttttttaaacaagacagatatccgtgttcaacatttaaccgtatgtcttatttaaaaatttattaaaaataaaaaaaatagtcacgtatataatattattcatgctttatcatctaacaataataaaaatactaaccgtagaaaaaatttcaaataagacgaacggtcaaacgttgaatatggacagtataaaactgcattttgttgaccgagtaaaaaggagtacgcaaggattctttaaaaataaagcagcatatccccgagtatagtttcaaaatatactacccatcctaaaatactactaatatctttaggattcaaattttgttttgaaatcttttcaaaaagaaattgtttcagtatattatcactttgaagtgctagttgccccatcatgcatttcgtttcaaaagttttctcattttaccctcaataaccatttaacttccggtcatgtattattcaataaaaggtattataatatttttttattaaaatcaaatcctgatgtctaaatttatttttagaattcaaatttttatagaacggaggaaatatatattcctgtgagatggcggatagtagcggaaaagggttaaggcatcagaatgtagtctaaaactagttcataagtaataaaatattccattcagccacctaaccacattatggaactagtccatagcaagaaaatagcaaaagccacacataagtatatgggctgcccatatagaataaaatatgttattttctctctctactcctaatactagttgctatctatatacattgtgaagataacaataattatagtccatatatgtgggtcctatctacatggactacttttgctatggcaaaagtagtccatagagatgggacccacgtatatgaactttaattattataacctacacaagtatatggatagcaaatagtattggtaggagaaaagagatagagacaaatgatatattttattctctatggacagcccatatacttatgagtagtttttgttatttctttcctatagttccacaatgttgctaggtggctgaattaaatattatattgcttatggaccacttttggagtacattgtggatacctcttagggcaagtactatgatagatgtggttgctacctccaaatttatttatggcattcaccaataaattaagatgcaagatatacaataagtcacctataatacacaaatatcaatgcctttagtactctcacattcttcttagagtttgtgtggaggctacctcttgatttaggggtggttcatcatctctcctcacttctctccttcatcttatcacctaatcctatgtgttatttttagagacagcacatgaagcactatagcacttgcccttagggcctagtactagcagagaggagggcgggggcatgccatgtcatgtcatcctggcgtggcgtggcgtggcgtggtgtggtgaacttgccagaaagcagaaagcagagagtgcactgattccttcacaaatctggcgactccaccagtctagagaggagtagactagtagtaggagtagtaggcatgctgctgccctgccatggaacagacatgagcagcgccgcgccgcgccacaccaccccacacccactgataccgaaagatatcgtgatcagatccagtgcagttgattcagggctgtttggataaattttagtccaatagaatgtttagcactaattaaaaatattaaatataaactaatgataaaacctagtactccataatcctgggctacatgtgctaattatatattatttaggattaaaaaatttatctcgtgaattagctctcatttatataattagttttattattagtctacatttaataattcgaattaatgttcaaaaatttcagtacctagatccaaacaccacctcagcaccacatgatgagaaatcaatgactcatatcaatgcatatcactgtagtaaaaatattacttttatacatcatatagtaacgaatgtgaatcgttagatcaaaatatggatggctcagattgcttgcagtttttattgtgcagttatactcatcaatccataaggaagtgtttggcaaatgtcaaagggaaatgatttccacccatttttaaatcctaaccattcattcacccttttccatttaatcctaaacttttattcatttctcaatctcaatcccaatgccatcctccattttccattatccaaacgcaccctaaaagtatgatagtagggcagaattaacagtcatacgaaaccgtatatttgggtgccgtaatctgtaatcagctcacatcctcaagcgannnnnnnnnnnnnnnnnnnnnnnnnnnnnnnnnnnnnnnnnnnn

SEQ ID NO: 39375 - DNA, 10740 bp, Oryza sativa
  unsure (1)..(10740): unsure at all n locations
aataaccttacaaagttgcatgaacaaatttaacttcactaatgagttacaaaattaacaaataacactattcatttttttctttttctgctatgtttctcaatttttcacagatgaagttcagtttatccttaaaactttacatggttgttcaatttgtgagatttttttttccaaatcttttgaaaacttttatatctttgtttgaaatgtaaaaatgagaaacatagaagaaataatgatattttttaaaaaaaataaaaaataaaatctcatagatagctaaggtaatagtactttgacaaccatgcaaagttccatgaataaacttaactttatttttgagatataaaatttgagaaacatagtagaaaaagacaaaaataggaatattgttatttgttaatttatatatcattaatgaagttgattttgttcatgcaactttgtagggtcgttcatttacatattacctacatgtgtgattttttaaagaatttttaagaacttttataaaaaaaaaattcaagtttccacctaggatgtgatttccaccatatactttccccatcaggaataacactatatgtgcatcttcggtaagtgtaagagcatctcaaagagaatggccaaatggctctccaagctaaaattggcaagtataaagaaaaatgccctccaacagcctctctattctgttggctaagccgtatggctagccaaatcacagcactcactggccaaacttggagagtcatttcggctggccatccatgggctccaccactcctaccatctctctctgcccaaatagcagaggaccatggcagtggtggtgttacagtaggcttccttgtcgttcgccgccgtcagctctcgccttgtgtgcgtgggatctgtcgcctgcctcacgcgtggggagccacagttgcttcgccgcccgcgcgtcgccgctgtcaccgcccgcgcgcgcgcgaagccgccgccgccgtcgccccccgcctctcgcacacgggggagccaccgcagccgtcgctgctcgcacgcgcggggagccgctacagccgttgctgctcacctcgtcgccgcccgcgcgaggggaagccgccgccgcctgcctggcgtgcggggggatccgtcgccgccgcagtcgatgggctgatgcgggagaagagaaagagaaagaggaggaagaagaaggcaatggaggttgacatgggtcccttttttattttggagatgtaaatagagagactattggagtgaatacctagtttgactgcccaaatcagttagagagttggctataagagtatttaaagagtctaatttagagatgctgttggagatgctctaacagagaagaagggaaaacggttcaagatcctaagaggtcaccgaaagatgtcctctaggatttgaggtcttacgaaatatcctcctgatctccaacagatcagacatgtctccatatagtgaaaaacttcgtgaaggcccaacccgacccatcaatcataaaaggaataagtccatcttacctcactcatctctttcacttcgccgaataacatccctcaaccgcaaaaccggctataatacctcccccatctccgtaaaccggtgcaaatcgactcctccggtggttttgaaagcggtttatgctgatatggcaggttgacttggtccgaatgtgctgatgtggcagccatgtcattaaagggattgaagatagaagtgggtcccacatgtaagtgacaaatgctaaaacaaaacggggccccctgtcagccccatttttttcttatcttcttcctcctttctaccttcttcttgcagccgcacgcacggaggccgattcggccggcttcatccaacactggcgccagttgatatgaggtggaagtcgctgacatgtgggccccaattgccaactcagcgagtcaaccgcggtctagcatccatgtcagcaaatactgcttgctaaaccactaaaggagataatttgcaccggtttttgaagatgagggattcattatacccggttttgtggttgagggaggcaattcaatcaagcgcaagagatgagggagacaaaatggacttattccatcataaaaataatgtggcatctctaggcccagtccattacagttcttcaccaatatttattttcctttttgttttttatccacctaagaaagggggaaactacatccaattcgaatccgataagaagaatcaaatccattgcgtgtagaaatggagaggaacgaattcgccggagatctctggttgttgtttccccggaccagctggtgcatttctccctgatgggaagagaagccagctcggttacaagccatggctccgcaccggcgcgtccggcttctacaccggagctcctcgcatcctcctccttcagtaacggcagcgacaaggttctataaataatgcttgtttgcattgtttgttgatatagaggtcgaaaataatgcttccattatcgttgtctagggagtggattttgatatcccgaggggacgacttctcgttgtttgtacgtcactcaaataattatgaaaaaaatttaaaaaatatattaatatgttatgttatattatatttaacttctacatttcacaacgagaaaaacatattaaactacagcttgttaacatatattcatatgtcaaatttattttttttccgttgcgagatgtaaaagttaaatttaaacttgtatgtttatggattgatatatcacatgctaatacatcttcttaatttatttttcataattatttaagtgacatccaaacaacgagaaagattccacattaattatctaaagcctcaatctctactcactactggagaaaccatctttggtcagttgcctaaaatccacaataatcctggtttgaattttaaccgggactaaagatgactttagtcccggttgaaagagctgacatcactttttactctttagtcccggttggtaaaatcaaccgggactaaagatcatttttagtcccggtttaaaagaagacagactgtgtcagacccttctattatctttagtcccggttggtgatccatttttaatctcggttccttataacaaccgggagaaaaaatgaaaacgaaaaaaaaatcgcagagcaagcgccgcgcctcctcgtcctctcgcgcgcacagccttatcctctcatctctcctcgtctcccttcttatcttctccaatctcctcccttctcaactcctcctcttcccccttcctccccttcacctctcctccccctcccttgcgggcgcggcgcgcggcggacggtggatgcggccgcggcggcgcaggcggtggcgtgcgacagaagcggccgcggcagcggccaggcggtggttgggatgcggcctggcggaggacagcagccgggtagcggaagaggccgcgacggcggccgggcggcagctaggcggcggcccggtggagggcggcggccaggcggtggctgggctgtggccgcggcggcgcaggcagcggcgtgcggaagaagcagccgtggcggcggctaggctgcggcctggtggagggcggcgggcaggcgacggcggcagtggaggatttgtttattttttggatttgtaatgaatttgcttttgagaatttgtgatgtatttgatctgtgtgcgatgtaaatatgtgatgtatttatgatgtttgtatttgaagatggtggatttgtaattgatcgatttgagatttagagatgatgttctgttatgtgattctgggggatgtggtgaaatcaatattcaaagtagaaaacaatacaagaaaagagaaactaccaatcagatctgacttcatctttagtcccggttggtaaatgactttatttttaatctcggttggtgttactaaccgggactaaaaatcgatctttagtaccgggtatttgaaccgggactaaagatagcgatttttagtcctgcattcgtagtctcgatcgaaaaactaagactacagatggttataaaccggtagtaaaaagcctttctctgctagtgacttgatccgatcctctctctcttcacctcgccgccagcctcgggtggcgccgccgcctcctcttcgtcgttcttggcgacgacggcggggctgctaactagccgcgcctccagctcccggttcttctcctccagctccgacagctttgactcgagaaacttcacgtactcccttgctccgatcagtatcgacgacgtcttgtctttctgccattaaaatggatcgagaaataatttaagcaaatattagtgaagatcaatactaatcaattaatacggagtagaagaaaatgttcatgaatatgcatgtatgcatatgcacgtgtatacgttcgtgtataagccagctataaacatatttcgaggagataaaagagaagagagaatggtagcgagctacagatttgtagctaacttcagcacggactccaaggtgcaagtgtatatgacatgtgggaccagatattaattatatagtatatgtttataattaactattatattagttggctattaagttggttatagataatttgaagccagcagttgactgtactactgtattaaacttgctctaattaataattgtacctagcttggagccgggagggaggacgtacggcctggactggagggcgacgaagctgccgttgagcttctcccgccgcttccgctccgacatcgtgtgctgcagctggttgctggacggcggcggccgctgtctgctggtattagcactggcgtacgcctgtacattgttgccgtgtgcatcttggtcagcaccgattctatggctgtgtttagatcacactaaaattaaaagtttaatcgaaattaaaacgatgtgacggaaaagttaaaattttgtatgtgtaggaaagttttgatgtgatggaaaaagttgaagtttaaaaaaaaaactttagaaccaaacacgctctggccctgtttagttccccaaaagttttcgccaaaaacatcacatcgaatatttagacacatgtatgaaacattaaatatagattaaaagaaaaaccaattgcacagttagggggaaattgcgagacgaatcttttaagtctaattagtctatgattagccataagtgctacagtaatccacatatgctaatgacggattaattaggctcaatagattcgtctcgcggtttccagacgagttatgaaattagttttttcattcatattcaaaaacctttttttgacatccggttaaacatccgatattaccacccaaaattttcatttggcaaagtaaacggggcctctatctatagaactggcacctagctataatctttaaaataaaaaaatgtgtcgccgccgtctggtggagctccgacaggaagatgacgccgctgaccgtgacgcccgagaaggcgccgccagcctagcttcttgcactgttcaactcattattaatcgattttgctatatatttgtcgacaaattttcccctaaaaatttgacaggtgtaattacagtacaatcgtaatataattacactgtaacttgcatgtaattacactgtaactatagtgtaacttgtatgtaactttcaaaaatctatccgtaatatgttatttcggtaaattggaggtcgtgggaacaaattctttcacatatgtgtgtgctatgatttattttctttctcaccaaaataaatcttgtaatagatctaatgatttaaaattatgtgaaacttacatataagttacactgtagttacatgcaaattacagtataattacatataagttacagtgtaattacactacgattgtactataattatatctattaaatttttagaagaaaatttatcgataaatgtataggtagtctcttattaattagcgtgcctctccgggcttctccccatccccatgtacgagtacgaccacctcccgcccccggcgcggtggccatccaagcgagagctcgaatcaaccggtccaagaaggaggcgccccacaccaactttgtcagcccgcgccgctggctatgtcaccaccggccgtctacatctgcatctcgttatagtgtaattatgtgtggattacactctagttaattacatagtgtagcatttagattgtaatttttattattgttctatagtataatttctacttattgtttatacatgtgcatctctccctgcttcacacaatcctggtctccacaaccacattgaaatagtgtagtaagccaaatgcgtccttggcccgaggaaccgagaaagttgcagctaaacacaagagtaattagtgtgctcacggataacgaatcaacagagaacgtgccaaagaatcacatatctcaagatgggatctgatggtaaaaaaaatcgtatgatacggtggaaaaaaattctgtcaaatgatttatagcaaaaccgataaaatattataaataccggttttccctttaaaactgacacctatagttaattaaatatatcagttttatatatttttattccgtgaaggttagaggtttaaatgagagaacttttatgttacaatatactacaagtatatactagcagtataaatgatagaacgatatagattgtagctgcaatggcttcaactgcgagcttcttagcctcatgattatgcgctctgcttgctgccaacacacccaccaccgcagctgcgcctcccgctatacttggcctccccgccgtgccgtcgttgcctacacaccgccgccgatgtttgtcgttcggtcaatgccatgggtcgtctctctgctccggatagattaggcatctacgatcaatttgacaattagaatgaagatgaatcacgaattactaaatacccctttaaatttggcagggaatccaaatgtgtcctcatttataatgttagtatatactattagtatatatattgtaccgtaaaattctcttaaatgaaccaacacctataaaccgataattattagaagtgttgtagtagtgcgtattggctgaacgcgccaccgatcgctggcaactccatcgccggtgacggtggcggtggcaggctagcggtgtaatggttgtgctggggctcgctcgttgcacaccaagggtggtggtaacggcacctgcgaggagacctccagctactggaatcccgtcaccgccaccaccgccgacaaggtctttgggctgtatgacctattagggaagagatttgcttcagtccaacaaaaagtatctcgaggtaccagtacctcacggtatcaaatcgtttccgatcgttggatttaagaatatctatcttgcctaactagatccaacgatcgaaaacgatttgatactgtgaggtaccagtacctcgagatactttttattggaccggagtaaatctcattagggaagctaccggcggcgacagcatgcatggtgcgtcgacgaatgcatcaggaggtcgtccaccatggcggcgccgtacaccgcggcaccggctcaccgcggactgatcatcgtcacatcatccatgctcaagctcatgctgatctgcatgtcataatccaaaacccaacaaagttaattctacaatatatttctttgatcttatatgcattgattgttcatgatcgagctagttaatcaataaaaaaaattgtgatataagcttgcctggttgaaatggcgctgaatctgcgaggagctgatgaacagccgctcctgctgctgctccctttgctgaaactcccgggggctgcagctgcaataataatatgcacgacagaacagaggaattcacagaccatatatacattatcgtctcgatcaatcgtgatttgtacagtggtgtagaattcctttaccagtttgacatcatggtcctttacttttcagagaatcttgttataatatttgtgtctgctagctatgactgacgacgaacgttacagtagtattagtcaactttcacgcttgattcttaatgttgacctgaagttactaaagtaccacgttaattagccctccatcattatcgatcggccatcatgcagacttttggggctcgcaggatcgtcagcagagtgaagtaattaattgaggtgtcaaggctaattaattcaagccgtcaagaacattgcatgcccacgtattcgaatcaatttgtttggagagcagttcagtttttatttagttaatttataccttcttagaaccatatctaatatgtttgatggttggcttttgagggttgacaagttcagttctcatctgatctatacctttctagaaccatatctaatatgtttgatggttggcttttgacggttgacaagaaaaagagtaaactcatacttgtaggagcatctgccatatgttgggctctgtggttgagtaaaaatgatatggtatttgacaaatcaccatctatctcatatttacaggtaattttcagagcaacatattggctccgatgttgggtacaactgcaaaagtatgaagatgatggagagcttatgaaggttgcatgtcttaggcttgagacgacagttatgtaactttctgcaaaatatagatggagatttataaatagatttgaataaatgtgtactccttatcttgatttggtcttttattttgttgggtgtgtttatttttattttgaactacactcttcgttagagtgatactttgcaaggccggaatgttttattccattatctaaaaaaagtatgagtatgtgtataaggttttccattatcttagagagaaaaatgtgtacaatcataccgtcaataatgtacatgaaatttcttcttttcttttctttttcttttttctgatcaacgaggtgtgagacagctttggcgtttgacttcaataagaaaatgtttaattagttagttagttataccttgagctgtaatgttaggtttgcactaggagggcggccgccggagccggcgctggtgctcatcgccacgaggctggcgccgtcgccgatctgctctctcaggcactgcagcgtccggagcacaacgtccgtcgtgctcatgcctccgccgccgccgccgcgcaagtccacgttgagcgtgcaacaagtctcttgatctcctcctgtcgccgccgcagccgccgctccgctgccgccgctcgtcgtcgtcacctcgatctctactaggtcctctcgcttcgtctcgtcgccggcttccgccgccgccgtctcgcctttgtcgttcttggcggcggggcggctggctagcctcgcctccagctcccggttcttctcctccagctccgacagctttgactcgagagactttatgtgctctcttgccctgatcagtatcgacgccttgtctttctgccattaaaaaagagaaatattttaagcaaatagtacggtttttttttcggtcagataatacttgtcgttttggataagcgtgagatcaaactttagagtatttaattatgaattatttttaaaatatttattttttaaatatggtaactatagtaaatatatgtatatagagtagtcttaaaaagtactttaataaggttatatatttgttaacacttttatatatattataatgaaaaataatggttaaagttgtttatttaagatcgtgccttttacaaaacaataacccatattatggaattgctacgtatctgtcgacagattttctattaaaaatcagtcgatttgttgaccgcatgatttactttgagatacgtgcatgtgccattgagtgaaaaaaaaaagtcgctagaaaagggaatcaaacccatgacgtcgggatgccacaacatgcactccaccaactgagcaagcagcggacaacagctttatgtctatacttaacatttttaaaactttcaatgcagttacactacacccactcacaccattgttataccacgattaaaatgtaagtgcactacagatacaatgtaatttttaagtacatgcgggtgtagtttttgttttacatgtacggatttactcatcgttgttttgttgcattgtagttaacttaattgtttgaggtgtgatttgatatttttgggactatatataccgttgtatttttcataaaagaagttttacattgcaagtacccaaagttacatatgtaattttaatgtatttacactgtaagttttaaaattacatatgtaagttgatgtaaataggtgtaagttgcttgtttttccttttcttttagcatcattgaagtgattaacgtccggtgactgacgtacgttgatatgttttcatttgaaccgcacgtgggggtggcttgaaaatccgactaattttctacgaaaaatctgtcgaatgatttttagtctgtctaaatattattaacccggagagagtattagtcaaggtggtgaagaaaatgttcataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39376 - DNA, 5957 bp, Oryza sativa
  unsure (1)..(5957): unsure at all n locations
ccctgctccactctaagaattgaaattcgcaggcatcagcaactgaagacatgggacggcaaatattggcctttggtgaaaggtgtggtgttttgattattctactgtattgctggaccttaaagttttgcctgttgcttatatctctattctatccagcgccacatggttatactattactgacttaatagtaaatacaaaagtttaatatgcactctagattttatagaactcatgtttagtagggttcagatgaactatgccatttgacttgttcatggaattaggatagaaggttatataatataggctggcaataacgtagcttttatagcacaaattattgctctctttatcgtttagatcagtacaagataactgaaaaaaacaggtttttacacttgataaatctttctgttggcattctacagtatttgcagaaattatctaaattattgtagtgagttagaacacccacacccccttcattccgttccatattgtcttcaatgtactcatttctgttatctgatgtgtatgggcagttattttgtatgtgctgctatataagctaaaagttttttttacaaaataaataaataaaaatatatacatattcaaatgatgaagttccctccatccagtttttccaaattcagaccttgtaattttagcccacaatttgtcatgttatatgcatattattttatccgtaaatttatatatataagtttttgtgttttcataggataaaggaatatgtaggtcttgtattgtattggaaattaatattcaaattttaattttgatgaccataccaactcaagccaagcctcaaaaaattgtacagagggtgtatatacctcaaactcatagcatggtgtttattatcctgtgttccctggaatatttttaatcttcaatgcaggctaatttacgccgtaatttttgtttcataaaatttttcaggaaacctgttgagcaccttctcaaggctgttgatggtgttactctgaaagacattacagcccttgctgagaaaatcatatcatcaccattgacaatggcatctcatggaaacggttagctcatatttttcatatgtagccagtcatctttacatagtgtaacagttgcagtatcctaactctgccctttacgatgcagttctgaacgtgccaacttatgattcagtcagtggcaagtttcgctcgaaatgagtagtaatgtggtcattgttttcctcctcctggacaagttttaactgttgatagtttttcctcaggccattcattggcagggtttcagagagaaaaataaggagcttcatacaattttgatcatttaactctggatgattgagaataccatattttacctttttctgcaacatttgtccacttgagttggaattttttatgctgttttcatcagttttatgggcctgtaaattttagggccctctttcggtggcggccagggcctgtacaaaataccggtctccttgcaaaatctttgacacgaatgctgaaacacttgaataaatattctatctatactcttgcatgacagtgaaattctgcaggagatgcgtccaaagcgagggaactgctgtgagccatcgcttttccacaattccaatcacgttttgcatgctgtttggactgtcaattcccgtctgtttggttccatgattgaattcgaggaaatcgagctcatgagtcgaaggcaaagagcaaagagcagctagaggcagcaatgcaggctggtaaactcccaaatgccctccaaggtctatgaataaaattaattattcagtatcatctactgtgctgaaaatgcagcaggggatgggtctgtgtacgatggtgcatcgtctggatgagctctagaaccaacttcctgcgaaggaaaatggttgtagcagcagcagcagccgaaatttctgagaaggtgtcttggttggaaggaaacgacacccttggttgacttctgggccgtgtacgagcggtttggacatgagtggcccatgggattggaaagggagggtccaggtcgcgaggcgacaccacatcggcaaagacgacggcgacgcctcctgtttgagggagtcgccgtttctgactccgagctcccggcggctggaggggccagaattattgcagtcgaggagacgacggaatgcaatcgcagtgccaccgacccacccaccacccattgccgatttgccactcgttgttccgagtccgagtcgttgtttgttggctcgtggatgctcctctacctcgacgtctccgtccttggttaacctgctcaaacaccggaggcgccggcgtttctctctctctctcgctcgctaaccccatggttttctcccgttcggtcttcttccttttcggtcgagtcaagttatcacaaacctattcatagcttcctgataaccacgaaggcttatatatgtgggtttttttttggagagtgtatgcaagaaaattattttctaagacaacttgccaccgtttgtgtggttagtcctggaaggctggaataatgcattgacagcattgttaccaacctactttttgatgctccaaagagtgaaacaaggtaccaaccaattgacggcatgctagtgaccactccccacgtcccaaaacgtggttacctagaacatgaagtgatattacctagtactataaatttggataaggacattaggaatctgaataaggacatattgggtaatgccacttcatgttctactatgtattaatattttgggacgaaaggagtaatgactagcaaatgggaaacaagcaaagtttgtaggcttttcgtgttgttatctgaatcctctaatggacttgttgggttatactcttattagtgacgtcgctgaaatctgtatatggttaatatggagtggagtaatttacagtagcattcctccaaatcaaataagtcaaagaatgtcgtattcgcctttgcctcgattgatcctactacatcatcaaggcataataatgtcaactagctacaccaatgtccaatggaagttaacacttaactcgagaaacgaacaaagcaaagcaaatgcatattttacatttcaagaacgaatctgaaacaagtttttctttttgctatatttttttccctgtcgaggaacaagaagaatttggagttggcacctagatgcatccatccgtttaaataaaggattggcttgggtttattaggacccaaattaatcattggtttaccagatagccgtttcgtatttaagtggattaaactaacgcaacggcggcgtttattcacagccacgaacaacaatattcatttgaacactccaatcatataacactctcaaattaaagaaaaaaatacttgcatcactcgcgacagagccaattggacgaaaagaaagtctatacatcgcttcatcaaattagaataacatttttcaatgcatcataatgttgcttgatgacctccatggagggtgacattttggactattgaaattcagctttgtgtaactttcatccacttcatccgtcattggcagcatcatgttagtttatacatagataaaacctttaatcatcaccaatggaaggcgatcagggtgagacagagggaggtaggtcatgagctcatcatgcatgcggagataatacctgtgttagataaaacctcatgtatgcaaacatcactggttactaattggagcttacctgtctaaaaaaaaaactaattggagcttagcctgctgcctttcaacttgcatgttgttcttttgtttcttccacttgatataattttgatcttctccaataaaaacgggtaaattttttgtccgttaatttaatctggcaaaattgggaattgttgctagctttctataatctcaaacctgagattgttgcagggaccatgaaatgaaatatagttgaaaccaccattatctgcttaaccagcagttttcgtttatttctagtatgtgttttgcggcacagttgtacagttttttttttttttgtgaacatacagttgtacaggttgagctccaattggacaagctagctaggtagccaaagaattaatcgacaaacttgacttcgctaccaatcaatagtttattttgttctcttgtctttgtctgatgtagaaggagcatttaaatctgttcatttgtagtttgataccaccggtatgtgtcgttttcatgagcaaagcaaaccgaagaggaaggaaggaacggacgccaagttttcggagatgatgctctcattataattttgtttttctcctctgaagaaaaggagaagttcgagaagattttgtggtattcctatataataaatcacggaaagtattacatcactgacactgtttttagcatagagaacatgttgtttgatgtagcattctgcattccttcaaaaggaaaaagtattttttttaaaaaaaaaaaggtaacaagtgtacattttgagtataacatattctgttttcctatgtgaagctatatgaactcttttctactccatggaagcatagccttagcactcctttttttaatatatgatactgttgactttttgagatacgtttgaccattcgtcttatttaaaaaattgtataattatcatttattttattgtgacttgatttatcatcaaatgttatgtaagcatgatataaatatttttatatttacacaaaagttttaaataagacgaataaccaaacgttaataaaaaaaagtcaacgggtatcatacattaaagaaatgaaggaagcatttatttgtattgattggaaattgaagctaccatcttgaccttctgattggaaaatgaaggtcctgattacatgattctacacatgaaacatgcaagtggtatcagctacccaaagtcatcaacaagaaagacaacaagaataatgcatcccaaggaggagatgataagaggagatcgattcggatttgacaaaacagggaggggaaccttaatatgccctccattacaataatgacactttacacttctctcatctaaaagcaagtttataatactcatcacccatccctaacctctcataggtcacaaccaaacatctaatcaggatctcacaggtggatgcatacatgatatacgcacaataagcttataagcatctcccagggaataatgctcctgtcatcatccaaaaccactcgctggtagcctatctgcctctgatctataagcttatcagggaccatgtgagaggttatcaaggcatcagcaccctgattttgactctaacccaaccataaactaaccaatgctaccactttttaattactagtttgttggcgtgctgtcattagtgagttgatcagagttttgtgctttgtttgcttgctgagagagagattgacaggaaagaaaaagaaatatgtgggcggttgaggaagccaagacggatcgcacatagtcttgcaataaaaattgtgaactccacatggatgcgactggagaaaagagcttggtcggccggccatggagtctttcttctatggctgcctcctctcaatgtgtcctaagctttgctgctgcctgtgtttgttttctttgattagtctctttcttagagtaattagagtcttttatgaaagttgtcatggacgcatgtatcactcggacaggtagaactggttcaggaattgaagacaaagctaggaaatttaattaggaattgtttagttagggaaaaatttaggtttagtggttatatcggatatgcggaaacacatttaaagtattaaacgcagtttaataacaaaataaattacagattccgctctgaaaccgcaagacgaatttattnnnnnnnnnnnnnnnnnnnnnnnnnnnnnnnnnnnnnnnnnnnnnnnnnnnnnnnnnnnnnnnnnnnnnnnnnn

SEQ ID NO: 39377 - DNA, 1000 bp, Oryza sativa
tcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaaagtgtgatttatatcttatacatttgcataaaatttttgaataagacgaatggtcaaacatgtgagaaaaaaaattaacggcgtcatctattaaaaaacgaagggagtatcattctcatctaaaagagtaaattccctgtgtacccctgaaaactcactcaatccctttcatacccctaaaatttacccgatcccttctatacccctgaaatttcaatttgatccctcccatgcccctacccttaaaatttacccgatcccttctatacccctgaaatttcaatttgatcccttccatgcccctaccgtgaaatttcaaattgatcccttccatgcccctaccgttacattttccatcatttcagtgttacgtttggttgcaaatgtcctttttgcccttgatgctttaggtttaaatataagcttcaaaaacaattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggattttttttatcaggag

SEQ ID NO: 39378 - DNA, 5774 bp, Oryza sativa
  unsure (1)..(5774): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgctgctgctgctgctgctgctgccgccgccatgttggttaacattgacgaacttgatgccatggtgggtggcacacacactacgggaggcttgagggcatcctcgcccacggtcaatgtcataagggttcccatcaactggatcgacaggaagcggcacgtaccatagaacaggctccggtgggtcaacccttcctggatgtgccactttggcgacgatcatccctgctaccaagtagtccacccagatcatgtagcgattgtggtacgacaacactgcatcagttgtccaccagcacaggtgagcgaggccgtcgccatggcggatcggcacattcctgaagactctccagtcatcggagccagaagcaaagaggtagatgttggtttcggaagattggcatgatcttctctcgagctcagccacaacgaacgaaggagaattgttgctgcaggacagaatacatgtgccttccctgctcatgatgcgcgggcgaagggtgtctctcctcctccagtaggagacgggcagccgcgtcaaggaggggtggtggttgctgctgctgctgctgttggcattgtagacgaagtagtcgatggcggaagggcgagcgtacttgtcgggggagatgatctggaacaggacgacgttgtcgtgcgcggcgatgacgtatgggtaggatgtggttcccgccgacgggcggggcccctgcggccagtcgagggtgaggagggaggtctccggcggcttcacgagctcgaaggagacggagatctggtcgccgccggaggtgtaggagaccgccgacgtggtgcggtcgcggtcgtcgccgcggaaggaatccctccgggcgccgtaccgattcaggatcgcccaggttgaggctggattggaggcgcccgcgtcgtccaacgatagggttaaggaggatcgcttcggcggccgcccgggaatctccgtttccttggtcggcgttggtccgcgacgggatgcgtcggtccggtgtacggcccgcgaaccgtcggacgatcccttgcgccgcctgtggctgcgtgtccccgtccccgtctccgtctccgtcgtggggatccgcatggcggcggcggcggcggcggcggcggcgagggtttggtgtttggtgtttggtgcgcgaaggggaaaacaaaggcgagacgaagataaactactcttgactcttgagtgcaacccgatacggatacgggtgacccaagtgccaacgcaattgctgggcctggctgggaggctgggagagtccgagtcgtgtagttcacttttggttccttctatttgtcgcttaatccgattttcatcacttcatcgcaaaaccggcataacaggtctcccagcatacaaaaccgtttaaataagatccctcggccatattgtgttcggttttaacgcttacatggctccttttaactaggtctttacctaacgtgttattgacgtagtgcttatgtggcaattagattaaaaaataataaaatcaataggacccatgtgtcagttgcacacacaaataataaaaaatggtgggcccgcgcggacccacacgttatcctcactaccccttctctctatcccctgttctctctctagccggtggagcggggtgggcagtggtcggagcaggcgacgacgactcccgctgctcaaagtcctccagaccccgcgccacggcgcgctggatgtcggcagcgctgcgcagggtggccagagcctgcagccgcggcgtcccggcacacggacctcacccatgcctcacgcccactctgctgacgccggcctcactgtacccacgaattgagtacgtcggccacgcacgcattgctctacgcccatgcaatgccggtgacaccaaccgcatccacctgctcccgcctacccgcaacgcctccctgacgccatgactttcggccgcaagcagcagcacctcgacgaccgccggaccgaagagcatcctctggaatgcctcggttcaaacctcccctgcatggcctctgcgccaccttgctgctgccccgccgagtcaagctacgccgctctggccgtcggccactccgccccacagtcgccctctctgaccccgcgccgtcggctggagagaaagaagagggagacagaggatagagagaagagggcacttcatcaagcttttgttctatgtaatttattatgactataagtaacatgagactacgtatttataattggaagttggtttttaaaccttagaatttgattttgatttttataacaattttagcattttttttcactatgcttagcactcgtttcactatgcttagcactcgtttcacaatcgggtctagaaaatctaatctaaatttcaaaaatgctttgaattaattctaatctgcaacataactttctgtacaatgttttgtactactccgtttcacaatataagccattctagcatttcccacattcatactgatgttaatgaatctagtcatatatatctatttaaattcattaacatcagtatgaatatgggaaatgctagaatgacttacattgtgaaacggagaaagtagattctatagctttagttcaaagtgtactctctacgttgttacgctatagctaaaattttaggctgggtccgtcaatgtttacaggttaatccgcttacatccttaatactttctccgtccagaatataataactaacttttgagattgaacggaggtagtagccatcaacaccagggtaatgcacgttgccatcatcatgagtcgtgagtcgtgacaagtgtgacgtccagcttgactgagctagtacaagccaccatcccgacactgttcgagaacccgtccacgttcatcccaagcatatgcatcgtccccaccaaaaaatcccaacgaatccaacgccctttgtcatccacctcgtgtcgctcgctcgctcgctcgcgcacacaccacccaacggattaacatggtggcgccggcggggagcttcttccaggaggccgccctcccggagcagcggctcgtcgagggcgtcgccttcccggcggtgctcgtcccgagcgccgccgccgccgcggccggtggcggcctcgacgcgttcctggacgccgtgcggtcggagagggcgtccacggtggagccgctgctgcggggcgccggcgcggtgctgctccgcgggttcccggcgcgcgccgcggcggacttcgaccgcgccgtggacgccttcgggtacgcggagctcccctacgtcggcggcgccgccccgcggagcaacgtggtggggcgtgtcttcaccgccaacgagtcgccgcccgaccagaagatccccttccaccacgagatggcgcaggtccaccatacaatcacagcaaatcgaatccaattcgagttcaagaaaatgctttcgctacaagcttatactaatgtttaaaattaagctgagatttcatatatgtttttggttcaggttccgacatttccggcgaagctgttcttcttctgcgaggtggaaccgaagattggtggtgagacaccgatagtgttgagccactacgtttacaagaggatgaaggaaaagtatccagaatttgttgagaaattggagaaggatgggctgatatacacgagggtgttaggagagggtgatgatccgtcttctcctattggccgtggatggcactctacatttctcaccaaagataagagcattgcagaggaaaggtctggctttctttttctgaaatcttcagttacactgatatataccgctatatcgtaatcttgtcatgagttctgaatgtttgcacttgcattcagaaacccactgcaacatcgtcgcattccaccataatactccctccggtcataaatatttaacgtttaggattctgtcaaacttttaaaattcaaaccatcaacaatttctcgaatgcttagattgcgagcaatagaaattgtatacatagatttgcctcgaaaagtacagtcataatcttatattttacaaaagatataaagtgataaaactgatggacgaaattttgaaactggagggagtacgtttcattgacctgcatgcatgattcaatttagaaccaatggaactacagagttcagttctgcatgaccacattcagtaattagccacatgaaaaaccttcaataattcaagccattttagctgctcatcaccgattccatcagcccatcgaccatcacacaaatcacactacagggtttctcacttgaactagaattctgacgttaccttcagcacaggtagcaatgtatcatacatgctgcagctactaactgaagttactgaactgtcactctgtcaattaattgcacttagggctgcgaagctcgggatgaagctggaatggactgaagacggggtgaagacgatcatgggcccgataccagcggtcaaatgggacgagagcagggggaggaagatatggttcaacagcatggtggccgcgtacaccgggtggaaggacgcccggaacgaccccgtcagggccgtcaccttcggcgacggctcgccgctgccggccgacgtcatcgccggctgcggcgagatcctggaggaggagtgcgtcgccgtcccgtggcggcagggcgacatcctgctcatcgacaactgggcggtgcttcactcccggcgatcgttcgagcctcctcgccgcattcttgcttcgctctgtaagtaagcaaaacagtttgggtagaaattgggaattgtggatgcatgatcatcaggaggtgtgggcaatagtgtgaggaattagtctgcagtatgtatgtatgtgtagcatgatttgcaggcaagaaccctgaataatttgatctgtgccaatttggatgtgtagttgtgtagtaccaatctgaatctgtgttgtcgaacggtctgacgaacctgcaagctctgcaatcttagttcttcagagaggcccgcgattagtccgtagagagggcagcttctatatcaggttgggctgggcctatcagaattttcggttgcagaagtaggcagcatgactgcttgggctagatttgatggcccacatatccggccccattgttccctttatacttatactagaaaaaatgcctttcaacgggtgaaggttcttttagttattatattatacggtttagctaagttgaaattcaccatgggaattcccttggatttgtttatttttataaaatcatgagcggtaattaggaatcttatcgtctcaagttagcatgcgagttttttaaaagagatttcttatacgactctccttctatatattttcaaaagcgaacgatcttaaaaaccgactcaaacacggatctgtatttccaaaagcgagtgaatttaaaaaccgactcaaacacggatgcgcgtacgggctgcaggaat

SEQ ID NO: 39379 - DNA, 11207 bp, Oryza sativa
ggcgagcacacctcggcgcttactcgccatacgtgatctcccatacaaggttcaaaatttaggaacgaaatttcggtcctatcgccccccccccctccagatatgatatttttttgtcaaaatttccatttttttatgaatttgacaatattttgttcagatttgaccaaattctgttcaaaattttggatcaaaattttcgaaatttcagtatatcggcaccctccactacaaaagccaaaaaacgaaagattgaactctgctcccacatctccggctgattgcttgaaaactgggcggctcgatcggaaacagcaaaaggaaggccaaggtctccggctataatttctcccctgttcgcgtttgcactctgaatagtaattccacttgatgatcgagaagatctcgtgttccatgccgagccggttggttcaggcttagctagagaagacgtcagtgtcatcaggtaacaacaacaacaacaatgcaacaacatggcctcctccacggtaatcttttcttcgagcagtctcttcgagatgcagtggtaggacagtagcactccataatggtaaggtttttagctatagctcgttgtcggcacgcgactgattgatgattcagtcgcactaactgaacaacaccaagtgcgcgagggcatctgatctcctacaacttttgcatttcatatcgcggatggatggatggatggatggatatatatagatgcgccaaaccgaaagaaactgatctgtctgtgcaaaagcaaccccaataacagtttcgatcgatcgatcgatgcaaggacgctaagagacagaaagcaacagcaacaatggtaatagtactagtacttccaccctcctaaaatatagtaatcttgcagtactgcataggacggagggaatagtaccacctccgtcccattataagtgcagctattgttttccgcgtccaactttgaccgtccgtcttatttgaaaaatttttgaaaaaaattaaaaacataagtcacgagtaaagtattattcatgttttatcatctcataacaacgaaaatactaattataaaaaaatttcaaataagacgaacgatcaaagttagacgcgaaaacttatggttgcacttataataggatggagggagtaattactactagtaaggtattctttgtcctttgcttcaagagccgattagtttcagggttgttgagactgacgagacttcagatttggactcgtctgatgcatgcactatgttaagttttcacttgtactcattattgctaatcatgtaagtagtagtatagtactaccagctagtagtgcaaacacaccgtcattagcctttgtttaatcgttgagcttgtagagattaagtggtagtaaacgttaattggttcctgtcatccaagtctagccgtctaggaaagttgacgtaatcccgtctatagacaaagattcagaccaagaataaaataatctagactctagagagtagtagtgttatggctgtgtttagatccaaaatttggatccaaactttagtacttttccatcacatcaacctgtcatacacacacaacttttcagtcacatcatcttcaatttcaaccaaaatctaaacttccccctcaactaaacacagcctatgacgcatttttctgaagagttctgcatagtccaaaacaggaaaggtaacaagagattgtgcttatctataataaagctggatgctaaagatggcatcagagactagtatcacatcatcatgttatcacttcctaggagtatatatgttcaggtttaaatcaaatggacatactcctaaatgtgcaaagaatgtgaatgtgaatagtaccactgtcacttctacctagaaagcaattgacgttatgcacttatgcgtacggagtactccgtatagaccaattttgacgtggtaattttccaggttttgttcttcaaaccggtactacttcctccgtttcacaatgtaaatcattttagcattttctacatttatattgatgttaactaatctagaccattaacatcgatatgaatgtagaaaatgctaacagagagagttactagctaagctattccagtatccaatgccatgcctagttggtgcagatgcgtgacaggctttcagtgggtcgatcgtcgaagctggcccgtttatttcccaaaaagtttttcgcaaaaatatcatatcgaatctttagacacatggatgaagtattaaataaaaataaaaagaaaaactaattacacagttatggaggaaataacgagacgaatcttttgagcctaattagtccgtgattagccataagtgctacagtaaccacatgtgctaatgacggcttaattaggctcaaaagattcgtctcgcggtttcccggcgagttctgaaattagttttttcattcgtgtctgaaaatcccttccgacatccggtcaaacatccgatgtgacacctaaaaatttttttttccccaactaaacacgctttattggtagttaatccatcatcagctcgtatatactcctatcttggtagcttcactttttatatttgatggagaaaaatatcatggggtaccacatcacacgctgtcacgtactgattcgtaaaagtgaaagtcttgcgattgatcaatcacgatgcccgctcactgtggtgatagcacgcgcacgcaacgccatcacacaaatgatgcgttctagcacggactggtccggtttgcaacccctatagtcccgttgcgcttataaaacgagatactttttagtcctgattttattggaaccgggattattgtggaatttggtcgactgaccagaatttttagtcacagtttttattggaaccgagactattgtggaatttggtcgaccgatcaaagatggtttctccggtagtgtagcggcggcaaccaatgaaattaacctcgtagtggtaaacagtgtgttttacacagtacgtgtgtacgaacctgcccgtgttttcccggcacggacagatgttctagtaagtggtatgaacctgacagccgccggcggcggcggcgaggcgccggaggtgtccggccgtgccggtaaaaaagaacatgatcgatcgatgtcgtgataagatgtggacatatggctgtgccgccaccaccaccactagcttttgatcgattggaaaaaaaaaaaaaagttcgagcgcgcagccctggattgcggcgcggcgcgtgtggttgtggtggtggtggctctcgcgcgtggtccaaaaacgtgcgacatatcaggtcatctccccagtcgcgtcgcgcgcgcgggggatcggagagaaaaccacggggcgcgcgcgacgtcgtcgagacagcgagccccaatccaccggccacgcaaccacgacaaccgcacgcacgcgttctcagtggtcaccaccgcgccagccgcgcgcatgcatgcgtcgcgcgcgcggcagcttccgctttaggttattccacgggaggatacgaatatatggtgttttgggcacatggctctggccggctgatctccatgggttcgtaaaagaggctatgatgaattgttagatggatatggggattcgatcgggccagatgtgtcagtttttcctccggggccctccatccaaaaaaaaaagacaaatcataggtttccgtattcaacgtttgaccgctcgtcttatttgaaaaaattatgaaaaaaactaaaaagataagtcacgcataaagtattaatcatgttttatcatctaacaataataaaaatactaattataaaaaaatttcatataagacggataattaaacgttggacatggaaacccagggtttgtctttttttttttttggggacggagagagtacgatggatgaacggatgaatgagttgatcatcatttagcagctgtttctttgatcattccttagcttttatttatactttcttagtacatgtgtttgtagaaaaggagcataaaagagggaggtttcgttatctgtgtgcattttgtgatgtagcggatgagatgtctgttccaccctcatcggaaaaaagaacatgatataaaaaagctatttaaaattcgacggaaaattctctaaaaacacgtaaaatgtagctatattataattatagtttaagtatgatgctagttagcatgtacagaatagttgcaatttaatttgggtgtaactaaataaaccatcgtagcttagtgcttgcaattctaagatcacgggatcgagtacttatcgaacaaccagcacgaatctcgacagatatctcacggtaaaagaagtgcaactaatatcgcacgtactccctccataaagaaaaagtccaattctagacacacatgtcagattcatccctagaatttgacttttttttttgggacatatggagtattgaacggccagcactaatctcaaacatctatcagtcaaaacgtgcaatatgcacacatctccccgcaaaaaaaaaaaatatgcacacatcaaatttctatcaacagacagacaggaaatcccccttaaaaaggaaacacccaaagatcaaggttagctgctgtgtgcattttcattatccaaaggccgagaactttctccattgtcatgaggaagaaaaacaagtgttaatctgcgcgacttcatctagatatggcttttttttttttgggaaaagtacaccgaaggtccctcaacttgtcatcgagttacaaaatcgtcccccaaccgcaaaaccagatatcggaggtccctcaactaacaaaaccgttcgcttgaggtcctccggtggttttggacccggttttgtctgacgtggcgggtgagtcagcgtgggccccacgtgggtcccacgtgtcaggctgccacatcatctctcccttcctcctctctctctctcactcttctcttctttgcgcgagtgcgatggccacggcctcctcctccgttgatgccgacgccggtgaccggttgaaggggtcggccacgagcggcgtgacagggctgagggtggcggccgacgaggcagcgacggcagctgcaacgcgtgagcaggccgcctcgccggggtcgcagccaacgacccccgccccatctccgcgccgccctcgccgttctcgagctgtctcggcaaactggccggcggggcgaggcgggagaggaggttgggcggccggcgatgggcgacgggcgacgcagcggcagcaacgacatgggagtaggagggccgccccccacgctgccaccgcagccgccgacggcgcgggcgacagatgtgcaaccatggcggcggcctcctcgctctcccgtcgcgctccctatcggcgccgtccgcctccgcctcgtcctcctgcgcccgccctcccactccgccggcctccgtcacctctccacctgctgtcgtggatgacaacggcggcctcctcgctctccccgtcgtagctcatgttcctccgtgctctacgaggacagcacctcgggcgccggcgacgaggcccccgtcccgcgttgctcgctgctgccgttcgatctgaacctgccggcctcgtccccgaaggagccgccgccgcaccagaaaggcggccagagcaagcggaacggcggtgtcggcgggcgagcacaatggcggagcggcggcttcggtgggcgagtgtggctgcggagaagcggcgtcggcgggcgagcgcggtggctgagaggcggcggcggatagggagcggcggtggcggatagggagcagtggcgccgacggccgcgccactcgccctaatcgtcggcgacggctccgggcgcgggcggagcagagaggcgtcctctcagctgtgctcctcctcgtcggctgccgaccgccgcccgtcacgctggccctcctctccgccgcactccctcctgtcgaccgccgaccgcgcccgccacgccggccctcctcccctgctggctgccggacgcgcccacggcgccggccctcctctcctcgccgtcgcccctccgccgcggcgggtcgaggcgcgcgagggaccgccgggcatcggcagcacgtgctgggtggttgcgggtgtgggggccgccgacgccctcctctcctcgccgttgctcctccgccgcctcgccgccgacgaggtctcccccaccacccttgactcgctcccctccccttcccccgccgttctcatccccacccccgtcgccgccaccgcccacctcgccagcgccccccagcggccgcgcccgccctagagcgagtgagaggagaaaagagtgagagagagagatgtggcagagagagaagagtgagagagaggggagggagatgatgtggcagcctgacacgtggggcccacgctgactcacccgccacgtcagacaaaaccgggtccaaaaccaccagaggacctcaagcgaactgttttgttagttgagggatctccgatatctggttttgcggttaggggacgattttgtaactcgatgacaagttgagggaccttcggtgtacttttccctttttttttctcctttcagttggattcactgtagcatagcctggttcgcaactgtggtttgctgtagtggagcagtggtatgtgaatgtgaacaaaggccagagccgaaagaaagtgggcccggcgttcaggaccaaagaaacaaataaatcccgtttgatagtgatgggcccatgaaatagcccaagtgttgtttgtagaccctggatgaggaagccgccttgctccaaagattccatgtagtattgcactatttctgcacagcagcctccatccatggcaccatcagagtcagggtatacttgtttgttgattctcttccttttccaaggaagacagctatacactttatactccctccgtctctaaaaacacttctggctatatatatttggatataacgtactccatatgtccagatacatgtagtcagaaagctgttttttttttacggatggagtatgtattagtaataatactttctctgtcctattttaaatgcagttgtgagtttctgtatctaacgtttgacagttcgtcttatttgaaaaatttatgaaaaaataaaaatcatgcataaattaatattcatgttttatcatctaataacaataaaaatactaattataaaaaagtttcaaataagacggacggtgaaacgttggacgcaaaaacccacaactacacttaaaacccgcatctgatgtcgcgtattcgcgtgactctataccttctattatatggtatgtgatatgtgagagtgacaatccttttttatgggtttctcgttgcttgtaaaaaaaacattggtcatgctaattaatattatgataataacaataaatagcttaatatttatcacaaattttataagttttgtcttataggtcttcatggttgcatgacctcatattttttattggtgcgtgctctttatagcctatgcacaaatattgtttttaggtttttaaggaatgagtttgatttcatttcaaattcatgtgaaaattattaaacctatattcgggcgaccatgactctgcatgtccttattgcatttttttctcaaatatattaaaattaactgttagaaataaaattaatcaaatgaacctgcattttgtatttgccctaaattgctcaatcttgaccggtgaatctttggttatgatgagggtttatttgtaaagtagtttactcaatagatgcaaatcgtaaattatatgcataaccttatatttattctttagctttcccccttccttgctttcttttgtcttctagtagtttcatctccggaaacctcttgaattattattttcacatccatcaaattcaacagccaagattcatttatcctctttcgtcttgtaatgaatccaacggttaatatttatagaatgatgtgactcatcctcgtttcattttgagtttcacttttcatcaattaagatgggacgaagggagtacttgtgtttagacaactttaaaaaagggaattgaagcatatgtacttttactaaatggaatggaatattgaatattagtttaatgatttgtgatattatcatatggtataaacaaatgaattaattgttatgatgctgaaaataaattcaagatagtattataagaaactaatgtattgagaattctttataaagtgcaccatttgaaagctcgggaagcatgccgttgaatggaattgttccattcctgtaaaaacaacaccctttttaattaaaagatggatattaaaggatgtagaggtgaatcgggtataacataaacttgactgaaaactcatccacatatggagtatggggtagtcagtctattcggcaaagccgggccacaacacccgcgacaactgccttgacaattgaggaactgtccgtgctagctactactgtaacgcagtcgtagcccagccagccgaacaacctcataattttagcattggtcagattcgtagttagaatgtatcgtactcatattagtttttcttttgaagtttagactgaggaaatactatttgtgcaagatttgaaaggttatactcaggccattcataatgcggtttgctcatttgaggagccctagatgtcacataagcacaacacatttaggccacacaccccgcagtaaaggtcagcctagttgttttttttatttcagacccgcatgtcagccccttcctataccttttctcctccctccccctctctctctcacatgatcctcttctctgccggaatcgccgcatctcgttctcgctccgccggcgccagccgcttctcccctctgttgccgtctctcctatccaccaccgccactcctcctcctcgccggtggcccaataaatgaagcggaaagggcggccggaggcgacggtgacaaggccctctttctctctgcgaatcgagctccgatggtgctgccgcgcagtggattgagctcgcgctcatcttcttggagccggcaacgatggctactcgcggtgtcccacgctccatgaagatggccgcctcgtcttcctctcgctagccgatctactcgcaacagcggcatcaccgctgaatcttcttgggcggtagagttggcggctgatctgttggtggcctgacgacgaccacgatggctctcggcgacgacaaccatgacgtgcagcgccgccgcttccccttctccccttcccgccgctttgtgggccctgcgttagatgcatgcagttgcaggcgaggctctcgaagccaaaacgagataggggaagcaaactaaggtcatgggccccatctacttttttgtccaccacagcgagtgtcctacgtggctgagcgagtccacacgctacataggagcgctgtgaatggcctcaaagagaagagttggttaaaggaagtttaatagtatagccaattactagctctaaatcatctataatcaatttaatagccaatttatacaatagttacctacaaacatatactacactattaatatctggtcccacatatcacacatgttgcttcttggagtctatactgcagttagctataaatttatagtccgctgctcttctctcttatttttatctccttaaaatatatttataattggcttatacctgctgttatattagggctttgctcgtaccatagatgacgtcaaaaggagaaaaacgatctctaaaatttctttctccccatcgatgagagatgagggctatggctgtggtgcaatgtgtagcatagatggctactactcctccggctagtggtaattgcttgttgcaggagggggaaatgatgatgctagatttggggtggtcggggccgtgtggaccaaagtcaagtcacgacgacgcagccacccatccatccatccatcctcaaacgccaaagcagcagcagcagcagctagcataggagccacccagtggccactgccccgtagtacgtccatctccagccatgtggtccctacgacgccgacgatgacacaaaatcatgcgacacgtttcgcctcctcgttggccgccatcacacaaactgctctctgctggtacagcctctcttcccatgcactctgccatcagatttctcatatcccgggctgtaaaacgtttaacgtactgtaactcgtacttcaagtaagcttgtaagagcaagtttaaatagtatagtcaactactagcttcaattaatttatagtcaatctaatagctcatttatacgatagttacatactacactattaatatctggtcctacctgtcatacacacactgtgtcttggagtccgtgctacagctggctataaatctatagcccgctgctctttttccttctcatttgtctccttgaaatatgtttgcggctggttatagcatgctattgtacctgctctacgatgaggagtatatactgtcgacgtttgatgtcgcaattctggtatttgtatggtatggggatcgttggtactagggtatacgcgagactgaagtaaaagagacaaagacgaggatttttatacaggtttgggcccctgaattgtcaggtaataaccctacatcctgttagtcgaagccgatattgctcttattcatgataatcacaccagtacaatatttggggtagcctctctaactgttgtcaacctggcggtctgaagatctgactcgtagtcgacaacagggtagccttcctcctcgaatccgtgcccggcgagatcagagatagcgctttcgtctctcctgacagtatccggagacaccgcagggtactagccgtgcttatccctgaagtcgatatccggcggcgtgttttggcgtatttaggcttctatgttgtggcttctatgtcgattgtgttgggtgttgatcgtctcgtgtcccctctcctcctggggggcttgtatttatacctataggtgtcccctcgtccaagtagaactagggaaaacaatatggatacaatccgagtagtctttgttgtttccatgtagaactctggttgtctttccttatccggaactcctcctatatccgtaggttgtttccatataggacatagtatgtggtaggtcctgccaagatttagtcaactactattagatatgtggtatccataaagctgacatatacacgctgtcaaatagagaggggtat

SEQ ID NO: 39380 - DNA, 21399 bp, Oryza sativa
  unsure (1)..(21399): unsure at all n locations
tgcgctttggttatatggtgctaatcaaccatctttgagccaagaaaccgctcagtaaaccagttaaaaccaaaaaacgaataaagtactccgagcagttttttttttcttttgcaaaggttgtccgtgtttcattggttctcgtcgattataccgagaaataatatacctgaataaccggtgtaccactcccagcaataatccatcggcgagatcttcctaaacccttttcggtgtgtttggataatgggaaatggagggttggattgtgattggaaaatgaatgaagggttaggattaaatgaaagaggagaatgaatggttaggatttaaagatgtcttttggtgaatgggaaatgatttccccaacccattagccaaacgctgccttcggagttttctcaccggagtatgactttctcatcggctacttgctttacttttttttttttttggccttttaacagttttgacatgtgctgttgcagtgttggtagtacctgcctatctggaaggaatgtgcgttaattctacaagaggggggaccaatcgtttttgccaatattctgtgcaatcaacaaactgacgacactgactgtgattaaaagagcttaaccagttaaagagcccagctgtaactaaaatagcttgatcaattacagctcattaactttctaggaaacacaatactcctaaaattgttttcagatttatgcatgcagtgatacaatgaacctcgactccttgagattgcagggggaaaaaaaggaaatattatcatcatcttgagataagtataatgtggtaggagaatcaattatcaaagaaaaggagatggtgtatagtaataaccacaagctgagcagcctgagcttatcttatctgatcctctcaccctctatgtccaacaccggcattcctgtcactttaacacatgcctcttctactaatcaaacatgacccaccggccactacagctttgcattattggctgtgtttatatctaaagtttggatccaaacttcagtccttttctattacattaacctgtcatacacacaacttttcagtcacatcatctccaatttcaactaaaatccaaacttcgcgctcaactagacacagccattgtagacattgccactgtctctccctgtgtctcttgggataagccaccaatcacctttgctctgtgtttctgatgctgtacagtgcaaatccaccaaagattcaccaggtttctagttagggctgtgtttagttcagcgcaaagtttggattttagttgaaatttgagatgatgtgactgaaaaattgtgtgtgtatgacaggttgatatgatggaaaaggactgaagtttggatccaaactttggatctaaacacagcctaggcagcgataaaattgagcaaacatttttgtctaccaactccctcgtttttgtctagtaacaactcctacactagaatgcttattagtttttctaagttcagattaagggttcgtttgtttgagcatttttatctaacatttttcttttttaatgatcgtgtttcttgaactgctaaatttgttataaataaataaacttattttttaaatttatactagtgattaaaattttgaacaccttttgatgtgcagttgtttagctcacctaataagagcaggtacaatagtagactattagccaactgtaaacatattttaataagataaaagatgagagagaagagcggcgggttatagatctgtagctagctgcagcacggactctaagacacaatgtgtgtatgacaggtgggaccatatatttaatagtataataagcaactattgtatgaattgactatagataaattggagccaatagtgggctatactattaaacttgctcaaacatagcctaaagctggactggagtagttagaagtacagtttagccgcatcagaattggataggaagatatgtttgcacaaaattacgcagtgctccccacaaggaatctttaatgcaggagatgatcatacacgaaaagaaaaggcttgtggtggcgccacatcccccctccgatttataaagcccaaccagagcactcgcaacacactcactcctgcccttgcgagcttcgcacgcagcgatcgagagatagaacagcgagataatggtagtagcagccgttgcttgcttgcattggcttagctaagctcaagctagctcctactactcctacctgcttcagctttgcttcctgcgcatgagctagatgctccctcgcatccatctcctagctttccttccctttctctcgctgctgctgctgctgctgcatcctcctctcctgtgacctgtcacagcttggcctaggactagtagggagtagtgattcttgctcgctttgtttctctgaatccttgcagcttggcttggccttggccttggctgctttgaatagtacctgacggcctcgtggcgcgcaaaccttgtcccttttccccgcaaatccttgccgccttttggtcgctctctgctcctcctcgtccctcgcgccgtcaccacctgctctgtctcctctccttcttgcagctcgtcgtcgtcgtcgttgatctttggctatatattactccctcctgctgctgctgctgcacggacgcagtgaggaggaagagctcgtgacttgttttcatcaggagtacagttgtcagtagctgatcgaggtcgtcgtcgtcgccatcgatggcgtggaggagagggttcggccgggaggaggaggacgcggcggcggcgggggagagcggcctcgagctctgccttggcctccccgcctacttntcctcctcctcctcctccaagccatcggagggatcaaccgctgctcctgcttttgctctccgatccaatggaaccaatgcctccaagccaaggtttgttcatttgttcgacagaaatggaggtggaaagaagctaattaattcaattttgatgcttaatttatgtgtgaaaatgcatgtagcggggcagcggcggcggcgccggttgtggggtggccgccggtgcggtcgttccggcggaacctcgcctcgtcgtcgtcatcgtcgtccaagcaggcgccgccgccgccgtcgtcgtcgccgcagaacggcgacaaggcgagcaaagacggcggcgcggagaagggcatgttcgtgaagatcaacatggacggcgtcccgatcgggaggaaggtcgacctcgcggcgtacggcggctacgcccagctctccgccgccgtcgacaagctcttccgcggcctcctagccggtgagctcagctttaccttgcgccgcccgccgcgtggtgcggtttgctctttgctgtgacctcatgcgaacacgatgctatgctattgctcgtgcagctcagagcgctgccgctgacggcgaggccgacgcggccgccgccggagagatggtcggcggcggcgagtacacgctcgtctacgaggacgacgagggcgaccggatgctcgtcggcgacgttccctggcagtaagttggacaaaattacacatccgtagctagcttccatcccaaatgaatttctcgtctcatcgatcgatccgctgcaggatgttcatcgccaccgcgaagaggctgcgcgtgctcaagagctccgacctgccgccgccgtcggtgagcctaccacccaccaaccaccatgatcaatcaaaatgaatttactcctgattcgttctgaatttgcagctgatgagggcggcagggagcaggaagagggcagcagctgacagctgaactaatcactgtcaatttcagctgctgctgccgatgatgatgaattgatcatggtgtggtgcttggattgagatccctctgcagtcaaatacacggtcctttgtcattgacaggtggacctagggattatcgggcctatatgttaatgataacgtcacatgactttaactgcagaggattttgatctgtggtgcttggctttatggccattttgatgtctttgggctgcataattatatgtatacttacgagagatcatgacggtattagtggtcatgattagtagtacgatcgagtagcatggaacagtgttgttaattactagtagctgggtgattaagctaatctatggcgcctttggtggtgtaattttggatgtaggcaggcatgtgtcaaattagttatgtgttttgttaattaagcgatctagttaatgcgtttaagttaattatggtgccatgcatgtctgcaaaaatgtgagctccatcgatcgtgtcggcgtttcatctcgatcaagttgtcatcatgggctctagtattgctatccacctcggcaactcaaaagtgggctcacttttagattcggctagtttcaactcaaaatcgaagtggatttcggcgtagcttccacacacaatccctcgcgtgaaaattttgccaaaaaaaaaacacaacttaaaggtaaacattggagctttcaaaccaaaagttcgaatgattctcaaacttggggctccgagacacgccgcatcctgccgcactctccgcgcgccatccaacggtcgtaacacggcacacgtaggcacaatttcgcctgattgaatgaaatcatctccacatctactaacagtaagtacaacttaagatgtaaagacagtttagtggaggtgttaacatgggaatttcttcttgttcattcgagatatattttcatatcatggcataattcttgttgcgttatcatcattgttaatccagtcttaacatgtatacctagcttatagggcttactaacaaaaatactataaacagtacttgtacatactcctccgtccaaaaaaaaaaccaatatagaatagataggatataacctagtacaaggaatctggacatgctagataaaagttttatccaatactagatagatttttttgggacagggggagtactggagtatgatcgagaatcattcttgacgtttcaactttcagggtaaaaactttccttgttgtagcatgttgttattgaaagtgcacatctaattgaaacctaaggaccgagattaacgttggggatttaacggaagagtcaccgctgctggttttacacgatggtttcagagacagggatgctagcaaaatgtttttaggggaacattcacctgaacaaataatgatgggatcacattttccttcctttgttgttacttgctgagttttagagcagaatattatactccgtattacacagattgtaaattttatacattctcaaacagttataaatggctagatttgattggttatccttactactgcagaatttaattcatggaagtagcgcataatataattcattgcacacacacatctttacagccaattcggaatattaaaaaaaaatccccaaaagggataattataggtaacaatgaaggttttgcagttccaattttatttcaggttacaactatgcagggcgacagtatatcaagcctcattttggttacagactgcttccagttccaccatgcccaagcagcacatacaacaaagctaggttttttcaataatttttttcactccagagcaaaaatggacggcatatactactatttatctagcaaattttcatcgagattgagaggctgcaataagggcagcccctatccctgacccgtcgttcgcgtgcttgacggctaccgacttggaagcctcctctcccagcaactcacccaacgtgctctccaaacattccctgaatttggtgtagtgttcgaacaaacctccatcaatggcgatgaccgagcgctgattgttgatgccgccatttcttccaagcttcatgaggatccctgcaacaccagcagcagccagccgagctgccctccttgccacgatatcgcatatttcgacaaccattttccttatctctaaggatgtatgtgtaatctgcaggcatacataccatgtcactacagagaatacacatgcagaatatgagctttttcagaagcatggatacctctaggatttgatgcaatttttcagccactatctttaggtcaggtgtttcatcatggtgcattgcagaaatgtgcggagtcctgttcgccacattaacggatattttagggtcagccttgaatctgttatagaattttctacactttataaaacagtcttatgagcattcatatcatatgggctgcatttgaaagcaacctactcaatcctgaattgcataagagcgctaattgtgaaaacaaaaggaaatgacataccgcagatggaaacaagttttgagcttggagttatctatagaaccgaaaattccagactgcaaggacagtttaagcagcactcttcttacgatttcacctaaatacattcctgatgttaacttctcatatatctgaaaaagaaaacaaaactatatggttgagccaagacccaagatccaacagtacaggcatgcagggtaggtggtcttttgctgaagaaacttgcctgctctccagggtttaagctttccttgtctaatgcttcatcgtattcagtaactggaagatgcgatgaatagaaattaccccattccatattgatgacctgaaatacgataaacgcacttaaaaaaaacttagaaattgaataaagatacaacaaaaaagttgagtaaaataaacttatgtgagttaatttattgcttaaatttcaatggaaggtgggagtatggcctttgtcccttaccatatcccctgaattgggcaactccccttcccattttggtatagcatttgccttctcaacatatgcagcatttgtgccagtaccaaatatcacacctgcgacaacatcttcatcgtagtatcttgctccagccaatgttccaacagcatcattaatctatttcatcaaaaaagttctctcagactaaaaatgtttacctgacattgtagatatattatgtttatgaaaggtaaaagccagtcaatactcaccaatgcagctacatgcatgtccagaccttgtttcaccatagccgtttgtagttcagccaccacatcttcacctacctgatttcagagaaatgttttatctgatagaagattcactcatatcagcttaaaaatggatattttgtttgcgtgaaactgatctactagtaagagctagcaagtattaatgacaaggcttgtgactagaacaacgttcatatcgcaagatgttcatataaataatgggttttgcagagctgtagttactaattaggactattttttacatcaccacaaaaaatgtatgcgatgcatgttgagtttatgaaggacgccttactgcatcatcaatggaaaacgcctttgtccacttgacaagggtacccgatgccacagatcgttgcctcacaggaaaagagaaggtgaatcctagctctttcttcttgccgtttggcatgtcagtaccctcctcctcttcagcaacaaacttgcctaattccccagcaatgaaaccaaacaattcctgcagacatatagtaaaacaacgaatatcgtcaaataaaaaaatgcacaacagtggaacaacatcaaaatggagcaaaactcggtcaaatgatgatgattcagcgtacaaaaacccaccgaggaggtccctgacatcaggtgtggtgggatgctgacttccctggattcagagttgacgacatgcttcttgctgccaccaagatgaaccttgagcacccggaagtttgttcctcctaggtccaatccatagaacaatccatcctctctcctgaattcgtggcacaaaactgatcagtgtaaacccatcattttcagagatgtatctactgtcactcttgtttctgacgctatgaacacaaatcagaaattcagaattcagaggaggcgatgcatatgcaggtatactgactgacccagtggggagcttgtcgacgtaggagagcagcatcttgaccctgctcccaccctccttctccaggccggcgcccatctcgccggccatcgccgccgccacatcccgcagcagcgacgccggcgtcgcgcacctctcccgcagctccgccaccaccttctccgcctccaccgccgccatgatcccggtccccgacaggcgaatcgaaaagctaaagaaaagcttcagagcaagaaaggcgagacctttggagttcggttcagacaaacccaaccacgatcaaaagacgctccggaaatgcgcgcagaatcgcattcacggggctcgatcgatcgatctatagaaaaataatctgggattggagggaggcacgtgaaagttttgtgtttttgtctaaagcactcaactttttttcatcagtagtttagttgatccctttcagtggcggttttgatccatctaccgatcgatacggcggcagcggaaagggataagcgtcgtgctcttcttgttctgttccttagcttttcggtaactgcacactgcgtagcaacagggggaggaaacattgtccatggtcggatcggatggatatctatccaagaacagaagagaatccagcaaccaaattggatcgtggattggattggattggatggatttactcgcgtcacattggcatggaggtgaatggagaagttggccggagtcggggtcgccggtcgccaccgccgtcgccttcgccgtgcgttgggcttttcgcggtgcgggccttagatgggccgtcgacgaggggggctcacggcccacgttgatggctgggccgatccagcggcggcgctggcacctaggtcgccgcgccgccggccaccgcggattttacctgcagtttccctttctcgtagaccgtgtggcggcgagcgagaaaaccgtgcaaactttttattaccgcgatcaattcacctctccatctcgtataggaattgaattgaaattttgctgttttggttaaaaatcgaggggcgttgtgtcgtaggttcaaatttccatgatgcctctgattccatccgcccttctttgtttctcgtttcaaaaaaacccattgattcccccacatcatacttgcatcgcaacgtgacacccgaaaaacgccaactaatcccaaagaatttttttaaaaaaatattcgtgtgacagtccacaccatgcgtgccgtgccccccaaagatccagccagcaaatgtgcacctgccggttgccgccgtacacatttatttacagcttctgcgtctcagaaatatcacaagttttcacttggatatttccaaaaaaacctggccggtcaatggcagctgttaaatttcgtgccaatccgtttcgtttcatcacggtctgctgttaaaattcatatttatggtttcgatgcgatcgcggcccgagtcaaaccctgtgaaaacggatgaggctttcacttctgtaggaggctgtgttgagttcccttcaaatttttaactttttcatcacattaaatgtttggacacatgtatgaaacattaaatgtgaacgaaaaaaccaattacacagtttatatgtaaattgcgacacaaatctttttagcctaattacgccatgatttaataatgtgatgctacagtaaacatttactaatgacagattaattagatttaatagattcgtctcgcagtttacaggtggaatctataatttattttgttattatgtttaatacttcaaatgtgtgcccgtatgcattaaatttttttgccaaaacaactaaacacggcctctttccttttactagtacacctcagagtcagcaggggccaggtcagcaaagatcacactggggcgagttgaccctgcaaaaaaattgaaacgaacagggtcatttactgcgtgagatagtaccacgacgcgaggtcacaaagatcgtggtggtacataaaaaaaaaaaaactcctgtacgtggtacgcgcctctcacccagctgcactgcatcgtcatgttcgttcaaatcacccacgcacagcaacagtttcgccaccaggcaccagcagcagtagtagtaacatgtttttgacacattgcgcacacatcacgccctacctgatcctgcacgtgcgacccgcgaggacacgcacgtactactactacaggtacagtaatttgcattcgcgtatccttttaaacaaaaataaaactacaacaaaaccaaaatttttcttttagaaatacggtacgaatgcagacgctacgtactaacatatggacacactacccttataaacgtatccgaaaaattaggacgatatatattaagattgacgaacgcatcacggacacctcgttatcgacgaatacatcacgtatcctgataaaaataattagtcctaaatacaagcatatgtgtcaaatccagaatttaaacccggataagctggttttatcgtaagaaatctaatcgattgaattaagctcactacttcgtgaggatgaaattaaatttagcccaaaaccaaactcaaatctgatataggagtactaccctacagtggacgacgatttggaatcttttatcatagtagcggtgatgcgccagatcgatcgatcgatggctcgatggatcaataattcgatattcccaaggacccactcgtcctgtgagcccttctgtggctcgatcccgatgacgtcatcgcccaaaagatccttttctctgctttgcaccggcatactacaactgctgctacaagtcaaagtgcagctcacgagagtggcgccagggtacaaaagcccacacgctccaatggcccaaaaagaaaaaaagaaaagtacagctgctagtgctagtaaaaagaaactactgcgtacgtacgtacttacgtacgtacacgatgtgtgtatgtgtacgaaggctgcactgtgcgtacgtacgtacgtacgcgtgcatgcatatacgttaatcgacatgatcgttggaggttttggaggtgtagggatggcaagtttgggtgcgcgccgtcgtggaaagaggccaaaggtgtttgtatttttcaccgtcttttttgcagcgctcccatcacgtgccaggtagtagtagactagtgctctccatgctgcttagtgcttacccacagctgcgataacccctctgatggtattttcggtgcaacaaagagtcttctatgataaaacgtattgtgtagagcgacgaatttgaaacacactctctattcgaattcattgtagtatataccgctgtgtagaaaacccaccatatagaaccgagggaatactctctatgtaaaaaaaacaatttatcctatatttagattttatctatagaaattatttttttcaacaggaggagtacttcatccgtccttaaaaaaaaaactatcctcatactagaacgggatacattatagtataatgaatctggacacgtagatttatacaaatgagtgtatagataactgttttttttacatcgttaatgatggcaagtgacctcacatctcgcaagccaacacaaatcacgaagagacgttgagattatgggtttgcagctttcacagtgcagccacgggacgtgggagtggatatactccccccctaccgtactcctatctttttgaaacagcctctttttttgaatggtgagctactacaactttggttgttctctcatgctctcacacacttggatgctagctgcaccgccatttgtttattgccatcatttatgatttcgtatttcgatttggtttggtcgcatttggtttgatttgattctttcctagggatagttttttttcccctttattttttaaaattttttgtcttgtattggaccccccctccccttctttttatttgaaccccgctcctccctcccgggcgtttccctctcttattcaaacttgacccgtttcgccttcttgctcaagtgttcgacctggtcttggagcgcggcgtgtctctctcgccggccggagtcgcgaattccggccatgggcaaggcggcgaggtggttccgcagcctgtggggcggcggcggcgggaagaaggagcaggggagagaacatgggaggacggccgcggcgccgcccccgccggacaggaagcggtggagcttcgccaagtcgtcgagggactcgacggagggggaggcggcggcggcggtgggagggaatgcggcgatcgcgaaggcggccgaggcggcgtggctcaagtcgatgtacagcgacaccgagagggagcagagcaagcacgccatcgcggtcgccgcggcgaccgcggctgcggcggacgcggccgtggcggcggcacaggcggccgtcgaggtcgtccgcctcaccagccaggggccacccacctcgtcggtgttcgtctgcggcggcgtcttggatccccgtggccgcgccgccgcggtcaagatccagacagccttccgaggattcttggtgagtgagccccaacaacttcctcacttcttccaagaacaacagtgtctgcttctgttcttgatctgttcgtcttctttggcgacgtgctcatttcgatttcatccactgttccagtagatttccttttccaaaaaaagctcatagattaagacatgattagatttttatttttgttcttggttcaggcgaagaaggcgctgcgagcgctcaaggcgctggtgaagctgcaggcgctggtgcgcggctacctggtgaggcggcaggcggcggcgacgctgcagagcatgcaggcgctcgtccgcgcgcaggccgccgtccgcgccgcgcgctcgtcgcgcggcgccgcgctgccgccgctgcacctccaccaccaccctcccgtccggccgcgctattccctggtacgagtacgaccacgatcgcttgcgtgcgaagcgggcgagctttttttttaaaggtgttcgtccgaggcatgttggttgctgtgacacaattcttacctcgggggtttcttgtgtttgcagcaagagcggtatatggacgacacgaggagcgagcatggcgtggcggcgtacagccgccgcctgtcggcgagcatcgagtcgtcgtcgtacgggtacgaccggagccccaagatcgtggagatggacaccgggcggcccaagtcgaggtcgtcgtcggtcaggacgagccctcccgtggtcgacgccggcgccgccgaggagtggtacgccaactcggtgtcgtcgccgctcctcccgttccaccagctccccggcgcgccgccgcggatatcggcgccgagcgcacgccacttcccggagtacgactggtgcccgctcgagaagcccaggccggcgacggcgcagagcacgccgcggcttgcgcacatgccggtgacgccgacgaagagcgtctgcggcggcggcggctacggcgcgtcgcccaactgccgcggctacatgtcgagcacgcaatcgtcggaggcgaaggtgcggtcccagagcgcgccgaagcagcggccggagccgggcgtcgccggcggcaccggcggcggcgcgcggaagagggtgccgctgagcgaggtgaccctggaggcgagggcgagcctgagcggcgtgggcatgcagcgctcgtgcaaccgtgtccaggaggcgttcaacttcaagaccgccgtgctcagccgcttcgaccgctcgtcggagccggccgccgagagggaccgcgacctcttcttgcagaggaggtggtgatctgaacagcgttcgccattgcaagaaggaagaggactacaagaactagttcttcttcttcttcttagtctctgtttctatgcgacatagtagcgatcgatcatgtttgatcgatggcaatggcgatcgtgtgctccgccattgccgtcgtctccgagcttgttactgacaagtgacaggcaaagtgtacgttgagctagctggaggggagattacaaaaaaaaaaaatcccacttctttcccctctgatttaacagtgcacttggatgtacattcccctatcaattcaaggccagcaaatcaaatcccgttgtttttttttaaaaaacaagtccggaaaggtaacggattaaacggcattgaccagccaggatttgaatggtagaggccagcagtatgctataccctatttggggagtttactgagaggcagatggttgctagtaagcttttaagaatctagaaaagttgggtttccagtttctgacttttagtttattttttaaattttacatctacaattttttaaaatctgaaccaaaaaactgtttaggggagcttataattgtaagagaagttcattttctagcttctaatttattttctggattctaatgctataattttttagaattcaaaccaaaagccgtaccatttaagagtgcttctgattcttagaaaagttacagcagctagaaacttcttcaaacaagccctatacgtctcgtcacagcaagcgagctagtcactcatgggacgagaccaccatagccgaccaccaccaatccaccatggccttggaccgactcgaggttgccatgcatgcatgtgaccgggcgaggtcgacgacgaccgaccggggaggctgtagaggcatgaggggggcgtgcctgcatgcgtttgcctccccggggagcggaagaattccgatgctgcactgtgccctttgcctgcgctcgtttggaggcttgcactcatcctggatcgatcgatcgctagctgcttacaactgtttggcatgtcgtgtgttttgaactgggttgggtacttgccgctgctgccacttgccgtagtttgttcctcccagttccagctcaggggtactggtgatgtacatgtagctagagctgtagctcttacttccacctttttacgatgtaagtcattctaatattttccatattcatattgatgttaatgaatctagatagatatagggtgcgttcagaagagctggctgtgacagcagcggcgctgcagctacattactcaacaagcaagattatgctaggagagctgcagcgctgtagctgtgcagccacagtccagctgaaccgaacagacccatatatgtctagattcattagcattaatatgaatgtgggaaatgctagaatgacttacattatgaaacggatgaagtaaattttagttcgaagagttggttctagagtacagttgtgagtaacctaatagcaactacacctctttgattcattttatcaaaacagtctaattcactccactctctttttgtagatgtggctgaaaccgtttggttgggcatgactctgtcaaacctgctactctaattaatttttctttttttttctttcggttatagagacgaggggttgtttggttggtacacagtttatcatgttaatccttattagacgtgccattgttttttttaagaacttttgattcttaagccgttaacaccacatatgcaaagttttattcctaaattattttttatcaataataaacggttatggcttatactatgctgaaggagtgaaggcaactgatgggaagttgggagcctcaaacttcaaccactttacagcacatggcgaatggggactcggtaactgcttaacggaactgtgctcaccgtacaaacccaacggatggatcactcgacgagattccgatttttcactgttacagcacactcgccggccgatcgaaacattcaactggctattggatcgaaccattcaattggctgttcttcctattttctagtccacctcgcagtgaaaaaaagtcggcaatcaccacaccccccatatcctgggtatagaattgaatgaattgtaacgatgtctccagcagtatacgcagggattgtcccttttactgcagtaggtccaatgcatggaagatctccatgtaaaccagattggatactcgtagttaagttacttcagtcatggaccatccggtttatggacacagcagaatccagcatgagccatgaagaactaggtaatggttaataatactgctccctctgttttcaattactctttcttaggattcaaatctgtacacaaatatacattacgatagtactagtacaaaacaacctgcaaatcaatcgcttgcgtttggaaatggatgaagtaactaattagatcgctaattatcagaaagggttcaatctaattatcagtaagagtttttctgaaactcaggattgataaaaaggtagaaatataaaaattgtttggattgatgtcaaaacgtgcccataccaatcttttggtagtttaaatagtaaatgcgatagtttggcttgaagccaattagttggttatatccatgttaaatttggcacagtttctagaaatttcctcactacaatatgggatttggcttgtaattggcaccaatccaaatatcaaatactacaaatacggttgtttatataggagtagatcatacgaatcgaatgagagagagattaaaaaaaacaaaatttaaagattctaaagcttctgttaactttcttttaaaatctacatatactactaagcttatttcttagtactcttaagcttatttcttagggattttaaaggatttgaaaaactgtaaaactagccagatgtgctgcacacaagcccattgcatgtgagcacacactactggagtatactggtaggagtagtaggagtagcatgtagcaggtggtgaatgaatcggagctgagtggtgatatgaaaggtcatacttttgtctttcttttttttctctggctctagcttttcaacgcctatctttcttttcggcaatgattaggttctgatttgatagctgagaaaggcactcgatctctcctggaaggacttgactggggtacacagtacactcgtcatagtagtacagtactccctcagtgttagtagaggagtcgtctagaataatgtttaatttaaaccttagaaatataaatcatgaataacttttaagttattgatttaaattgttaggtttgaaaatgtaaaaattatatgaatagatttatcttgaaaaatactttaataaaagtatacatatcacttttcaataaatttttttatagaaacaagatgtcaaaattgtgttttggagaccgtgtcgctgtcaaaaacgatttttttatgagtatggagggagtatactgctggtaggtcaatactagttcgatccggttctccaatggctgcgtcacagtggcattgccatggctcattggctctgctttgcagctttgctgcgtgtcgcagtgtccgtgtggatgatgaacacacaaacacacacgcagtgatgaattggaatactacctccgtcctaaaatgtagctatttctagcacagtactttattccaaaataaagctatttttctacccaccttctcctctcaaccaatcacaaccattctttttcacctactttctcttttcaaccaatcacacatctttttcaatcattatcacctacttttttaatagccgtgccaaccttaaaagtacttacattttaggacggagaaagtactgcatagtagtaacagtggagtatgaaatatggatatgaatattactagcaaatgcaagcttatggtgtcaggattggtaggaattagctcaagcttattagagcaagtttaatagtatagtccactactacctctaatttatctatagccattgtaatagttaattcatacaatatagttgcttactatactattaatatatggtcacacatatcatacacataatgtgtcttggaatccgtgctgctgcagctggctataaatctgtataccgtttctcttctctctcatcttttatcttattaaaatatgtttatagttagctaatagtctgtcactgtatctgctcttaatcgtaattgattacagtagtgatggaagtggcatccctcaaccctcggttccggtgacactgggagggctggacatccatcgaggtgacaccgcctcgcccgggtcgacatgtgcgaccatcatctcactggatgcattttggcaaagaggatcacatgcacgcacacttggcctagcgtgcatgggtagccggaccggtacaaaacgaaggatataaacacacacaggctagcgctgcaggcaggcaggcaggcaggcgagcatgcaggagtcgtggtgcgacgcgccgacgagtggattcagagcgccgtattggtggtcgtcgcttcgggtggagtaggagtaggagtagcagaggttgcgatatgattcatatcgtctccgacgacgcgaggccagccggtgggttcatgcatgcgacggccaggaatagcagagtccacgagacgagacgcgaaggcgacgagctaccctactccggagtccggacagggctagtggtagcagagctcagaggagtgtactgctacatgatgacgtgcgatttgaccaccggccggcctgccctgccctggactcccgactgacacctgcgcatgcacttcgcacgcatgcacggctccccacgccctggatctttgttgccgccctgtgtcgcgtgtctcgtctcctccctcctgcactccttgtctctgttccgctcaatctactccctgcgtacggatgcccgacgtgcccacgtactctaaatagagtactcctacggtgcacgtactctactcttctattacaccctggtaaaaaaacaaaggctgtgtttagtttcttccaaagttgaaagttttgttgaaattgatatgatgtgactaaaaaattatgtgtgtatgacatgttgatgtgatgaaaaaagttagaagtttggatctaaacacagccaaacacatactactcctactgtccagattcgtaacggagaaaaactattcaaatctgtattactacgacatttacacatcctatacaagatgtactcctactagtacttatttagggatagagtataagaatcttgaaccagacatgatattttatagtattacgaatttgaaaagactgttggtccatattcttatattttggaatggagtaatagcggcttgttggtgtggctgtgacaaagaaacgtagtgctatactagtagtacaattcaatcgactatgtgcaatgcgatggtgtgcccaagcatggcatactagcacggtcacggcgtgtagtatgtgctgcaaattgtacaggacacctgtaacgtcctacctctcccaggttgggcccgcttatatctggcagctttcataggtcatagactgcccttatagaccaacacaagtcttttctgcacactttatcctcactcgtgcgcactcgggaagaatttccagatcggtcacccatccctaaattgctccaggtcaagcacgctttaacctcggagttctttagagatcggcttccagaaaagaagttgcaacttgtttatataagtattctattaatcctattaagccctaggccgggatgttacaacaccgaagttgggaccgtccgtcttaacatcagttataggcagggtttaccttatcatttgggccgagcttaccgcctaaaatcgcacaaaaatcacatccaaaaattcgaattcaaaacttggcggttttgcggtttcaccgcgataatcgcatggtttatcacgataaccgcaatatttgcacgattatcatgggctgtgtagctgaaatcatttaatgtaaaataaatagggaaaacaaaataaaaaatacggttgaatatgtgtagaaaactataaattgagaataattggaagaatatgttggatacttaaggcctaatattctcttcccttttccaatttgtaaactattttcgcttttgccctcaaatttgaatttaccttacactatttcaaaaatattcttcactattgtcaattacaaatcaagaactacatcaatgatttttttttcaatttttttgatttttttccggaattttgaatttggtcaaaattcacctaaactatatcgccgatttccccgtgataagcgcaatcaccgtgattatcgtgcgataagtgaaacccttgttataggtgaacctagaatccattacgtacaatgaaaaaaaaacaaaccttatacactgtgagaaccgaatagtttcaatcaaagagaagttgaacacatcgaataaattcttttagatatgcaggatgaggggaaagatgtgattgggatattttttgggtgggtctcgtaaaatcgattctgacgtttcggggatctaacaaaaaattgattcaccgctgctatacgtacgatttttttgtacgatgtttatacgatgaaacgtttctgtcctagcccatgagtgctcttgactgccgcgtgcgcatgtgccgtgtgctcgtcatgtgctcgcgccgttatcgtactaagatcgtaagaaaaagttgtacgtacaacaatttccaaatttatttagggcctgtttagttcacgaaaagaaaatttttggatgtgacatcggatgtttgaccggatatcaaaaggggcttttggacacgaataaaaaactaatttcataactcgcctgaaaaccgcgaaacgaattttttgagcctaattaatccgttattagcacttgtgggttactgtagcacttatggctaatcatggactaattagactcaaaagattcgtctcatgaatttctccctaactgtgcaattagttttttcatttatctatatttaatgtttatgcatgtgttcaaatattcgatgtgatgtttttgaaaaaaaaattagggaactaaacggggccttaacttcggtggaacaaactcgccgaatcgatactacagctgccataagaccttcacaggcatgcccaacccgactgatgactcaaaatagtctgaaactggcaattttagagtatgctcgtgtggaaactttctaggttaagtatattcttctcttctcttttccaacttctacctctcatttttcacacgtatatttcccgaactactaaataatgtatttttttgcaaaaaaaaatctattaaaaagttgtttacaaaaatcatatagtctattctttaagtttttaagttaatacttaataaatcattcgctaatgatctgtttcttttttttcgaaaggattagtttccaacgtatcctgccgaacacatcccaagtcaactggccctgatgcaagtctggcttgactctttttttttctctttacctttgcactttcgggtgtgaattaggggggtgaaaatggatcacatatgaaggaataattttcatatcatattctaaactacagtagttgtctataatcagtgagtctatactgaaatctacgagttgtagtaaagctagaaagggtgcttttgaccctaattttgtttgtgtataacactattgcattg

SEQ ID NO: 39381 - DNA, 1092 bp, Oryza sativa
tcctgtatcccctgaagtattctcatcccaaccaacagtgtcctgcaaagagagcaagtccttcaaatttgaaaaacaaaaatcagtatagtatactaccactcgagtactgagaatatacgtgtatttgtttttactaattgctgcagcgccgtacatctatatatttgttttacttgtaataaattggtagttactgtaatataaaagtcgtcatggtcaacaccccaaacacaccgtagtcacatgagcaatccttacatgtgcagcttcggtatactctacagtatccatttcaaaagatggaaaattaacatattgagttgaatattgtttgtggctaaacatcatttgaaaattgtggattcatgtttgatactctatctgtccctaaatataaaagattttagtgtgggatgtgacacattctattataacgaatctggacatactaggatgtgtcacataccaccaaaatcacttatatttaaggacggatgaagcatatgaatacgttttttctacttaaagatgaacaacttttaagttttgattttaaatagtactccatcccttctaaaatataacaatgtttatctacgaatttaaataaatacatatccatgtttatagctaaaaattagaacggatatagtacggtataacgaattttgcctaattgcacaagaagatcaggaccgttgatccagagagatgcttttcttgagatcagtatggtgatgtcaacatgtcacaggtgccacaacgagaatcacgcgcgtaggaaccttcccttacgaccacttgatcgatccatcatcacgcagatagttcaaaaaactgcgataaattggcgtaaaactcgcgtagttccacaattaaattaacgtgatcaacctgattacgcccctgcttgtcactaatcatgtccggacttggtcacgttctactgttcttaattaccatcgctgaataattatggatttttggcctgttcgtttgttggttgatcttgtcgtgtaggttgtcccttgttttcttggccatgtttttgggtgatcggagacgtaaaccctactgcctaacctgaca

SEQ ID NO: 39382 - DNA, 1451 bp, Oryza sativa
gcttgaaaatattagaaaagcatcaccacttctagcttagccttctatatactactagtactacactatatgagtacagattattacactagtttagagagatggtgattcgaaaacaaggagttttcatcagcaatatagctagatgatgggaccaaatatgcgggaatcgaaccaattccaatgaaatttttgtgaagttttcataagagcatttcattccaaatgagaccgaatccgaaccggtttcgacgataattttacaaggtttttcatgagaatgctgcagagtagtagtacgtcgtgtgaggcccgcgagaattcgtcagcctgcctgggcctcattgtgctgagtagtagtcctatatggaattttttttatttataattttttttattaaaagttttacaaaaataatttccattttgaaaattgacggaagtagtcgcctaccgccctctgggaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttgtactgtggggggggggggcgcctgcaaatgggcggcgagggggcatggaattttgcaggcggcccccttgccgccctgggggagggcgatttttgcctcccccctataaagcccagtccctcctctgtgaaatttcattatattcactaaaaatccaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacaacacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaggggtgcaggaa

SEQ ID NO: 39383 - DNA, 1038 bp, Oryza sativa
ttcctgcagcccatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgatattttgcctcgtttgttagccaccattgcccagaggaataataatacgtactatgacctacatacatttacatcggttgatgatcgaacaaagagtgtgctgcaaagagcctttttctcattgggtgcttgcataaatgcttttgtgcattgtcgaccgatgttctatgcatagaaggaccttatatggacaggtaaaaacggaggtcagagattgacagcaattgggtgtgatgggaacacccaggttctacctatggcttttgcatttgtagagagtgagaacactgaaagctgggactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaat

SEQ ID NO: 39384 - DNA, 1309 bp, Oryza sativa
tcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatattatcgtgatgagtgttcggactaaacacttttgtttatttgtactcttgtttaatatgtgttagtaattcgcttatgaacatttattacttatgttgaactaattatttatatgtttctgatcaacctatttgatgcaggtatggtgtacgacacaccggcgctgttgaaccgtggttttgacaggaaccaccgctcgttcctgtcagcagtcgagggtgcacagctcggcaccttccgtcgctgcgagagcaccgctaggactttcgtccttgtgcacacgcgaccaggcttactggctcaccatcctgccgatggtgttcgatattttcgttgagcctcactgcccacagcgtgtgatgagacagttcggacttaggcaggtgtttccgggcaacgtgcagccgaccgtcctccctgccgaccactcgtgagttcggattgttcatttctaaatttttaggcggattacttcatcgagccatataatttacctctcttcacaggttgactcgacggggacagctagcaggcgcactttgggctccacgtgtacagcagtacgttgacgactgggtgttagctacagaggaggtgatcaacaagctcttcccacacacggaggagaactaccgtgtctaccttcgctggtaccttcctcgcactcatgcgcgtgtgaccttcactccagacgccccagagccgcacgttgccgctgtcacggacgcgtatcccacgca

SEQ ID NO: 39385 - DNA, 1309 bp, Oryza sativa
cgcacgggacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgctagctccgcaggggcgttcgccacctcttcggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacagtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatac

SEQ ID NO: 39386 - DNA, 1208 bp, Oryza sativa
attcctgcagcccaatttagaaagtataaataaaaatgagctgctaagcagagaatgatgctacggaaatatataggggggaagcaatcctagttaggttacctttcaagcaatgtgacttccaattggagttgagtagttctttcctttccttcttccaggggcatcgaaatgcgcagtttatattcactgtctaccatcttctctcttatttccttgtcctataaaataggatataaaagcaacatattaaataataaaagggaaaaccacttgcagtttcaaatagttcaacataaccttaccctttttgcagcacattgtcggtaaaacacaatttcatcttggcaaaaaggctcgatgtcattgatttgcaggcctgtgccgtataatatttttgcaataatacttccacacacagagaaagagaaacacgattttaaatgtcacagaaacagttaactcacataagaaaagattcctgagtataccatcacagggctcaacaccttgaaggacatgcgaggcaatttcttttggtatggcaggggatggtggctcacgcatgagatcatcaccagtgagaatggtctcttccattgtttcctgtttatcgactattgggaaacagatatgaaacaatagcatcacgggcacaagcagaagccatacatgatcacaaagttagaatctaaggctggattctcttatctattacgtatgaatacacagcatattgggagattagttatgattgtaatgtcatgtaggtaagtagtatcttgcagatgctttattggttatgcagctagaagaggatttttaccagcattccaccaaacttgatatcatttacatgaatggaggggaaatagagcaaagacaccaactgagctaatcaacaaatctcgggtatcattgtgtgcagcaaatcagcacaacttccagaagttgaaagcccaatggaagattatactagagagaaaaaacttaagaggcacctgagaaaaagatactatacgatgagactgcaatactgaacatgtccggactgactctataagggctttgttcaccgtattttgattacatcctttcttacaatacaaagataacaacacaaattttattaaagttaccatcatattctgtaggatgatatggagttcatttttcaagacaagaaatggactggagggctgcaggaa

SEQ ID NO: 39387 - DNA, 3029 bp, Oryza sativa
aaaatggatcggagaggagccggacgcggcggccggcgaccaacggcggcgcgccgtttgccggcgaggggatcggaggaggaggacgacgacgacctgagccctgaaccacctgtgggccttctgggcttttgttcgctactataggcccacacgtctgtgcccatgggcctggttttccggcccacgatccatcggccccgatcaacggctgtgattcgacgagggtgagctagggcaggagtccccgccttccgatggaaaacggacggcgcagatcgcgtcccgcggcggccgcgcgctgtataaatccgcggccccgcagcgcgagaaacccttcaccgcagaaaccctagagctcaccctagcgcgccgccgccgcagccatctccgccgccgctcgtcgggctctctccatctcccatccaggtaaacggcacaccccccttggatctctccctctcttaggttgccatttggtagagtttttcttgttgatggaatgatgacgggtgctggaaatgtgcttcgctaatgctagtgctgcgatctgtgatccttttgctgtgagataattggtcttgctgtcgttagtgttagcttctacgcgttggcagtaggttcttggatcgaatgcagcagcgggcgttgggtttacttgaaatgttctgtttttttaatgttacagtttcatgtgtgaatcatagaatatttgtttccgtattgatgaaatggacaaaagtatggttaggatctgaatatgtagttccacgtttacgggatgtgtacaaacttgtatatgttgcattctatctctcctgattggttgttacgctcatttacttgctttgtccttacatgctagtgttatatgttagattcattcttttgctgtgatagtttattttgtggctagttaatgccatttatctgtttagactttgcatcgcagtcttggtcattgtcacctatgttcgtcctttattcttaggagataacatgcttaccgatagttgttagtcaccttggttgtttagatacatgaggagtttctacaaatcatgatccatctgttaagttgaagttacatagtctgaccatatttcgtcctgatttgttcaggatgaagttcatttctgcctatctgatggcctatctggctggcaactccagccccactgcggaggatttgacaacgattctggagtcaggtaatttcatctccctgatttatgtccatatttgaaactgttcagaaaatgtaatctagccaataaatctgcttaactggtgtctacattttcttctgcttaatctggctaattccatggcttcagaaagcagtttttttggtctaaatttcttagcatttaatcgttaaattagaaggtaccattctaaggtttgcattcctttctaaatgttagactatatttagattgattggtttcgttcttatcttcttgggtgctttcattaaatataatattgaagtaatagtcatccacttatagctgtatgtactgtgaaatttgacctcaatctttgtctttgtggcagttggttgtgaaatcgacaatgcaaagatggaactcctgttgtctcaagtgagtggcaaggacatcactgagctcatcgcttgtggcagggagaagtttgcttcagttccatctggtggtggtgtgtagctgttgctgctgctgctcctgctgccggtggtgctggtggtgctcctgcagctgaggcgaagaaagaagataaggtcgaagagaaggaagaaagtgatgatgtaagaccaatgttcttatttgtctcaattagcatattttgctcattcattatgtctatggtagtttgacatgacttctattcaatgtataatatcgtatgatttgcaaaccgttgcttctgctatgcttcttattgccatttaacattcatgtttagtttattagaacaaatacacctaatggtaactaatttaactgtttgcaaatttatttacaggacatgggcttcagtttgtttgactgagtgatgcggtcacctcttctatcatcaataccagactttgcgcaggaaactagagtgatgatgtttgggattttagcttttcttctttagttaagttgaaaacacttgaggaaagactatgcttcctactatgttttgatatgtagtaacgcagccataggttgctggttacttcactggtgaaccatgcttttgctatcaaaattcaatgcttaatggaggatgaattgtgctcggcagtagtttttagctgtgttcaattatgtgtccctatttgttcggtgttatcagctcccaatttgattcatttgagctacgttatctgtctatcgttcatcttccgaagttgttttcctttgattttctgttttagagattacgataagccagaagttacatcagtaataataaaaaactttggcaattttaaacgagaaaaaaggctattttttgcatgcagatgcagtaaaaaatcatgtaaacaatttctggagtctggacatagcaaatgaaagattaaggacatgcgtagtggttaatttcaaagtagtgatagaatcatagaattgccatacaatctaatgatctctctcaaagagcaaaatatgtagatggaaattataggactggcatataatacgaaatgaaccaatcacgaaagagctactaataaatttgccagaattccatatctcaaagagcaaaatatggagatggaaattataggactatggcatataaatacgaaatgaaccaatcacgaaagagctactactaaatttgccagaatttatttttatgattactgcttcagaatgataagaaacagatctcttatatacccctgaaatacccctgaattttgcttactttcttgtataccccaaaaatttgattttgatcccttgcatactcctcccgttagttgaccgtatattttctataaaaatgaccattttacccttggatgaataaagaaattcataaattacatt

SEQ ID NO: 39388 - DNA, 19482 bp, Oryza sativa
gtcgtcagctcacagccacgttcccgcgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcaagcaaaggcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagtcgcgggtggtgcaggaggacggcaagatggggagcgccgcctcctcgtatacggcgacggcagcacgcctcagggtgcgcttcaggctgctggcgcgctcttacgacacccgcctgtcgtccatgacccggagtctccagcccaacgatggctggaagatgtggccaacttggtcatgacggctcagcagcgcctgggtgctggtggacggtccaccaccaccaagacctccggcgccgccaccaccggttccgtgtcatcaaggcggagggcgcggcgagcggcggcggctgcacgtcattcggctgccactccctcgtcgacaccgtcgactcgggaggatcagcatgagaagccggatgcccgcctcaacagcgagcgccggcgtaacagccggcgtactccccgtgcaacggagggcgcctcctcgtccagagtgtcacctcgacatggacgtgaggatcagccctccgtgcccccggctggtggtgtcggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatctgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccggttccggagtggcagcttcggccgcccccggatctgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtgcacaacacctccctccacgatctcgcggactgtcgtgcagtcaaaaacctggctgagcgaacgaggaagtgggaggaggacaggagacaggaacgccgtgagggcaagtccccggcggttccttccggcaaacggcgaagtgaggccaagcagatggcccccgctgttgacatcgatgatggtgacgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccgaccgtcccagccgatcatcggtgtgacgccggggcacacgtggccattgggtcacatcgacctaccggtcaccttcggtggacccgccaacttccgcacggagcgggtgagcttcgatgtggcggacctcagtctgccctacaacgcggtcctaggaaggcccgcgttggtgaagttcatggcggctgtccactacgcctacctccagatgaagatgccgggccccggtggccccatctctgtccatggcgaccttaaagtcgcgctcgcttgcatggagcagcgcgccgaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccatgaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgctgtgcggccgggcgcaaggccggtccggcagaaagtgcggcggcaggccccggaacgtaaagccttcatccgcgaggaggtggcgagacttctggaggccggattcgtccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatattctggttaccatcagattcgcatggctagggaggatgaggaaaaaaactgcgttcattacccccgtaggaacctattgttatacatcaatgcccttcgggttaaagaatgcaggtcccacttttcagcgtactactcgaatttctttgggtagccaaataggacgtaatgttgaggcgtatgtcgatgacttggttgtaaaaacgcgcaaccaagaaactttactttcagatctagcggaaacttttgaaaacctccgctccgcccgcataaaactgaaccccgataagtgcgtgtttggtgtacccgcgggcaagcttctcgggtttttggtctctgcccgaggcattgaggccaaccccgagaagatacgagctatagaacggatgcgcccccccagcaaacttagggatgtgcagtgcgtcactggttgcatggctgccctaagtcgttttatatcgaggctgggagagaaggcgctacccttatttaagctcctcaagcgctcggggccgtttacttggacggaggaagctgaacatgcccttactcagttaaaggtgtatctcagctctcccccggttctagtcgccccagagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgctcgtcagacggtgccgggtgcccccgaccctcaggaaggccccgaggccactgcgggaaggccgcatctaccaccctttgaccccgaggctaaccctgtgcagattcgacccgggagagagcagggagaagaggcccccgagccgaacggaggcctgaggcccctgacgaccggagctggccctttgcccgcttgtctgacaacgccaggagcccccgacccccgggacggccccgaggccactgtgggaaggccgcacctgtcatcttcggaccccgaggtcatcagcgcaggagacgagtgtgccccaagaggccacttggacgaagagcaccccggggatacggcccctagcgaagaggatcggccccgccgaaaggtgcagaggcctgtctactttgttagtgaggccctccgggacgccaagacccgatacccacaggcccagaagatgctttacgctattctgatggcctcgaggaaactgcgccattatttccaggcgcatcgggtcaccgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagactgtctcaatgcccgaggccagcacgaacccctcacagctgcctcaaaccgcccactgggtgatgcagttcgacggttctctgtctctccagggcgccggtgcaggggtcacgttgacctctccgaacggagacatcctcagatacttggtccgtctcgactttcgagcgactaataatatggcagagtacgagggactccttgccggactcagagtggcagctggactggggatccgccgcctcttggtattaggcgactcccagctagtcgttaaccaggtctgtaaggagtaccggtgctctgacccacagatggacgcctacatacgccaagtgcggcgtatggagcgccatttcgatggaatagagcttcggcatgtgcccagacgggataacatgatagccgacgaactctcacggctcgcgtcctcgcgagcccagaccccaccgggcgcctttgaagaaaggcttacccagccatcggcgcgacccgatcccttaggggagacggatgcgcctaaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgagtgcggagcccattccgcctcgcgtaccttggttggcaaggcctttcgtcaaggattttattggccgacagctcttaatgacgcagtcgatctggtccggcgatgcagagcgtgtcagttccacgccaagcaaatccatcagccggcccaggccctgcagatcataccattgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaatcgtattattacggataatggcacccaattcactagtgaactcttcggcgactactgtgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggaccgtatcgagtgatcggtgtcccccggccgggctcggtacggctggccacgggcgacggcacggagctgccaaacccgtggaacatcgaacaccttcgccgcttctacccctgaaagggggggtcgggtgtcaggtttctatctcgggccaaccccgcacccccctcgggtgtgcagggttggccgggggctaccacacatgcacatatattccttttcttatttcagcttttcaataaaagcagtttcaatttcctaaaggttgtgtctgtgccgtttttccttctaaagaatcttaacttgaaataaggtcactcgtgctcaaccttgccctcgggggttcggttcggtcagcaaaaatcgccaaacggggcccagaaccgagccgtgccccggggtgtggtgaactccgggggggaatcggcaaaagcccacgatcgggttacccatacccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaacttatatatatagcaaaataaagttaacatagaaattgtttcatcatttttgattgcagagtaatttgatctatacaaaagaggcatgaaggccttagaagaaagaaaaagaaaaaagtaaagattgacgggggctcgggggctcattctgacgcgcccgggtcgccggcctcgtcgccatcgtcgtcctcaccgctggcatcgccctcctcgtcggagctgggggcgaacgcgagccgaggggctgagccctcgaagccgttgacgatgtggtcggcggcatcccggacgcgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttgatggtcttctcaagctcctcggggagttgctcgagaacccaagccatcctgttgaggtgcggagcgaggccttccagattggtggggggcaccgacgactggcctccccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagccgcgaggcgggcggccaggtcgctttcgcctgcggccgccccgccgataggcgccctcgcggccagctctttctcccgtgcctcgaggttggcagcccgctgctccagcgcggctctctcggcacggacacattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggcctgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagcttgttattcagatccgcctcccagctcccgtgttgaaggcggagggagtcctgcgcctcgatcatcgcggtggtggcgacgagggcggcctctcgctcctcctccacctctcgggcgatctccgccagcgccgccttgcgggcttcgagctccgagatgtggcgccggtgggccttacggccctacctccaaccatggtgtccaccgagcgccgcccctcctcgacgcgcgcccatgcggcctcgagctccgctcgttccgctcgcaaggcctccacctgggcgctaaatccatctagcaccgcggtgtttgcggcggccaaggcctgcataatgggctcggcgctcaccggggcaacggaagacgaggagaaaagtcgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcacctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcatcttcagcttcccgaaggcgggctgcggcttcacgccggtcagactctcgcctccgctcctctgcggccgccggatcttcggcctcggactggccggatttggggtggcgggaggaatgcgacgggacatcgctgaagcagaagaaaaaaccgaaagacgaacaaaatgagtaagaaaaaacttcttttttgggaggaaaatggttgcaatgagagtgagacgaacctgcgagggggtcggttgaatgaccactttggaggggaaatcaggtttccccggcatggttccgtctcccccgtcttacggagccgcttcttcttgcgcaccccctcgggctgcgacgtcggcgcggccccctccgggcgccgactgctggcacgcgccgccccgccccctcggggaggagatgggggaggtgtacctcccagcttcctcttcccctgggcgtcggcagggcggctgctccccgagcccccgacgcggggcccagaagcacgaccccctcctggggcaggttgttccccccggcggcgcacgcccgcgccgtcgtggcccttaggggctctctcctctgaggccccgacccccatcataatggttagaatggagacgcggtcgggatcgctgcagagggggaggatctcctgaggaaggcgagacgcctccgcggagctaagattcagcaccctttggactacgatcttgaagtcctcaggagcccaatcccatctggctccctggtgggtccgcatatagtcttcaggcccagtatactcccaggcgctccgggcgcgccgttggagcggcgcaatccggcgatggaggtaatcgccgtacaccatggccccggtgagcccttgggatcgcaggcccgccaggcggtcgaggacggcgtcgtactcctcccccagatctaccggcgcccgccagctggagacctgcgccgggggctggcttggaagacggaggcgcgcttcgttggcgaggggggtgtagaaccagtcgctcttccagtcgtcccacttcttgcggaggacgcaggggatgtagcggttcagcaccggcccccgcggctggaagtagcagccgccaactaccgacggcggcgacaccgactgcacggtgaagaaccaccggaacaactgaagagaggggcgcaccccaatgaacatctcgcacaggtgtgcgaagatggccaatgtcatcaccgcattgggggtgagatgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatcctttcctcgatgcttttatacccttgccatcgctggtcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaacggattgtatcgtgcgcgcattaagtacgctcgccgaccgaagcggcgttaccgtatctccgagcgagacaaatctgctcacccagattcgcgcgctgctcaagtgatgtggcagtcttgagtagaccgcccattatggacaaccaaagtcaccaataccaatgtgcatggattgagaccgttgggtgttttgcccaactacggagaccggtcccacctgtcaccaggctttaggggtggcgtcacacctgaccgcttcccttcggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggtcagatttataccaggcttcatcctaaccattacaggcaagatgttgtgtgaagaagggcaaacatgcacgttgctaagctgacacgcggtggacaagaatgaccgatttgtgaccggtctgacactgctcaggtcgtcagctcacagccacgttcccgcgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcacacttaaagtactatgagtgataaaacaactcgtaacaaaataaattattattacgtaaatattttgaataagacaaatggtcaaacatgtgagaaaaagtcaacgacgtcatctattaaaaaacggaggcagtagcagataacaaacaatacggtgcagcgcaaagtagcaatggagagaatttccttgcttttaagcagaaattggataatcacattgaagagaaactggataatcttcaaaaacatcacagccaccatggttaaacaattacatgcatgatttatgacacatgtcatgtactcaacaattccaacataatgacgaactgacttttaaacagatacccaaattttgtgctgattatttatgggattaatgacagattcttgtatacatatacccagttgccctcttactgcagattctgagttcagaaaccctgttcaacaaggtaatcgccaagcctctccacaaccatgttgcactggccaggagtcatcggttcctcatagattccaatgatgatggatagataaggtcttcttgacagtaacccctccagttccctgagaaaatgtaacaaaaatgcgatacatgaaattagcatgtctctacagagaccagcaatagcttgtagcaaatcaattttcgggtaaaatttgtaagtttgttaaacataaaatacttctgcggttgagatagtgtctgaacaattaaaggtctggtcaatctgctttccgagataaaacggtttgatgagagaacggagatagtagcagggatgaaaacggtcggaaaaaccttagtgtgattcaattctaggaaactttatcaatgtgctagtgatatttatggtccatattgtggcgttcctagtgatttctgaaagaaaggggaatcttgcagcactattctagacccttagcttcgaaaaatgatgtaattgctttcagctgatttgctggaagggaagtatattttgtaggtcaaaagttgaaatttgaatcggcgaactcggtaaagttgctctcatagctttcacatatttgtgcgccctatgggtagatataagaaggaagccaacatagtctacctttctgtgagatagaagctaaagaagtttattcccatgtaactggaaaattcgaataaaatgctcataagatactgggctacatggtcattcgaatttcagaagatgaagtctatacagaggtgtgtttggagggccattcacatgaaacagtccttgcaaggttgcaagaatcaggaaccaaaatttctctcatttttctagaaatttttgcgataataacaacttgccaaatataccaagtataaaacgcaatcgctggacacacaggaagccttttgtgttcagcaatataatttcccttcatcacattgttctaaacttctaatcagttgtgtttagtttaccactgattcaccattcaccaacaacgatgtcagtcctccttttggcacagaatgactgactgataacatcgaatgctgactaaaaattagcaacggaaaacacatgacagggaaaaaaaatagagcctggttttgctgctagatcaaaattctcttctcttccaggactggaacaagcaaagcaatcgcaaacgtctctactggtaatggcagggttagagttacgcatctgaatatctctcatctcatgagagtgaagcagagagcgagagagaaaattgctctgctccgctcgtcctgtgctcccagagatttgattcgattcgattcgattcttgcccctgacttgccttgcccaaatcttggcaagcgtcgtctctgctcaccgtatgtttgattgatcgcacgtaaatcagtagtattatgggccttgaaggcccgtaatggaaaatcagcctgttgcccgggtgttgatccttgcatcatcatgctgtcttttaatagatttttttttggtggggtggggggttatagtaggcccaataccttttttttttacattggctgaataaatgattactcctacattcttggtttaacgagtctaggatttgggcggggagcatacagtctccagtcagcactagacctagcactcattgccattcgagcaagatcatgagccaccctatttctcctccttttattttgtgcacttgcacctgttggagacattgcatcacacttatttccaagctttaatggatgaatggctgaactgcaacggattatctgatgatttgggatgtgataatatttgaggtacaaccaaatggattagctgttataaatttaaaagaagtattgtagggaacttacatacgtagaaagctattattataaagcttgaaggctgaagcttccaaccataacttaggctgtgttcggaaacccctcccccccggcaagcaaaacgaaatacatattattgcatgattaattaagtattaactattttttaaaagaaaatgattaatatgattttttttaaaacaactttcatataaaattttttttaaaaaaaaacacaccgtttagcagtttgaaaaccatacacgcgaaaaacgagagaagtgagaacacaatcttagggtgtgttcgtttttcttttttgcttttgcaactcccttgtttaccgtaagcacacttttcaaactgttaaacgatatattttaaaaataattgtatataaaagtttattttaaaaaaatcaaataaacatgtttttcaagtttgtcgtacttaataactaattaattatacactaatatcatttattgtttcgcacatggtaagaaaaagaaaaaggtaaacgagcttttcaaacagagagtatattgcaaaagttcaatattcaagccatagcatcacaaatagtaatagtgaaaaatagttaacacaataaaagtcaactattttagactaataaaattaattaatttgagatgtaaaaacctgctatagaaacaaaatggttcgacgtatggcaacaaatcaaccaaccgtaagtagattagatttgatttatcattaaatgttctttaaacgtgatataaatatttttatatttacataaatattattgaataagataaatcattaaatattgataaaaagttatcggcttttattattaagaaacggaggtagtagatgttgatatgccggccaaacaagagcccatccaagatcggatgcccccacgtagcgtattcatcaggataaggttgtgcatctgcaatcgcctacgccaacagccgatgcacacgcgtgcgacaccggaggcaggatatagaccagcagagagaaatatctcctcagaaatttgtcattagcagcaagcctaattaattcacggtaaaaccaattataaaagataaacccaaagatatttcaatcgtctcaccaaaaagatacaacagtgcacagcacggcaggtacgtacacgaccgattattaactgaacttatgtgtctgaaaaaaaaatgcaattcaaagttgagtactatagctagctaggcatcgtttgcttcacgacgacgacgacgaggaggaggctgtaatggctacggcggcgcggacggcggcgccggcgcgcttgtagttgtcgatgtagtaggcagggttgggcagcttgaaggtccggcggccctccggcgagcccagcaggtcgctccactggtcgccgatgttgccgatgatcaccatccccttctcctcctccagcttcttcctctcccccgacttgtactccaccaccgatcccgtcgccgtcgagttctccgacctgttcgttcatttcatcaattttatactcgcaccgtctcaaaatgtaagcatttttagactcttatacacggtctgcgagatgctactttaaccaacaatatctatataagtaagatgttttaaataaaaagagttacatatcatgatagtttgtttaatgataaatctagtaacatcaattttacatgattgatctttttttactattaatggttaaagtttaaaatatttgatttgtcactatgctaaaaatatttatattttaggacggagggagtacacgcaggaattcagagattaattagtttgtaacgtgaccttaatatgagctcgtcccagcagtcgaagccttccttgatgagattggtggcggtggcgttcctcagctccggcgtgtccggcctgtccgacaggaagacgatcttgacgccgaggaggagcagcttcttgtacagcgtcaccgtgttcggcaacgccgacgctctgccggcgatcagccactccatgaacgccggctcgtcggttctgtggtacccgaagccgtgcttcttgtagaacttgacgtgggagagggcggtctcgtcgacgtcgaacacccaggtggcgttggcgtcggcggcggggtcgccggagaggacggcggcctcggcgtaggcggcggcctcgtcgacgacgaccttgctgtcgcggcggtagtggtggccgcgcatgtagttctcgacgtagttgtcgcacttgcgcggcgccgccgtccacccccgcacgttgttcgcctccacgccgacgcgccagctgtcgcagtagtcgccgtcgcccacggccgccgggatcatcatctgcctcagcctgtccacgaacgagagcgccgccgccgacgacgacacgacatcgccggcgccggcgccccacccgtggcaggtggtggctagcgcggcggccacggccaagaagcagacaagtcgcttgggcgccatcgccgtcgtctactgatgtttatgcttcactctgcagctggcagctggatatatatacacacactgacacacagcaatggcacagtgcagagttagttactcctaacattctatccaagatttatggaggtaattgtatggcggccccggtggcgaggtgaagagacaagaagagtttttgtctattgcaatcaatcaatcgagcaagcatgaaccatgtcgcatttgtcacgttatccgggaccaagcagcaacagcagctagctatagcctatagctggggctcaggaatcatgtggattctggtgtcaagataaggcgccgcgggcgcgtagcgcgacgtacatgtgtgtggacgcggcgcagatgacgccgcctcgcctcgcctcgcctcgcctcgccggccgcttcacctgtcgccacgccacgccacggcgcgccgcgcgacgcttcacccgcgcgcgcgagagagaagcgggccggtgtgatgtgatggggacggcgtggcgtgggccggcccatgcggttccgggccgagatggcggatggcaatgggctaagagctattgggccgcggtgcgttgtgaggcccattggaagaaaagggaaattgattgaagcgtagtagttcaccgtacttggatttgctgatgtgatgacgccacgagttccatgacgcatcggatgatcggatttgtcatattcttgggaggaattctgctgctattttctaagcggagcgcgcatctgcaaacaacaggcgacaattgcaaagccaacagaatctaagatatacccgcaccagcatatattttatttcccacaaaatattattacaaaattagtccactcttctgttcccatccactactatagcccaaagttgttttacttacttgggaaggcgggaaacacatggctattttaggagaggcttccgacaatcaaaagctactcaaatagtttagtttttttatttaggtttggagaagttatatagttttaaaattcaggaaaataataagaagcagacgcctgcaaaaatgttttttttttcagttgtgtgtttttttttcacatggtttttctattctctcaagctgcttatctgaatctaaaactctcctaaatagaccgacagatcgaggtacagttgagaagttgggtgcatatgattattcatcatggttctaaaatccgaattccccacaaatatcgcacacatgggtacctttcaagaaaataaagttgttttacttacttccattactagctaggtttaattacttacacagcactaaaaccacaaatgtgggtaaggaaacagcgtcgcattggaggcaggaatagataggcatactcctttgagataattaaatatgattagggaacaattgcttaaaaaaaagaagaaactaaagctagatcaatatcacatttgggagagaataatccggaaaggaaagataggctagcttagctaggccatgttgtgttattctcaatcccactatctaacagtacaattcgccttgcaacttctttttgggaccgaatcaacgacacatgggagagcttaacaagaggttaactcacctacacacatgtgcacttttagtttctttttcttttctatagtatcgtctccaagtaatataattaaggtgtattaattcttattgtatatatgcttgtgcgcgtgagagagaatatatccccagatcgatctcttttcaatttctttgttaacaaaatagttgttttgttttgttgcatggccataaaagaaatagatgagagtgaagaagacagacatgagacatggccgaactctctctttttcactctttcttttatcctttctatctcctgtggaaagggacatgtgagcatctggtttgttctatgatgttccatgaacctgaaactgtctgaacctaaccattattttttattaatctctgaggctctgagcatatcataggcaacaaaacacatgatcagtagcttggatcatatcatactatcatatcggctgagagatctagcagtaaatattaactagtgttaaattgcccaaaacagattgtacaagaactatatatttcagtcttaatttagagatgaaacgaataatgttcataatttagctaggttacaaacacagacgcacaaatgggcaagttacttctttggttagctgctctgaaaggtagaattataaagatagagatagtttattatgattcgctaaaagacaaatgcgagaacaaataataggggacattaactgcaaaacaaacaaggaggaacctttcctttacctaactcgttcatcatcaagttttttatgaggaaaggcgatgcatatgttctctccttagcactgagattctcagcagcaattatagaagtagcattatgcccta

SEQ ID NO: 39389 - DNA, 13890 bp, Oryza sativa
ttaaaaggtaaacagatcgcccatttcttagttaaacaattgaagtgctttgcttaacaaaaaattgtaaatgcgagtcccttaatagttgtcagacctgaagaactgatactgttacaaattctttttctttgagccacccaccagggacctcaaatgccaaagcaacatctgtgttctgtttttcaagaaaaatccagaataagaagaagaacctaaatgccatgagatggcataaataactttataaatgccttaccgatgaatcagcagttcttctatattccccaccaacataggtagactttggctttgctggtccagttacaccaggcatgtcagacagaagtggttcagcaatagataccaattcatatgatcaacacctgttgcagctagaacaattcggggagcagtgtaattctcctgacatccatacaacaacaaaaaaagtcaagttatcgaaagcatgttaacagctgtaaacagatagaatacgacaagggcttcggacatgagtctcacagctaagaagtattctaggacattcgtattcaatcggctaactgaggattctgaggcaatcagaggggttgccaaagcaccagataaccagtagaatgaagagcctccaaaagaaaagtttcagggttacttgaagcttctgcaagctctgccttcagtttcattatctacaaagataaataagtcagtaatgaacacatgttaatctacattacagatttacagacatggatggcatgatattacgaggaaatacctgttccttgacttcccaatcaagaaaagcaggattgcgtacacaatcaataagcacctcaaccatttcaggcatgtaagttttcagggctgcataactgtagctcatcatctcacggttagcagatgctttcacattgccacctactgcctcgatttcacgcacaacacgcaaatggctcctgtttgtagtggttgtataggccatcttcttcaacagctgagtggcacctagtgtttcaggtgcttcatgtacagaaccacaattaacatatactccaactgaacaagatggtccctgtaaagcaaatacaaagcagaacagtattgctaactgcccacagaaacatgcatgaagcagttagatcatagaaatgaggagcacatactggagttgtctcagaagcaatttttacaccatttgcaagtgttgtgatttttgtcttgccaggctccacaaggtcaggtagcggaggtggaatggtgacccctggaagtgtaaaatctggaggaggtaatgcatttgaccgtgcacctgtcagccaggtccagaagccacctgatgacctctgtgcaacacttgtgctagcacacctaatcgcaacattcaacatttgaccatccagtccatgccgctgaaaaaagaggtaacaacaaaaattatgatcggtagcacaagctgtattggcctgtataataaattcaactactccaaaaaccagctgtctctgcttgtgtactgtcagagttaagcagtgcatagcacaacaatatttctatgtacggaaatctaatccatgaagttactagcatcctcatttaaaaggggttttctaagtccaggcttctgcactatgcatgatacaaacgaaagagcagcaatctgatgtcgaatggaaaaaaaaaatcatcaacacaacgtttccagtcaagtgaaatcaaatatcaaagatttttagtaagcctatataagaaatgttgataacataggaagtgaatcatctaaagaaagttatctaaactcttcagggtcatacatctaactgtatatatcattgcattcagagtaatcaactaagggacaacaaaaaacagaaccaagcataaaagataaaactgatactctccatattgagcgataagccgataacctcctgctctcaggatgattttagccgcctaactcatgaagttcagcaataacgagggaatgaccaacccagaacctattaaaactcaacataatcctatttcagaaaaatgtatgccctcatcgcctttccacgcctttgcagaacgtcaactgagatcaaacgtatccaaaaaaaaggtatgctacaaaacaaatccgtaataacaaccctcatcgtcatatatcaaatccaggcttttcccaattcactaggcaaccacgatcgctagctgcgacgaggggctcatgacctcacgcgcacacatcaaatccacaccgaagctcgctcgatcagaccactaaagcgtaccattccaccacgcatcgcgaagcgataaccctaagggggattcggatcggacgcatcgtggggtgataccatcagatctagcgaaatggagcgaggtaaggttcacggtttggggcgggacgggtgcggctgaccttgatggccccgaggccggaggcggcgcggtacatggcgacccggtgcccgcggaggggtcgctcgtcggagtcgtcgccggcggcggcgcggcggcggaggcggaggcggagatggggaggaagcgaagggaaggcgagggcccgtcagacaagtggaaggggaagaaattcgaggcgctggtccgcatatagaagtgggcgagagctcttaaatgggccgggccgaataagaggaataattctgtggcgattgggcccactttggcccattttctagatgcgttgggccttacccctctcgcctctcgtgggctcgtggggagtcgtggccatctgatctctctcacaaagccatcctccgctgcgccggcgctcgccgagtcgccgccgttgatgcgccgccccggctcgacgtctccggcggcggagacgaaggcggaggcggctacgcggagggacggggtaggcgtgcgacggcgacggttgtgaggctaacggcgccggtcgaatcctccctcaaagtttgcagatgagttgcttgatcaaatgccgattagggatgtcacgcttgaacgtgcttgtgcgtttcgtattttttttctcccctttctagttattgctgttggtgtctagttaattttgtcgcatttgcaattacgtctggggatttgctcctcgcgtggtagatgacttccaatttccacggcattgagtgaagagagagtgatggtttctgtgctgaaatcatccccgggtgggtatgcaatgcaactgatctgaccaccaccacctgtttgagggaattccagtttcagttcataaattttagcgggtacatcttctgttctgtctgaaagatgtgtcgtgtgcaaagttgtcgcttgtcagaatggtccaaatctgcttgttgagctgtgggctttcgacagattcaggacaagctgccaaggacggctctagatttcgagcatgtgtttggtgtatgcgtagggttggtgtatggaggtagttggttattgtgggcgtttgtgtagggtcttaacagttattgctttgatgtttgatcagatcacgcttattaggtggaggacctgtacagattagtcatttgcgtacaggagattgtgtcaatgctctcgcaggagacttttattcgtgtcaatgatctatgcagccatgcaggagaccttttagagtgcttgtgagacctaacatccgttgatcattttaagagggacacatattaacttgattgtaatgtgccttgtatgagggagtagctgctagctatagttgttggccaaccacagcaatgcattttgttcctatggtctttggatagtgtactgtccaatgtcaataaaaattttcactattggtggttgtatgttaacacaattttcttgcagtccttaaaaggagggcaaaaactttgccttgtatatgttaatagagcaggagaactctcttgcattatcagtttgctatgcctcccagttaggatgtagcttacatcctgagaatagaccgccatatactgtgttattgtctgtgtacatccaattggatgtagaggccgggtttaacccattttctaaaaatactgtgccatttggtggtgtgcatttggagcaaaacagattcatattccttctatttaagttgttgttattgattccttgaacaaatatattatattcttcctgttttcgatggaaaagttttacattgcttgaagtaacacaatttctgaagcacctggacatgtctgtgagacagcacatccacttaactgatagtattccatagtattattctgcaccttcttgttttagtgcaagcatctcagatgggaaaaactgcctgcagttgtaaaatatctttgttgtcacaatttcctaccagcacgacattttcatttagttcctcatgtaatgtttcttctctcaataaggtagctgttgcagagtgatcagctaatgattgttggactcttcttgtcaattaggtaaatacttaaaataaccgtcaaggcatcaagggaagcatgtgctggcggattgtgcttgatgatgtttaaaagtcctcatggcgcatgggaggggaactgtgctgcctgtgctttgagcatgaccgcagcaggtgcaagccacggttttatgcatgatctttatatgctcttttatgaaatgaatttgttatgtgtcgtaaacttgtaactgttcctcgaaagctcaccacaaattgtagttagcctcttgtatttcctatcactttcatgcagcatgtataggttcaattggtccgcgtaaaactgcgacaggctaacatttttccccgcatgatgtctgtttttcatcttccttccccccattaggtggcaatgtgttttcaataaatatgttggtagaatatgtgctctgatttttactatatgcatacagattaaattgctcaaagaagatatggcttagtttaccagcttcagaaaactatgtctctcatatgtctacatgcacaggtgaacggtcagctcgtcagaaagagatcggttgaagttgtacgcctgaatgcgactgcgtcaattaatgtgattcaacagaagacatgaattgatcaagagagttgcatgtcgttcaggtactttactctttgacattttcttgattgatttggtatactctgctaatgaatagtggagtagtatacaattatatacgcatttatacgctgtgacttgtgatcatatttttgtacgtataccaagcaacacattgcaattattaattatgagcttgtgcaggtccgtcggttggccagaaccacgactccaagtgtacgtacgtttaccacacacaaacctcttattattccgagcaactcatgcctcgtgcggattatgtatagtcaatagtcatatggcctcatgggtgatattcatgaaaccccccgtgaggtgttcctaccatatcattttttttccctgataacgagacacatgattaagaatgtgtttgcctaatgatgctgatgaatctttgccctgccaaatgccaagacggccggggctatcccccctggaattttctcgcaggtgagcaagatgtcgtgtcgacattgggaggaggaggggttatcagggtcataatggctctgatttgggcatgcatgagaggcacaatgcaacacacggccgcggggtagagaggtggactgatcggagcaggcaggaaggcagctgctcgacggatgagcccgatttttccctgttcaggatttatttacagctcctggagtaaggcgtaagcgaaggcgaccgcgcgaggagagacacagaaggagaggaggaggacgatgctgttccagtccaggtacggttgaacctaaccgagctaaccttatcgccgctgtcaatgttctgcaacctggtttatggatgtgtttagttcgtgaaaagaaaatttttcggtgtcacgctagatgtttgatcggatgtcagaaggggtttccgaacacaaataaaaaaactaatttcataactcgtctggaaaccgtgagacggatcttttgagcttaattaagccatcattaacacacgtgggttactgtaagcttaaaagattcgtctcgcgatttccatgcaaactatacgattagtttttgtttttatctatatttaatgttttatacatgtgttcaaagatttgatgtgatgtttttgaggaaaaaaaaaaggaaactaaaccaggcctatctatctgggcctgacgccggccgtcgtggtcgatcgatcgcgcccacaggcacaggcacggcaggctggccgtatcgatctgatctagctaaccccacctcactgcagcagcagcagcagcagcgcggggacctgatctctctccctgcccggtggggcccggagcaccagctccgctgctctggtcatgctttccatggcaggaaggaatgtgacacacacggtggtgccggggagaatggcagctgggccccagctgctagctgcgcgcgtgtactgggtcatcaattaacagttttcgtcagcttgtttggatgtggccacctaagctagcgctgaggtgacatacaaggagagcgtgtcgaaactggagaagacggggcttgctgttcaactgcttcagactttgcaggagggcactgcttaaggaggtaattaagcaactgtccagtgtcctactagcaatatatatattcgaagtacatccacattggatcaatcgtcctcgagtgaacagaggtacgacattctccatcagttatgagtacttgcatgcaggttctgtctggctcattggcagtttggcacaaaagcatttcaatttattgctgcaatttctgtttgtttaaacctgagcatgtagtagtagattattatctttatcgaatacggagtggattagatgctggccggcattcttgctgacacacaaaaggggttaattgttttggatgtctgagagccaatggctagggttctgcttgcaggagaaggttgctccctcccctgggcaggcatgcgaggcaacacgagcatataaaatttttatgtatgttctctctagccttagcttgtctacatgtacccttgttggggtccatcaagtgttgtgtagtactgctccatctgccttgggtgggaagcaagccctgggattcacctctctctctctctctctctctctctctctctctctctctagtctccaacatcacagactctcatgccgaaaaggatcatcattcgagcacaaggcctcctccatatgcccatgtgagaactcttatcacctgctccgtatatcttctttctactgcaatttgcaaaccccattattgtgcattggaaagaaatatccttttccatcattccgcgaaagcgaatgtgtgaaagaagtgtttcttcccagctgcatgcccaatacctcacatgattattttgttcacatcgtaattaatttagcactttctcctgtactggcaatctggatttaaagattttcttgttgagtatcaggatttcttttgtttgtttaacagcttgatgaagtgcatggcaatgcaacctttgatgagtcgatcgactagcacctagctcgccctccactcgtaggagctttatgctgcgtgtgagtgagtgcagtgcagtgcagtgtgtggaatctgcagtaacagctgtgatgtggtgaggcagcagttcttcttgccttttgctttttagttgtaggactggccagtctctcttaagctctctaaattaataaatatacatgaatcagctagctagcggtaaacgtctaagccaaaggtgcttggtgaggcgtcgggggtgtttggatccccgccaaacattgcctcgccaaacatgcggctgccacaacagtttggctgatgtttggttaatacgtgagttgtggcagccatactttttgctagttcatttgcatgcttatttccgccacagtgtggcgattatttctctcgccacaatctctggcggcgccacaatcttacagtcagttcaatttagcatagatgaaaggggtttgtgtgtcttgtgctatgcttaaattaacgatggagagagaaacagagaagcgatggagagagagtgagtgagagagatggagaggctaaggaggaggggccctttaacttttcctctataagaggtgtggcttcagttaaagtaggcaggaattctgctctctctctctctcttgtattaaacttgtgaaagcagcaggctgcctgcctcgattttttttttatatgtacacctctcccacactccttgctctctcgtttgctcttctactgctcatcctcctcctctactactcgtcctctttggtttgcttccggcctcttcttcctgcatagcttctgttattcgatttcgatgatcttgtcttctccttgaattgtgtgtgtattaattaactgtatgtttgtttgatcccttgcagctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggtatgtgaagagtgaagtgatcaacttcgttttgcctagctcttttcagtaattgcacacttgcacctcggtcggtagcgagggttcttgggcttcttgctgcctggtgcaaaacttgttcttatggaattaattggtgtaactgcaagaaggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgagagtgagagagctaaggtagctatagctcaaaacattgcaccccccgcattgttttgatacagatatattcctggctttttgcaaaactttatcgggttttttttgctttccatggagtgatatatattgtatgctgggattgtttcgccatgaattatgggtcgtggttttggattttgggatatggcatatattcccttgttgttcttgatgtgctctcccccctctctattcttattactagtgtttctctacatgtgctcttggccggtatatgcaaagagaattattgtttatggaaagttgtgcctagtctcatctcccactctctcctctctgtcatgatggtaagatgcttctgaagtttccaaataggtttctttcctctcttcctctttttcagagaggtttgttgcatctgtcaagaagcataggccacccactccacactatactcttggatctcacaaaactctctatactaccttgatcctgctaattattctgtttgtgctgatcgatcgatggagcaggtgtgacaagggacggcctgagcaagcacttcttccaccggccgtcgaaggcgtacacgacggggacgaggaagcggcggaagatccagacggagtgcgacgtgcagaagggggagacgaggtggcacaagaccggcaagacccggccggtgatggtgagcggccggcagaaggggtgcaagaagatactggtcctctacaccaacttcggcaagcaccgcaagccggagaagaccaactgggtgatgcaccagtaccacctcggcgacctcgaggaggagaaggaaggggagctcgtcgtctgcaagatcttctaccagacgcagcctcggcagtgcagctggtcctccgaccgcggcggcggcgccgccgccaccgcatccgccgtgacgacggcggcggtgcagcaggatcagcagcgcaggagggacagcggcagcggcagctgctcgtcgacgagggaccacgaggtgtcggcgacgtcctactcgacggccgggtacgccgtcgccgccgccgtcgagatgcagcatttgaagcatgccgccgaccatttcagcttcgcgcctttcaggaagagtttcgaggaggtaattaatttaattaccacttgttacatgcatactgccacttttctgtatacatactgtatgaatctttgatcagttttcggagtaatgctggttaggttacgcatcctaatcagtttctctccaagtaaactgctggttaggttctgtgccgttttctgcatgcatcttaatcagtgcacgtcatgcagatcatgcaaattaaccatggtccatattcccatgcacgcatgcatggatatatatacactcgctcgcatggatatatactgactttctgtttttctaggtgcagattgggatacatatactttctgtttgattagatgagcttccttcaatttgttgcgtatggatgagcggtttggggcggggtagctgaccaaatgtgtaggatgcgccaatttaaagcaaaagatgagctacacatcacacagcagcatggacccttttagttcgagcctcacatcattttactcagattgcaagcaaccctaaaaccatccacgatccacccaccgtgaaagcaaaaactagtaatatatataattggcccggtctcattctttcaattattccaaccaaaaaatgtatatttcaagaaagttcaaataatatacatactactgtaacatacatactaactgaaagggagtgataaaagacaaatataatgggaacattatgcatgtatgttagttttataaaaaacattatgcatgcatgacatggaatttttccatttgtttgcatcaaacaggttggtataagtggtgatcaggtacactccaatcagcttgggaggtcggagcagcagcatgctggccaggaacaacagccgcaccggccgttgcttgcaaccacgacggcggtgcctgccacggccttcctgatcagccggccgacgaaccctgtatcaaatatagtgccaccagcaatgcagcatgcatctgtcgttcttgatcatgatcagttccacgtgccagcaatccttctccaccacgacaaatttcaggtgtgatttcatctcatcttatacattttctcctcaaataaaacatttccattatctaaaataattccctaaaattaatactaatttctctttttctagcagctgggtaatagattgggcacggtagctgttgaaaaaaaaactataggaacacatatatgcatgcatttatgaagaatattctttacatattcagaatgttaaatttaagtaaggagtaacaaaccatctccaacaaaaaacaatttcagcttgaaaacaagcaatggactcgctaggcagtacatttcatacttcccatctagacaaacttaattagtacggcttggtctaaagtccacattttcctccttcaagctaagagtttcttgctatcataggatccctttgaattctctaaaaataaactaaaaaccattctcagctttcaatttcaataaaaagaatcaaggatttgtgataatcttaagtgtcaaaattagtcatttttagttggtcatactaaacatattgggcaataatttatacaaataattgtgatatacaaaatattaaaaaaaattctagttatggcacttctaatgttgatttgtacatatgtagggtttttcaagtcgtgtaattactatttgatatgaactatgtttttttatatatataccaaggaagttgcatatggatgaaattaagctgtctgaagatgcattttctagactataaatatagagcctagacaattctggaaggattctttgtttacccatatatatatgtgtaatctggtaatgaatctgctttgtatttccaccgttcctatatatatgtatcactttaggtaaatctatatacaattgaactgtttatttcatatatatcaagatactaatgcattgtctcagctcattcttcatctctttggtgatttacttaattatattattgtagctcctttacttttttttttcgttttgctctttactaaagaatgctttagctactgttctatcccaacataattaacaacgaacatgcaacacagcagcagcagcaacaaaagcttgacaggaggtctgccggcttggaggaactgataatgggctgcacgtcttcgagcacaaaaggagtaagtttctcttgcatttttatttgattgcctcctcagcatggatccaagccgataatttaccagtcagaggctctacgcatgcagtaaagcattcctgcacatatccaattggaattaatatatatgcatgtacgtagcaattgcatgtgagacgcatgcatgtgtcccttttaaacggttttaatctgaacattagctcaggccaaatttaatataattgtagttatttatatatactgatttaaacatataatacatgggtgggaaagctgcaagctatgtcttataggcgaggtgaggggtttagaaaagaaagactgctcaggagggtcctgaggaaacttcagtgtggggcctcatagtttctttgtcgtcctagccagcactttgaaacaggcccttcaccttgacagctttttcctctcatttgtttccctatttttaaattcgccattttaggtgtgcttttacagcaagcatgccgacgagagagagagagagagaaatcttcagtactcctagtgagatagtagatagaagaaacatcatgaatatatgcaaacaaggaccaccctttgctttgcttttgagtgccaaagggggagagccaaagaccagcgtaaaaacaagaccatactttccttgctttcatgaccgtataggtgaaaacgagagctttctctccatgtcagtagcccctctcctcgcttttctgactgtatggctatagaatagttgtttactgttatctcttgcgaaaagagcaaaagaaaaggaggaaatattattcgtttcttgctctcttttgtctcttttctatgaaatgaattcacactgacaccatgcatgaggataagagaatcattattgtgaaatttgtttgcattaatcgttgtgaacttgttcttgtattacattactaaaaattaaaatcttgacatttacaaggtagtatatacatgcacgttcaggtaatatagaacaaaagtgtacttatttttgtcaaaactccattggatgattagacatgagtagtacatccgtctcaaaatataataacttttagctacgaatttaaacaagagtatgtctagattcgtagtcaataattgctatattttcgaacagatcaaggtagtaatgatatgtgtattgcatagttattcaatgagatcgttctttgacacgttggcctcattaataatatggtgcaatgcgttatattggagatcaatcattctgaccccgactatatactccgtataagtaagtgacaaaaagagttatgccttactacttttcccctcctttgttttcgcgttgaattatatgggagattaattaataaagtactgtgacaacacaactatagtactactagtctactaccgtggtatctgctatatctctcacaagagatccgaattggctaccttgatattatttaaatgaacatttctggtatcatctggagtgtaaataagagcaagtactataaaacttgctctaaggtagtccgtacttgaacagttgaaaattttgaattatttccctactgacattttaaagtgataccgtatctttcttattcaactgttgcacttcactgagctgttcttttttgacccccccttttccatattctattgcaggaagcttcaattcctcactcccaaga

SEQ ID NO: 39390 - DNA, 1073 bp, Oryza sativa
cgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttatacaattaatgtgcagtagtgcacctgtacctattggcatttcaagtttcatttacatattacggtgtatatatatagctactaaattaaatacaaattaattaacagctatttaattattgcatatcaatttaatgttatgcatatagtgtgctattttttgacaagtttgattacagttttaggctagactattttcaggaggtacatacgttttttttttaccaggggaacaattaatgagcattattagtattgttggatatatactattacattttagaaatacaaatattagtatattctaatttatcactattgcatatatagggagatctctgtgcatcgtcatactattccacagaatatattttttttgtgtgttggggggcactaacaaatatcacagtataattaacacaccctgctatttatactttaataccgtgcatgcatgttattgtcaatttatttacattaagttgcatgccctacatagaacataaggctttgtttaatttaacaaaaatgactcctttcaaaaaaaatttaacaaaaatgatgatttttggagtacttgaggattaaactgaacgaatccgaccccagcatgtacgttgcacacacatatatatggaatgaaaccaaaattgcattgttttttactgctccttccgtttcataatgtaagttattctagcatttcctatatttatattgatgttaatgaatctaaacatcaatatgtatg

SEQ ID NO: 39391 - DNA, 1597 bp, Oryza sativa
cagagctcatctttttcagataatatcttaggatgatcctgcattttgcatggacagaagtctaacaacagtggtaatcaattcgtacatagcatcattatgtcttatcgatcatggactttttgattatatatatgtgaaggaatcttatcctttggactgctaaaatattatgtccaaatatttggtgtcttggctgtatgcatctcaattatgcagaggtcagaattgttcttaggacagttgtatcatctcgatgtaatttaatgatcagttcaatgaagcttccattatctaaaaaatatacttggtgtctaaattctgaaagtttcggagatgaatatttttatcatagctctgatgcctaatctttggtatctgggactggtcaacgccatccaatattcaggtctgctgggacaagaaaccttcgccggtggaggatagcttatgtacaaaaagcacagctgttactgaatgaagctgcttcttggtcacatctttggtacctctatgtgaaaggtagtagtttcagatccacttaaatatattgttctatacaccccccttttccccttcatcagtaatgaaaattgtagatcaatattcttttaaatactgctaatgtgttaagttcatttatctgcacattttgcccttggcagtcagatctgtaaattcacctaatgcctgcattatctttgttgataggcactgactacttccaatcaagtgggtgtccatttagttgcaacaagcggcgttacggcacaattatatctgcagattgtactttagcttgagggtctgtacacaactcaaaaatatctattttgggagctctacatgaggaatatgatcagtaaaacattcgtgccattatcctatgttatgttactaagcaatgatcagatatttgacaaaaaattaagcagtgatatattaaatattcttaacaccttttgattttttttttgggtggcgatcaggtcactgcaaacaagcgcatacttaataaaatgacatcactagcttacctgtattatgcaagatcatcggtgcatgtactgccacaacatactaaattatcctctgggaattctttagttaatcttggtctccccatcagctctgataagattttgcttatttattttaattaactattaaattattataaaataattatgtaagtgtgaaaattttttttgtgttgctgatttgttttgattaaatatcttgtcctccattccttcttttactttaggggatgcacttgttatctgaatgtattcaccagaaaattgatttattagaggtagcattgactactatgaaaggcagtatatatgctttactattgttgtgagtgttcccccttctaccattgcagtaggatggtaaatgcaagaagccaaagcggaagtataaggctgtactattgggcttttcacagatcaagaggtgagtattcctggtcattaggtcactgaactacagatttgttaattttacgctcccattgtttcaagttgagtttatttattatggcccttattccggttaaatgcgagtttatataaatgcatctgtctaa

SEQ ID NO: 39392 - DNA, 4798 bp, Oryza sativa
  unsure (1)..(4798): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatattggtgatgcctggagaacaacaatggatgcctgcataccggttctgaacctcattgatatacggagatcaatcccttatggtattcaacaagtgcgagaacttcttggcatctcatgtgcttttgatcaagttgtgcaggtttgtcaccttaccctttttgtttgtaagtttgggaggtatttcatttcaaatctgctgtttgcaggtcacgctgcagatctttccaatctttttaatggattatttgaccacttgcatttacaagaacttactaaggaaaatttataaatatatgaacttagtatttcatgatagctctatggctacctctgcttcacaaactactgtgtttccgtggaaatagctgtttgacaatgttgatctaggtgtgttggggaactatctatggtttacgcgtgaatgcgataattgcatttttttttccatgtctgaccaagattttaatgttaatagagaatgttgactggtggaacattcggttttgtttttaatgggcaagtttggtccatttcaattgagttgtatttgatttctacgatgaactcttttgtacatcatgtttgtgcttatggatttgtccaatgcattttataaatttttatcttgcatctcatttcaatagattattttatatgtgctgaattgtgcagcggctttcaacaactgtaaggatggtcgctaaagatgttctcaaagatcatctggtacttgtggcaaatagcatgacatttactggaaacctgaatggatttaacaatgctggttacaaggccaccttccgttccttaaaagttcaagtacctttcacagagtccacattgattgtaagcttatctctgagatcaattggtttgttttttatcatcacatacattttattgatttggcccttttattttgtagacccctatgaaatgctttgagaaggctgcagagaaatgtcattcggattcattgggatgtgttgtttcatcatgttcttggggcaagcatgctgcaagtggtactggatcatcttttcagattctgtggaatgaaagtcaggtaagctggttttttctgcccactggagcttattgattatataagaagtggggcttcactctatttaattggggctaatctgcttaaagatctttgcacggtgtgaccaatcaaatgaattagcgttttagtgaaaaagtagctctgcttattgttgtaattgatttttttcagctgaaaagcaataaggagtatggtgatggcctgtatgattacttggcattggtgcgtactgacgaggaaaaggcaagatacacattctttgatgatgtggactaccttgcagaagagaacgaggcagatgtgtgcttatctcctgaattggatgggaccattggtcaaccgatcttcgatgataatttggaagagcaagatgttcagaataacagctcgtgggataatggcacaacaacaaatgcaagctgggaacagaatggtagtgctggaaatgattctgataaatggggaggttggaatgatgcagctgcaggagctgacacgggagtcacaaaaccagcaaaccaagggaattcgtgttgggatgtgcctgcgacagtggaaaagagttcctctgattggggaggctggggcactgaaaaggcgaaggagaaggagaaaatatctgaagagccagctcaacatgatgcttggtctgtccagggccctaaaagggcaacagatggaggagccagctggaagaagcagtctagcactcagaatgatgggaactcctggaaagagaacaagggaagaggatcaaatggaggttcctgggagaaagataatgcgcaaaagggatcatggggcaggggcaatgatgaagctgaaaataataatgatgtgcaaaacaaatcttgggagactgtggctgcagatgctcatgcttctacagagaagtcctggggcaatgttactgcatctccatcggataatgcatggagtgctgctccggtttcccaagggaatggaagttcagatacaaagcaatctgattcttgggatggctggaagtctgctggagttgacaaagcaattaacaaagacaaggaatccttgggcaatgtgcctgcatctccatcatttagtgcgtggaatgcttctccagtttcccaagggaatgaacgttcagatgcaaagcaatctgattcttgggatggctggaagtctgctggagttgacaaagcaattaacaaagacaaggaatccttgggcaatgtgcctgcatctccatcatttagtgcgtggaatgctgctccagtttcccaagggaatgaacgtttagatgcaaagcaatctgattcttgggatggctggaagtctgctggagttgatgattcagttaaagacaaggaatcctggggtaatgtgcctgcatccccatcagatagtgcgtggaatgctgctccagtttcccaagggaatgaaagttcagatgcaaagcaatctgattcttgggatggttggaagtctgctggagttgatgcttcaactaacaaagacaaggaatcctggggcaatgtgcctgcatctccatcagatagtgcatggaatgctgctccagtttcccaaggggatgatgtctggaattctgctgaagccaatgagtcacgtaataaggactggaaatcagatggatggggtgccagaggtggcaattggaggggccaaagaaacaatcctggtaggcccccaaggaaacctgatggcaggggtctgcctaggagacctgatgagagggggccaccaaggcgacactttgacctaacagctgaggaggaaaagattctaggagaaattgaacccactgtgctgagcatcagaaagattttccgtgaatcaatgtaagttacttcatgattatttgttaattttgtgtgattcatgatttacagttatatgcttttaagtttctgaatagaggaggcttggcttttatatgaaagtatgctaggtccgacatttaattgatttgtactgtcttaagctttttaactttattgttgacttaaaattttgcagtgatagcataaaactttctccggaagacgaaaaattcatcaaagagaatgttcttgaacaccaccctgagaaacaatcaaaggtgtctggtgaaatcgatcacataatggtatggttctcttgttacttttgggttgacctgttgtgcaattgcccgatacgctataatgaaatatagcattcgtttggcttatggtgtcaatggcctcatttaatttgacaggttgacaagcaccaagtgttccaggatagtcggtgcttgtttgtggtgtcttcagatggaactcggtcagatttctcctatttaaaatgcatggagaattttgtgaggaagacctaccctgagcatggggactcattctgcaagaagtatttcaagaggcgccgtgaccaaccaccagcagctgatggaggcacagcaccaggcactccagctggggctacacagtctactgcagttgatacccaggagggcacttcacagcagacccaaccagatatcgcaaccgctccagctgcaactcaacaagagactcttcaagacactccagctcctccagcagacgatggattgctcgggaagggacctagcccgtctgactgatgctcagggtgcgcttagagctgccaacatcctgcttgtgctctaatcctgccactctttttttcctacttggcctgacattgcctagtgactagacagatggtgactttgtgtagtagagaagggttagcagtctttaggtctcactcttccagacgaactctgtaaattctggatgttagtgagctgcatcccgtagcttaaactcgtttttaccctctcttttttttttatcttttttgtctttccagtatggttatttggttagtccaatgcaagccgattctgcgaggccgtgccgaatctgatgattttgttgttctgcaaggcacagagctctcgctggtgctgtttcattttggatgctgttacagggttttgtaaagacactgaaactaccatgcgaatcagcaaaagatggattccctgctgtgaacaagcaggtggccttgcatgaattcattcatcaaacatgaggtcttgctggtgacgccacaaatttggtttgatgtgtttgcactgagctggaccaatctgttcttgaaatttcttcaggttggtacagaaaataggtaatattgtattctgtcatttcattaccaagaccagtggtgtgaacaagctggaggcattgcttaaatgcatccgtcaaccgtatgattgtttcagcaaaaatcacaaattttgtttgatgtatttgcacagcaatctgttcttgagattacttcaaactggtataaagcaaataggcaatgctgtactgtcattttgggttttttcacttatcattttcgacctttcaaattgtggta

SEQ ID NO: 39393 - DNA, 5796 bp, Oryza sativa
attacttttcactcgtaaaaatccttccaaaagttagtaaggtattaacccaaacacaaccactcttaccttatcaaaatttggtaacgtcgaaaattgacattagcgaaaaaatgatttttatttatttttcattaccaggatgcatttcatccatcaacattcattaaccatatgattattttcagcaaagaccacaaaaaattgtttgatatattttgcactgaactggagcgcgccctgttcttcggatcacttcaatccggtaataacaaagcaatgctgttttctgtcatttcgttacaaaggatcagtagtatactcctaaataataggcacatccaaccgtcagatccgcatccaacggctgagatccccgccgccgcggcgtgggagtcatcacactagactagtacactaggctagccgcctcgaccgaacccctccactctcttccgcctccgcctccgcctcgccgccgccgccgccgacgacgacctccacctctccacgccgccgtctgcgatgcaggcccgcgtcgtcgtcttccccgtcaagggaagggcctggtgcttcgccagcccgcgcgccaccgcgcccgccgccgcttgcgggggcggcgatgggggcgccctactacccccaccgccgccaaccgtcaaggacctctggcgcggcatcgccggcgggggccgcacggcgtcggagaacgcggaggccgtcgtcgacttcgtcgcggacaaggtgctcgactcgacggggagcgccttctcgtctctcgccttaactgcattctcgcatgccgcccgcatttggggggtttctgatggtggggttttggctgccgcagatgaaccgggcgtggatcgggttcgggagcgcgccggaggggtcgatgaagaaccggatccacaggtcgggagtgtaagggtttggggattgcttagtggcgggtggcgcctgtggagtcggaaatggcgagatgctgagtcgttgggtgtgctcccctttttttttgctttgttgtggtgtagcttcgggctgaagctgctctcgcgggtgcggccgtcggaggtgctgctcaagtcggtgaccaaggacgtctccctactcgagatcgtgcatccggcaaggtgagctctgcttatgagtttggtgtttgtgtttgataaaatgtgcgtgcaatttgtgtcgtttcacctttgttgttattcttagtttgattgtcgaatcgattgggatattcaactatttgggtccttgttgtgatgaatatttcctaaggctctgagcctctgtgcaggaaatcatacagtatctgtcgttagtggcttagcttacttgcaatagcaatttatcattaacggatacacattgtcgccaatgaatggaactattagaatgtctgagcagatactaatttagatatacaagtttcagtatgcttcatgtagcgatacatgggttatatctgatcaagtttgagcattgactctgacatctctatcattccgttccaatacacaattcacaccagctttctctgttcatagctgttattcaagaactttgttgggacaaagtagttgaaagtccttctattctaagggcctgtttggcacagctccagctccacctctcctggagctggagctcagccaaacagtttcagctccacctgaaatgggagcggagctgggtggagcgctctcacaaaatgaactagagaggtggagctgggtccattccagacccaactcctggagctaaatttaagagttggagctctaccaaacagggcctaagaaattgcatgatttgcgtattgtaagtctgctgtaaaaatgtatgtcttaattcttcacagcttgtagctgcttgttttttgaacctctgtgcgtgctccgtaactgtaaaatggtagattctgtgtcagtgcctgttgttgcacagaagaagctctaaaagacttgttcacacgaactattcttttactggcttcgtaagttacttggaaagcctcatgcatatgcttgtttttgtatagaagttagctattgagctttatgaatcgctctggcactatcaagcatcaccagacagagttggtcggcaattttcttactcatgtcttattttatgtctattcaagattatttctgaatcctagctttaattgcagtataaatcctcgtcttgtgcgtcgacggttgcggcatattgctgtcaggtgagtgtttgatggacctgctccaacaatttgttactgtatagctcaatttatatctttcctcacccttctgtttctgcaatgtttctgagaaccaggggtgcatcagttcacaggaaatttctttatggctcagtttgtttgcttccagttacaagtgttttcatggtaagtctatattcatttgctttggaaaaaatggtgttggctagcaatttgcaacagtgatttcagtgggatcagtttgttgtactttgaagggattttttttttcattttgcgatgctatcaattattgaccaaactaaaaagattattagatctttatttttgcttgctgcctttgctagattgcgcacaatattagttgaggcttgtgtttggtctacttttcaacttagtacatcaaattaagaaaaatatgatgagctcatttacacattaaagataagggatttttacatatgtgggaggtataatttacacttctgattcagttaatgagccatacaatataattataattttgtgagattgtgctccagtgatgtctagtttataacctagcacacattacttgaatcctgatgacccggtaggttcttatgttttaatcattaaccagagtatcataatctacttgatcaaaggatgtgattgtatgttgccttcttgtgttgttgtactttaccccataggattcatagcagaaaaaagattgtgaaatagagtatacatgttggtatgaaaacttctaatgcgtgcaatccgtacttaactcactatgctatggtgagatgacattcattcttatacacctacttattcatttgcaggtactgcctttgccaaacataccatttttctgggtgctgtttcgtgcttattctcattggagagctctgcaggtttgttagatggcccagttattatagagttttcagctcttggatttttttttgttcaaactcctctctgtcgtggtgtggcgtttgctaaggtatgtttgatacttactttgacatagggaagtgagaggctccagttgttagtttctgacagctcagatcaatggaaaatccttcttgagaagcagaaagagatgagttccagaaaggatggcaacccttgtgaaaacactcaatatgctccttgggtaagttgtctcaattcaaaatgagttaaaccttcagattgttgtattttgagggaagttttggaccgagacatttatggacctccggagtcatcatcttgattattttctgttaattcaactagagttgtagatcggacatactacatcagttctagatcagatacttgaagagttgaggtagttaatctgtgttactatcacatacctactgcctctagtatgcaaatgtacccgaaggcaatgaacaaccttttctgacatgtggccgcatgggataatgcacaaacaagttaagccaggatatgccaattaaaagaatttatctacttgcacagttgcatatatgctggcttgttttacccgctaggcacagtttgtttgaccttgaggtttatgacatgtcagtgtacccttgcataactgcatgcattgtatgcccaacctgcacatacacatgggtggccacgactatggatggatttatttgtagttattgattatttaatagttactccatttgcatacaactggtgagcactttctggaatgcctgacttcatgttgcaatcattaagcaatcattgaagccagctattataatatatctttatatggtttttatataatataactttttatacatctgatgaatgatgggcacattgaagcttgcctgacttatatacaacaatgattaggctgtctgtgcagccagttatgcatctatgtgtaatctcaattcggaggatctgtacattgtggctcacagaaaaaggttgccagttacttcacaactccaactagtcaccttaacaatttttgccacaacatgttgtaatttgctgttggaatctgaatctgatattgtttttactgcaacataacttgagatcctctacctcacgggatttatatatgtccacaacattttatgaaggagctactatggaggaaatgggggaggggagttccattatttgtatcatataagatgatcttgtttgtaatatgtgttcctctcatacatggtcctttcattagttaggtgaaaatagtggttgttgggggtgttaggcaatagtggcttgtgactctagcctactgataattccttctagattgttaggctttgacagtatatatatcatatcatatttactgtatgtgcagtttgttttttttttgaaaaaagaaatacttattgtgttatttcttcaatagaatttgcagccttcgaagaagcttgatgggttccttgagagcagaaaattgaatgaaggattggattgtgataccatttcgaggatttgtcaggcatatgatttggacaagattgatgttctgaagtacagggatttggagtaaccacatccagtttcttggctgccgtggtgatttttttgccagctaatgtttgtgtggtagaaatgaattccgtcgtggagaactagctgaactgctgaagggtacacgagtgacacgagacttccaaaattagtgactaatgcagattttttttttttgcaagggatttggagtagtagcattacaattcacaagttttgttgttcctcagtctgctgctggtttacaaggcagaaaaacagacaggacctaaaactgtagtgcccatggtgacatctaattctgtacccaccatgtaaatagaggtggaggcatcctttccccactagcattttctttggtttcagcaccactcagtagtcagtactctgtaaggagatttgcttcaatggattttgcagctgctataacttctgaagtcaaaagttgtgactggattttgcagctaactatgaggccaaaagttgtgattggctaatattttttttttgggttgtttagggtgcaatcagaatcaatcattgggtagatctgcatccaattttggttccaaagcagaatctcctctctgcaaagtaccaccggtaaagatttggtctttctgaggtgcttccagtgaaagttcatagtttctggattaggactaacctttgtatgttttgactgatccactcatctacctctttgattgccattggattatcttgatagccggcggtcaaattaacttttagaaaaacttgagaggatggcatgaaagcaccacaaatccatggcattctgcatgattgaaaaccatctcctaattaggtgtggttatgctgctaggattggagcgaaataataaatatcagaactgggtccaataagccgttttccttcaagcttatccatagtagtagtagaagtactagttgtacctctcgatagtgacgttgctgtggcaatgtttaaacaacgcaaaaatgtgaccgattgggcgattgggattgcccacaaagtgacatgccaacttgttgctctcttaactcttttaccggtc

SEQ ID NO: 39394 - DNA, 10127 bp, Oryza sativa
cctcagacagtccaattagagggtgtttgcaattagagggttgcaaacaccctctaattggatgcctgaccaaagcgaccggtaaaagagttctcacagcaacaagttggcatttttgtgagagggactaaagtttagctccactttagtccctccaaccaaacaccaccttactccccggtcccggatcacgattccaaaccctaacgcacgcttcctcttttgattatgcttgttcggctgttgctgatgctgattctaaattttaaaggtttaattttacatagatttctttgcttgcctccttaacagtaattaaaatagagctatatgtagtgaaagcgatgaacgctgagattataaacttgaagctgaacactgagactactagatgtctagatccccctccccctttgacaagttccatgctggagtattcttttcaacttattgacatgtgtgtaactgtcaacttgattaagatacagatttttttcctcgacttttattagcacatttttcaaactgctaaataaatgtatttagtgcagaaacttcctatgtagaaattgttttaaaatataagataaacctatttagtttataataattacaacttaattaatctcacattaagggctttcttattttacgtattatcacttaatttttatcttcattacattcaaacgggacctctgtgccatggttctcgaattacaattctttaagaacttgaagcactttctatatcaccatttattagacagcttgttcgaaacttttttataacatgctgacggagcttggggctcctcaccgggagaccgcgcaggcccccctttgccggttcggccgggggcgctaagtgaggttcttcgccctcgatctgaggaacgtccgcgagagagggagtgcacaagacacgggcgacgtagacaggttcgggccgctgagaagcgtaacaccctactcctgtgttttggtggatctgtgtgtgaaggaatacagagagccggagagcgagagatagttcaggctctagaatcccctcgccagagtcccaacccccctcttcctaggcctgggcctcctttttatctggtcaggggtcaccacatggggctctagctgcctaagaagggaaacatgctttttacaaagagggctagtctacagccggaagtgacctttgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggtagctctcatcattccgacgggacggggcgaggcgtgtgacaggccgcctgttgccacctaacccgcgatctgaccggtctgtgaccggtcacacaccgcgaccggtcacggaccggataagcgctcgctgcgccgcattaaatgcggcgtggcgcgctcgtccaacctgctataaatgcggttaggtgagcccgctgtgcttacctaacccacacacgtggcgccaaaaccacagggggtcggggcgccccagccctcggggccgaaacgggagcggcccgacccctcggggagacagagggaggggtggccacgtcaccctcaggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacgataatgagcggcctctttaagaccgctacattactcgagcagcgcgcgaatcgggacgagccggttcgtttcgcctggggacatgatgatggcgcttttcacggttggcgggcgtagttaatgcgcgcacgatctgccccatctcaaccgccacggccgcacatttgccacgtgcgccgcaaacgggcgagtgggtttagtggaggcgtgtgcgcgagaaacgagggggcgaggtagtgggcgcgggaagcgaggagccgggcatagcgttggcaagggtgtaaagacgccgaggaagggatttgtttctttcctctcgccactcttccccttgccttcgccacttgtgccctaactcttcgtttcctgtgccctacccttgccgcactcgctcgctctcaagctcctcctccgccgacgtcatggcacggggctccgcaccgctcgacggtagcgtgctgccgccttcccgcatcgtgagcgagaggcaggccgggctgccgcgccgattcatgccggaatctgccaccggccgggaggtggtcgcgttgggcgagggacgcccggcgccacagtacccggggcggtccgtcttcttcctctttttcgcaatggcggggctggtcccgccattctctatttttttcatggatattctggagttttatgatctccagatggcgcacctcacccccaccgcgataatgacgttggccatcttcgcacacctgtgcgagatgtttattggggtgcgcctatctctccggttgttccggtggttcttcaccgtacagccggtgtcgccgccgacggtagtcggtggctgctacttccagccgcgggggcaggtgctgaaccgctacattccctgcgtcctccacaaaaagtgggacgactggaagagcgattggttctacacccccctcgccgacgaagcgcgcctccgacttccgagccagcccccggcgcaggcctccagctggcgggcggtggtagatctgggagacggctacgacgccattcttgaccgcctggcgggtctgtgatccctggggctcacgggggccatggtgctcggcgactaccttcgtcgccggatcgcgccgctccagcggcgcgcccggggcgcctgggagtacaccgggcccgaggactacatgaggacccaccaggggtgcaaatgggactgggaccctgaggacttcaggatggtggtccaacgggtgctgaatctcagctccgtggaggcatccctcatcccccaaggggtcctccccctctgctgcgatccagagcgcgccaagatcctgaccatcatgcaggtggtcggggcgtcgggggagcgggccccccggggccacgatggcgcgggcgggagccgcaggggggaacaatctaccccgggagggggtcgtgcttttgggccccgcgacgggggcccggggagcagccgccctgccgacgcccgggggaagaggaagcaggagggaacccctcccccatctcctccccgagggggcggggcggtgcgtgctagcagcaggcgcccggagggtgccgtgccgatgccgcagcccgagggggagcgaaagaagaaacggctccccaagatgggggggatcgcgccatgacgggggaacctcatctcgcccccgaggtggtcgtttagccgaccttcccgcaggttcgtccccgcgcccaccgcggccgtattcattctcccatctcccaaggcgagttttcactcacccgcttctttttgtcttctggtttttcttctgcctcagcgagatcccgtcgcccccccccccccccccccgccattccaagtccggccggtctgaggccgaggagacggcgaccgcggaggtccgaaggcgggaagctgaccggcgagaagccgcggaccgcctccgggaagccgaggaggctgcccaggaggccgtccgtgttcgccaggctgaggaggccgctcgggaggaggccagactccgctgggccgtggagtccgtccgggaggcagaggcggcgcgcgcacgccaggcggcctgccaaacccccgacccgactccgcccgaggcgacgccgacttccgaggccacccacgacgaggccgcgggcgcgccactcgggcccgacccctcgggcgacgtttgggacgagccagcttcgggagacgcccccgagtccggcacgtcgatcggcgggccgagccgcgcggcacccacaccgaggcggctctcccctctgccttccgctgccccactgagcgcggagcccctcctgcaggccttggccgccgcgaacagcacagtgctggacgggttaagtgcccagatggaggccctgtaggcggagcaggcggagctcgacgcggcgtgggcgcgcgtcgaggaggggcggcgctcggtggaggccatggtggaggcgggccgcaaggcacaccgccggcacgcctcacagatcgaggcccgtcgtagggacctggcggagatcgccagggaggtggaggaggagcgggagactgccctcatcgccaccgccgtgctcgacgaggcgcgggacgacctccgcctccaatacgggagccaggcggcggagctagaggagaagctcgacgccgccgctgcccgagaacggcgggcggcggagaacgaggcggcgtcccggcagcgcgaagaggcccttgaggctcgcgccacggcgctggaggagcgcgcccgcgccctgaacgcgaaggagagagacctggcggaccgcgaggccgccgtcgccacccgggaggcaacactggcggcgcacgaggccgcctgcgccgaaaaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcccacgccgagagggccgcactggatcagcgggccgctgagctcgaggcgcgggcgaaggagctagacgcgagggcgcacagtggcggggcggccgcgggccacggcgacctagccgcccgcctcgcagccgccgaacacaccatcgccgagctgcagggcgcgctggactcgtccgccggggaggtcgaggccctcctcttggcgagcgaagtagggcccggcatgcttcgggacgccgtctcccgtctagaccgtgccgggtggcaggcgggcctctggggcgggcggtacgcgaagtacgccgccaaccaggagggcctcgcctagcgcctctcagagatggccggggccctccagcggctcctcgaggagctcgaggagacgatcaagtcatcctcgagggacctcgcccgggggggggggggcggtggagctcgtactggcgagctaccaggccagggaccctgacttctccccgtgggcagcgctggaagagttccctcccggaaccgaggatggcgcgcgcgcgcaggtccgggacgccgccgaccacatcgtccacagcttcaagggtacggcccctcggctcgcgttcgcgctcgactccgacgaggagggcggtgacgatggtgcggacgacagcgacgacgaggccgacgacccgggcgcgtcggagtgagcccccaggcccccgccaatcttaataacttttgcttcttcttccgaggccttcgggccccctccttgtatagactgatttgatctgtaatcaagtaaagaggaaatttctgcgtcagttctgtttgttgtgtgtatgagacgaggatggtctgtgccgcggtccttctatgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattccccccggagttcaccatgccccggggcacggctcggttatgggccccgtttggcgattttagccgacccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtgagtatatgcatgtggtagcccccggccaaccctgcacgcccgggggggtgcggggttggcccgagcctgagacatgacacccgacccccactaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacccggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcctctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcgtcgttaagagccgtcagccaatagaaaccctgacgaaaggccttgccaaccaaggtgcgtgaggcggagtaggctccgcactcgccttcatggacatcggcgagaagctcgacgccttgttcccgaggaatgcacttcaggaggactccgtcagccgcgcgccgatagagggtcccttccaccagcacgtagcgcttggagatgcgccggacgcgttcactcccttcgcggtcctcgggtagagtcttatctgcgaggtacgcctagatctcagtgatccaagcaatcaatctaggggagctgggagcgctcccctcgggtcccgaggcctggactccgacgggcctcgggggccgttcaggcgcgtccgtcccccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcactggtactccttacagacctggttaatgactaactgggagtcgcctaacaccaggaggcggcggatccccagtccagctgccactctgagtcccgcaaggagtccctcgtactctgccatattgttggtcgcccgaaaatcgaggcggaccaggtatctgaggacgtctccgctcggcgaggtcaacgtgacccccgcaccggcgccctgaagagacagggagccgtcgaactgcatcacccagtagacggtgtgaggccgctgcgaggggcccgaactagcctcgggggcggagacgggctcgggagctggggtccactccgccacaaagtcagcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcgctaacgaagtagacgggccgctgcacctttcggcggggccgatcctcttcgccaggggccgcatctctagggcgctcttcgtccgagaggccacgcggggcgcactcggcttttgtgccgacgacctcggggtcagagggtgacaggcgcggccttcccgcagtggccccgaggccattctgggggtcgggggcacctggcaccgtcggacaagcaggcggagggccagctccggccgtcgggggcctcgggccgccgttcggttcgggggcctctcctccctgctctctcccgggtcgagtcgacacagggtggggacgcgcggagtgagggttgtcctcgtcgcgctccacgaccaacgccgcgctgaccacctgcggggttgccgccaggtagagtagcaacggctcatctggctccggggcgaccaggactgggggagaactgaggtacgctttcaactgagtgaagacccgctcagcctcctccgtccaggtaaacggcccggagcgtttgaggagcttaaataggggtagcgccttctctcccagcctcgatatgaaccgacttagggcggccacgcagccggtgacgcactgcacatccctaagcttgctgggggggcgcatccgctctatagctcgtatcttctcggggttggcctcgatgccgcgggggaaaggatgttgagggctgcacccccgtctatgaggacacgccccaacctcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcagcggtggccttctgcttggcctcacctcgccggttgccggcgggagccgccggggtcttgccctcacggcgctcctgcctcttctcctcctcccacttcctcgtccgctcagccaaacttttgaccgcgcggcagtccgcgaggtcatggagggcggtgttgtgcacggtacaccacttgccagtcgggcgctccctgccgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgacgtcctgaccgagcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgcccccctgaacgcgtagatcaccgcgtgtgcggggatgcacggtatggtgttgcggacttgacagaaccgctgaatgtacaagcgaagagactcatcgtcccttcgctgtaccgcatgcaagtccgcttcttcgcctgggcacagatatgtgccctggaagttcgtggtgaactgctggcacaaatcctcccaagagtggaccgacgcgggtggcaagttcattagccaaccccgcgcctgacccttcagggtcatggggaagaaattcgccat

SEQ ID NO: 39395 - DNA, 30270 bp, Oryza sativa
tatttttcggtgatggtgggccggaaccttgggggccaacggacgttccgaaggctcgccacaaaggctcgatagccggcaccgccaaccggggacacgggggccggcccccgtgcccggaccgaagtggcgctccggacgaggaagcgccctccgttgcgtgggcggcgcgacgagcgtcgcgccggcgctcgatatcgaggcgggcatccggccccccacgcacatcttcttgggtcggaggcgttgacgagggaatggcggacgaacggcgggtaacggccgccgctcgccgcgccctccgcctcgacgacatggagccggcggcggcagcgccagaggcctcggtggcggaggaccgcccgccggcgcctaggcgttgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgagtggcgaagtcgcggaacctccgaccttcctgagcgcctccccccgcccaagatttcggcgagagggggatggtggggtgcgagcccgacggcgcgggttctgctccccgtcgtcaccgctagcgttcggagagaggctgtgcgccactgcccgttcggccattgggctgagcgggcgaagcttggcgcacacgaaagaggacgagggcttcgaaagacacgcgcgccccctacctggcgcgccagatgacggagcttggggctcctcaccgggagaccgcgcaggcccccctttgccggttcggccgggggcgctaagtgaggttcttcgccctcgatctgaggaacgtccgcgagagagggagtgcacaagacacgggcgacgtagacaggttcgggccgctgagaagcgtaacaccctactcctgtgttctggtggatctgtgtgtgaaggaatacagagagccggagagcgagagagagttcaggctctagaaccccctcgccagagtcccaacccccctcttcctaggcctgggcctcctttttatctggtcaggggtcaccacatggggctctagctgcctaagaagggaaacatgctttttacaaagagggctagtctacagccggaagtgacctctgacaagcagagcacacgcctcctgcctcgctcgcccgcttttccggtggacgcccatttcaaccttcatttaatggccagcgacttccttgccatacttgcgctgaagtctggaatggatctgactaggactgacataccaactccaggagttagcacgccggctccggctagggacgagagccaggtagctctcatcattccgatgggacggggcgaggcgtgtgacaggccgcctgttgccacctaacccgcgatctgaccggtctgtcaccgcgaccggtcacggaccggataagcgctcgctgcgccgcattaaatgcggcgtggcgcgctcgtccaacctgctataaatgcggttaggtgagcccgctgtgcttacctaacccacatacgtggcgccaaaaccacagggggtcagggcgccccagccctcggggccgaaacgggagcggcccgacccctcggggagacagagggaggggtggccacgtcaccctcgggcccgacccccccagggggtcaggccacgtgggtgaccgcggctacccaagcctctagtcacgatacccccggccccatatcaccgacacatgctatacaacatttaattcatctctacaattaactatccataaaccataatccgtcgaatcctccattaaaaaaaaaccacacgctttagacccgatgctctcatgtcatcacttgtggtatatgtccgtgttactatatccatcagctagttgcgcaaaaacatatataccggatgagatactcctttccaaaagggcagagctttttgctcactctctctcctctctctctctctctcttccctgtgtgcttttctgttcggatcatatcccaacagaaaacgacgctgccaagtgccaacccaagtagggagatattaaaccaacatattttatataatagattatctataaggctggctataattttcttctcctatccatatctctcacttataaattaattgtatttgtcttggaacttgtgataagctagctcttgcataagagccaacatctttgatttttcattacctctctcctccacataagtttatagtaagcttatagctcactattatacttgctctaactaaagccactgacatgtgagaccgataatcgctggacccatatatcagtaacaaaagacacggtgtagtaaaatatcgaccgatattaaagctttgccatggcatactggcgaaatgggcccatccatgccgtgccatgcatgctacagggcacccccaacctgactttccccctgtcacgtaccctgtacgtacttgcctgcaccatgtacgtaccaccatgtgatactctctacgtacgcatgtgtttaaatccagagtttggatctaaacttcagtccattaccatcacatcaacctgtcatatacacaacttttcagtcacatcatctctaattttaaccaaaattcaaattttgcggtgaactaaacacagccgtactacactggaccgccctatagcatcaatgcctgcaaagtactctactagcgctgtggtattatacatcactgtgttttgtgttgtgcagtagacatgtttgtccatacttccttttatgttctgaggaaaatatactctcgtcgttgtagaaagttgttttgggttcgtgataagttacatttcttcaagtttgactaatttttatataaaatataataacgtttacaatgttagattggtttagttatatctatcatttgtatgtatttttatgagtaaagtatacagactgttcttaaacttatagggtgtgtcattttggttcctaaactctcaaaatacatatccaaagtcccaaaacttatcaaaatatgttatttaggtctcaaatcgccacaacctcttcagaattttacgtggggctccccacatggatgtggcgtggtatcatcttgactgaaaaataggacccacttattttttttcttttttcttcttttccttttccttctcttttttttccttttctgttcctttctctgtgacctgagtaccccatgcggcggtagcctatttttagtgagaggaaggagaagaaatgaaaaaaataagagaaggagaagaaaaataattttttttaagtaggtcccatttttaagtcaagattatgctacatcacattcgtgtggtatgccatatcagcgccatgtagaattctagacctatatgacactttaacaagttttgagatctagatttacatttaagagattggggacctagatgacactctaaggactgctcatgcactttactctatttttctagaaatgtcggcaccttctttgtgatcctggtcgaatttgaggagtttttggcttaaaacaaatccaaaacgacttataaacttgacaagtttagatatttgttacaaacgacttatattaacgacaaatctagacaatcttttatctaaaacctaagctctaaccatttgcccagattagttatattagagcaagtttaatagtatagcccactactagctccaatttatctatagccaatctaatagctaattcatacaatagttgtttactatactattaatatatggtctcacctgtcatacacatactgtgtcttggagtccgtgctacagctggctacagatctgtagactgcttctcttatctctcatcttttatctcattaaaatatgtttatagctgactaatagtctgctattgtacctgcttttaggaggggttatatttggttgagtatttttcgggacggatggagtacactgcaatatagctgtagaatattcataaaattttctctaaaaaatactcctcgtgaaatgattgttcattagtcttaagtatactcctaggtcaaaaaaaattgccaagtgaggtcttaataaaagaaagggagaaaggcgtttgcactgcatgcagcaactgcagcagtagtggtagttaattaattaattaattaataatggcgatcgacagctcagctcggaagacgatgcccacccctctctccgaggccgaggccgcacgaatcttgaagcgcctagccgttcgccgcgcgtgccgcgggcggcggaggcggtggccacgtaagcgcccgccccacgcatgcagccgtcggattccgattccttttgccgcttttcccgtctgcccccctcgttctccgtcgcctttaaacctagagtaatcaatcaattgatttattggtaattcacgattaattaattgttttctttctccatcaaccccaattaggttataaattatgcttatataccctaatgtataaagtattcttttattctagtactttatactagcactattactccatactattgtactccctccattccaaattgactacatatagttttttttaaggttattcctaaatgatctacatatttgtgcttatttattaagtctattcgttacttgtgcattggagtaaatagacattgatgcatgcatccatgcacacaagtatttataacacacatgcaatatcttgatttgctattggctaggaaatagtggggatggtgtttgagtttgtttctagaataaatatagtatgagagagttattagcttttcttggtcttggtgtacctatgaaatatgtagatcaatttgaaatggagggagtactatagtagatgtagatccactggattatgatttgtgaggaagattatgacggtgtgtatagtatagtattggtgttagctgaatgcaccctttacaaaatggcatattgtttgtttcggtcttagatacatgtcattttaattatcaatgtcatctgccaaatacaattcttttcatgtgttttattttactataatcacactacaggcatatttgtgacaaaaaaaagaatgggaattatgtggtagtatgtatcactttatcatgtatatgtatgtcgaggagcttagctaagcgaagactacatttaatattgattagcggatctaattacacacaaacggttggttcaactaaccctacaacttgttacgtgcgatcctataagcctttgtttatattgtacgtaaactatacaaaaatgacctaaaaataactcaattgaaatatgaatcaacgcgacaaaaatctacaagatgtttggtacagttgaactccagctgtgtgacacttacaactacaataccaagagatcgaaatatacaactttggttgtacagcgctaccggctatacccatagcccaaccacatgtcagacctcatccaaccctagatccaccgcaactcgatattatcacacttctcaacctactcttattatcatactacaagcttgttagcttggttacaatgtatgctaatttgaagctctgaactatgaacacgaactataccactattactattttgcccaacaaaccccaagtagagccgcctaaccaacaaccaacctcgttgaccgctagagccgctaatcactctggagtcgggacccatcaccgaatacgcgagaacccgaggaccaaaccgcaaaagcctcacctcaccctaggctttgatatgcgtgcggacgcctaaggctaggagttaacctcgcgtagagagagagagagagagagagagataactagcagagcactcgcggaggcgaggagagagagagagagagagagaggttggaagaggaggggagagtccacgtgagtgagaggaggaggaggaggaggagatccctctcccgcgcgcatccgcccctctcgccgatccccaattcgccatggatccaccctacgcaggtcggtcagcgccgcccccgcatccgcggttttcgccttgttttttttttttgttgttgttgttgcgtgtgtgtggtggtggtgatggctcaggtctcgcggcggcgtcggggggagctcgatctgtttgttccggcgacgaatccgctgttccggcggtgtaattgcgggcttggtggtggaggaggaggaatttgtgggcgtggattttagggtgggaggcggtttttttttttttggggggggggtggtgtagtgttcgtcgagatttagactttttgtgtggatggatggatgggttagattatgcgcgcgtggattagattgcggcggtagagggtttgtactgttcattgattggtttgttgggttgatttggagctgtagctgatgcgtggtagaggggtggaggtggaagcgcgttggggagggtggatggcgatgccgctggtgtcagattcgccgctgcatgcggtgatgggtactcacattgcgccccctctctaccgggggaggtggcagcggagtggttcctgcggctttacgtcgttttcgtgggatttacgtccgcgggcgttggtagcagcagcctatcctcttttgggacgggaaaataatatggcgttaggctgtttgaggcctcctgttcgtgcgttgggtgttgcattggtgctgatttggtgggatcacggctgccgaaggcgggtttgtttgctgttagttgatggtaaggattggctgatacgtcgattatatcttctagaggagctgcgtctacttgcatgtcaaggttaccacgtttaggggttatatgattgatgatagtttctttgtttagtggtccaaaattagaaagactcatttctttttagttttctcgtttcccttagacagtctgtagagagttgactttctgcggctcgtgccagcttcgatagctctagttaacattgcgccttgtggtatcacaactgtgctttgtagttcacatttagtcctatacaatatggtacatgttgatgagcctttaattcttagattattgaccgaatcatcttttttttccgaggttaagacttattctgttgcaatgtgctataattataatttgacttctactccagtaagacagtgtgctactcacattaatttgattcagcatgtcgagaatttaatttcctttggaacgtcattcattgagtttttccttgcacgctaagttactcagtaccgtctcatagttgttctgaagaagagaaagaatgatgccttcaaaatatgtattcttctactggatctaatgaactttaaacctttccattctggactgtaaatatgaatgaacgtctaaatttccttcgttgtttgcttcttgtccgactggattttgtaactatttctgactttatcaaattgataataatagtttccagtgttctcttgtttaggagtacctattgatcctgctaaatgccgattgatgagtgtggatgaaaagcgggaacttgtccgtgaattatcgaagcggccagaaagtgctcctgacaaactgcagtcttggagtcgccgtgaaattgtagagattctttgtgctgatttaggaagggaaaggaagtacactggattatcgaagcagagaatgttggaatatctcttcagagttgtgactggcaaatcatctggtggtggcgttgtggagcatgtgcaagagaaggagcctacccctgaacccaacacagccaaccatcagtcccctgcgaaacggcagcgaaagagtgacaacccatcacgactaccaattgttgcaagcagtccaactacagaaatacccaggccagcaagtaatgctcgcttctgccacaatttagcttgcagagcgactcttaatccagaagataaattttgcagacgctgttcatgctgtatttgtttcaagtacgatgacaataaggatcctagcctctggttattctgtagttcagatcaacccttgcagaaagattcttgtgtattttcgtgccatcttgaatgtgctcttaaggatggaagaactggcatcatgcagagtgggcagtgcaagaaacttgatggtggttattactgcactcgctgtcggaaacagaatgatctgcttgggtattctccctaaacaactttattatttgcacagttttttttcctgttctgtaactatacgaaattatgttttaattattcctatgcctccagtttttactgccttaagtaatgttaccattatttattgcaacgataactactagaaatatgttagtttgacttttgtgagagttagctttgataatttgcatgcattcttgctttccagccactttgattaccttactgattctgtttttaggattcttcggtgaagatccttgtagtgtcatcatcattggtccaatcatatgatgcatatttctcaattgtgtcttaagaagtgggttggctgcttttgcccttcagcttcatgctttgagcttgtggtctgtgtgcttacttctgcattaagctgaattagtgttggattcttccttctccatctggagtaaatttgtttgctgggataaccctattttcataggttgcgagctgcgaaaacaggctttcgactgcattttggtgtctttgtgttgcattccatagggttcttgtagttcaagtttcagggtatgaaccaagttactaagccagtaaaacttggtgaggcactgaggccaggtggattcaatattttcaaggatgaatagatcatggagaaatgcttagactagtatatgcaaggagtctctaatttgtctgtgcatgtttataagccatttgagtaacctgggaaataggattcattttgaagttttgaactacaagacaagtgattaattgtctttctcaaaagaatctgcttggctattagtatcttgtagtagtaagttttgaaccagttatatgttatttagagttcaagattctttggccagtccagcacaatgcacttaagtaattcaatcaagtttactggcccattttccaaaactatgctcctttcaagagtttggatattgaaacagtaaattagcttgccgagcaatacttgactgtttaatgccttgttcaggtcctggaagaaacaactggtgatagctaaagatgctcgccggttggatgtattgtgtcatcggatttttttgagtcataagattcttgtctccacggagaagtacttggttttgcatgaaattgttgacacagcgatgaagaaactggaggctgaggttggtcctatatctggagttgcaaatatgggtcgtggaattgtgagccggcttgctgttggtgctgaagttcagaaactttgtgctcgagcaatagaaaccatggagtctctgttttgtggatctccttctaacttgcaatttcaacgtaagtttccacgtgcttcacgttagaccacatacatacaaatagtgttgaattctcatgcatatgtgcattttcaggttcacggatgataccatcaaacttcgtaaagtttgaagctataacccaaacatctgtcactgtagttttggatttgggtcctatacttgctcaagatgtaacatgctttaatgtatggcacagagtggcagccacaggctcgttctcatcaagtccaactggcatcatacttgcaccattaaaaacgttagtggtcactcaacttgtgccagctacaagctatatattcaaggtagttgccttcagtaactacaaggagtttggatcgtgggaagccaaaatgaagacaagctgtcagaaggaagttgatctgaagggtttgatgccaggtgggtctgggctagaccaaaacaatgggagcccaaaggcaaacagtggtggtcagtctgatccttcttcagaaggtgtggactcaaataataacactgcggtgtatgctgatctcaataaatcaccagaaagtgattttgaatattgtgaaaatcctgagatacttgattcagacaaagcaagtcatcaccccaatgaacctacaaacaactcacagagtatgccgatggtcgtagctagggttacggaggtatctggattggaggaagctcctggactctcagcatcagctttggacgaggagcccaattcagcagttcaaacacaattacttagagaatcctcaaattcaatggagcagaaccagagaagcgaagttcctggatcacaggatgcatcaaatgctcctgctggaaagaggtggtgattgttccacctcgatattctggctctattccaccaactgcacctagatatatggaaaatggtaaggatatcagtgggaggagcttgaaagcaaaacctggtgataacatccttcaaaatggctcttccaagcctgaaagggaaccagggaattcttcaaataaaagaacatcaggtaaatgtgaggaaatcggccacaaggatggatgcccagaagcatcttatgagtactgtgttaaggtggtcaggtggctggaatgtgagggttacattgagaccaacttcagagtgaagtttctgacttggtatagccttcgtgctacccctcatgacaggaagatagtcagcgtctacgtaaacactcttattgatgatcctgttagcctttctggccagcttgctgacactttctctgaggccatctacagcaaaaggccaccttctgttcgctccggtttctgcatggaactttggcattaaagagaggggagctcgtaccgttctctttgtaggggagcatattttggtcccattctttcgtagcagatcgttgcattgattcttcattggaaatttcattgaagcggttaacttatacaatctgttcattgctctactttatttgctatgacagtaggtttaatttatccagcaacttatttctgttttttcacttaggagtccatagtttacagttctgttatccgtaccgccatgttggtacagagcatcaagagctgtgctcttttggtcagctttaggaacattctgaaattgccacaagtgtgtgggtacctgaagctctgttgctagctgctgtgagagggagggatgattctcaggatgtaccgggaaacattgggatgaagcaggcttcgtgtcgacactgacgaatccgagctaaccatgccttgtcaggataaatgatgatgtggtgctgtatctggggttgaaagaaatgcaaatgtgctgctgacttctatggggaatgggaggagtcctgatgtttttccttttcttaagacaatagatgcaaaatgtctgcactaatgttatgttcggtttagacccttgcttttactgtctcctactgcactttcttgccttctagttctaccgtttgagaagttaaatttatgtgcacatgcaaaaaggtttggaccttggatcctgctgcaggtttcacttgtgtacctggtgtatgatgtttgatactatttgtcttgcatttctgtagaagtacggtacggtgtatgattgattgtctggctcggcagacggcagttggtcatggggtcagcagaaagccatgtgcagatcaggttggtcgatactcccgtgacccattgttttctcgatttgtgaagagagttgatgggaaggaacaagtaaacttctgaagcaactcatgatcataagatggtcatcattgtgcacatgatactcatagcaacaccagttcatcacatcgctcaaagattagatgttgaagttgaactggaagaagaggtacatagaacacctgcaaatgaagatgatgctgaagaagaggaagataactggttggatggatgctatgatcatcattgtgctcattatactcgaagcaacattagtacatcacagtagtcatcaaagatgaggttgaagttgaactgaaagaagtggtacagcacatgcaagtgagcaagagaccgaagaagaggaaggaaactggttggatggatgctgtgactgatgatcatcgaagcgaggatgaacatgaactgaacaccttggttcattcagctccggcgaccgtggccggagaagcggcggccgacggcggcttgtggacgacgaaggacatgcactggcactggcggctgctgtcgaaggcgatgaggcggatgaaggcgtccgggtactccctccggcattcctccacctcccggagcaccgccgccgcgtcagagcatccgaacatcggcagcttccacagcgtccagtacctcccgtcgtagtaccccggcatccggctgttgctccggtggatctccccctcctacaccatatcatccattcatagtacaaacttataacaatacatttttcttttgggtaaatactaactgatggataaattcatcatggagaaaattagtgtaattacaaaaagagttaggacaagtttgatgcttagtttgtaccttgtcaaactcgaggcaagggacccatcctttggacatgatgaactcgatctccttggagatggacttcgcgctcaggggaggcaggtaagacatcgcctcgtacctcctgttggtgaaagggttccatgtctacaacaaaattaaatcactcgctgaatttactgtaagctgattttgcaagtatttcatgccgaaaagaaaacactttgatctgatctttttcgactcctcaaaacaaaagtaacatatagatatgcagagaaagtttcatgtttgctgaattgctcacctgcatgcagtaagttctgaagccattggatgctgcacctcttcttgccctgcaggagccaggcaccaccctcctctgatcccggacaagcttggccggctgctccggcgaagcgacgacggcgccggcgacgaagctggccgtgttgatgaacatgatgtcgccggagtagagagtggtggtggtggccggcggtggcgtgaagaggttaagaaggggagagtagagcaaggtgacaagagatggagagtgtggtggcgctgggagaaggtggcaccggtgcacttgggatggcaatggcatgggcatctttccatttcctttataacaattaacaaaatgggtgtttcaaatatgtccctttttagaaacataaaaatgggttcaaatctatttcttgaaaaacatactattgtgaataaaattttggcgtggttatcaaggggaatggttacatttcttggtaagttgatgagttttaatgggacaaatgtggaaaatactttggctgtgtacatccggtttagatatagaggctagattttttttatcgattttctaaataatatatggaaaacacaaattttacagttttttttaattagaaaatcaaatgaggtgaaaggaaatgtcaatgttgctaaactatctctcatataaattcgtgatgaaaaaaaaaatctcattgatcatttttttctcattggtctagagaaacggtggcttcaagccttcaacatggaagttgtttgtctgtagtggacgatgggaccagagaccagagcaatggtggtgatttcttcctttggtgccatcgccgatcttttccccccataccactagcatgtaatcatgcaggccgccaacagaaaatttattgatcacctatggtttgatttgatggtggacttaatcatcattcaaaacagtaggtttatttggcttgttatgatcaacaaaacgaaataggctttgtcatccaatcatgtaaaagcatctttctgcacaatttggcaaatgcattgtgatattgcgagttcaacaactaagcttttctttatacaacagtcttgaagaatgtgatatatcagggtaaaagatttctggcattcctgatcctgataaaggcatgatctcaagcccttgctcaaatcggtttcagttgatcccattggcagttgatagaagtgaacagtgctaccagatgagagctatagattgtgttcaatttacaggttgttgttagtacacgtttcccaaatgatctaattattcaaaaatttctgggctagggtagtatttacagcaaaatcaaaactactgcagattccagtatctttgacagaataacatctactggccccttgcacttttatgctgcaaatgacgcccccttcactagcccatcgttcagaatctcggccaagtcattttccagagccaactcctgcatttagagtagaacaatattagtctagatgaaacacccataacttcagaagttcagaacacatattggagatatcctgatgccttcatttgagaatttgcagagaaaagatggttccttttttttgttttaccttgtcgctgactgaacgctggtggccttggtcgatggaagaattatctccagatgatgcaacgaatgtgtgaagacggatcagctcagggagcacgacggattccaagtcaggacggtctctgtgccggagttcacagcatttcagtgaaagctcagcaaacttctgagcttcctgcacaggccagccggtgacattaggatccaagagcccctcaaatgttccttcctccagtgcatcagagaccatgtaagcaagccccattgcatcttttgcagtgatcatctgaagatagatgatgccgagcgcataaacatcggatttcgtggtgaccaatccagtcttctggtactcaggatcgatgtagcagaaggtccctgcagcatctgtcatccggtactgcgtgaccgtctcatccatcgaccggggaatgatgcgagcgaggccgacatcgctgatcttgctaacgaaatctttgtcaaggaggatgtttccaggcttgagatcacggtggacaaaggcttcaggtttcatcttgtgtagatagagcaagccagtggctatctccactgccatcttgaaacggagctgccatggcagcggtggggtgcctgaccggcagaagagacggtcctcgaggctgccattcggcatgtattcatacaccagacagccatactcagggcaagcacccaacagatgcaccatattcgggtggcgaatgttgttcaacaactcaacctgttgataacacaatttaaattcttaccatcatggtttacagatatatcatttatatatagctgaaactgatgcatgatgtttttctttttagcaaaggactaaaagtaaatcatatgattcccttcccttttcatttttggatgcaccacaatagtctctatgatttcatattactgaatgttgagtttttcatttttgtgaatgaaatttgaaattttcacgtaaacacatcattgtctacatgattttgacttaacagaagtatctggctatctatagtgacaatattaccaaaatcaaatgataatatgattgtgctgctctgaaaacattttactgtcagtatctatcccaagttcccaacatcactctcatttgattggaaattaaagagattgtggtggtgggatacttgtgtcaaacaaaattggccatggacatacctcctgttgaaactgtttcagtccttgagttatgttagaatggagaatcttggcagcaacaagagtattgtcaagtgtagctttatagactggtccataacctccttcccctaccttcagttccggtgagaaatgatcggtggcatttgcaacctcttctgttgtgtatattttgcattggaatctagttggaagaccctccagtagtcttttcgtctcaattggccttggcaaagatttacacttcagttcaaggttgtaagccttttcagaagcacatccatgcttagaatcatttctaggcgagtaaaatttgggcggcaaacgtcttaagatcggatgcaccgtatcctgggaactatggtctttaaattcctgtatggttctctctctgcattgatcagaagaggaagtttcgagtttcaagagcttatgctttgggccacgaactgcggaactcggttctgcatttggtctctcactgtaggaatgggttgaacatgtcgtgaattcttgtaaatgttcatcctcatgttcaacacttgcatttgagttttcactcctgtctccgatcccaagaggtaactgcagtccaaatttccattagaattcatactttcagaatatgggattagagacaagtaactttatgagataaacaataagcaacacagcacaaggtatcacaattaccttgttccacatgtgcatatcgtcatttttctgtttcagctcaagctttaacttccttatttcagcctccaaatcttcctgcaaaaagcagttggtctaatagttatatttctgcaagtgacaaaaccaaaataacaaagagtaggggaaaatatcaaaagcatactgggtagtatttagaagttgattcagtacattcttcactcaggtttggagataaagggttgcagccaggacaaagtgcactatcataaaaaaaaaaactcatttatcaaaacctgggtagtttgtatgagaagggcacatatttgatgtatccatgaaaacatcaaggaatttatgttagcatatatatagagagaggatgcaaagctcacctagatgaattttgcccttcaatatgtattattggtgctggttcacctgcaaattccacatgcacctaatgaacatacaactcacaagtatactagagtgaatatcatctaaagggaattagcattagagtaacacaaactttttgcaattagcggccgattttcagatatattctccagctcttctttgctggtatcatttgcatttgcatgggtggcaagcctgaatgaagatagtttccctttggatataacatacactgaacagaaatttggtgcagattttgtgacacatgttggcacatccaacttccatattgtcctgcactagttaagaactgagatcaatatagcaatcaaaagagaagtattaaaacaattcagaaaataaactgtaaatagaaatggttgcaattttctttgacttaatggttgtaaaataatacggcaccttgtaaatgcattcctagatgatgcccccagtactaatttgtcaactttatggtcaaggacaaaatctataataactttccacacatcagttccatcaagaatggtttccctgcattgtaactgtagatattaaagcaagtcagccaaaaaagggtcatgattttgctcatgctatcatcaggtcaaacaaaggaaagcaaaatcttaatagattatatgaaaagccacatgaatgatcgatttcaggtccatgccaacatgagcattccagtctgtagttttcagaaactctctatatctccatagattttagattccgccaaaatgaacataatctctgcgtgacaaggtagaggtaggaaaaatggatgcatacccctcgtctgctgcagaagcactggaatgggagcagcagatctttggtgtgatgatccatttgatcaggagaagaagctgcaacatcatcctgcacgtgcaatagggagaattgctttccccctgcataaatgaaaaacttggaaaatttataaactctaacaatacaatgcaaaattcacaattcatcaatgcacatcacatgaacagcaccgcaacttggatgcacatcaaatgagacagattaaggtgggttcttttctccccttttccaacctctactcactagttttctacgcgcacgatttccgaatactgaacgatacgtatttttgcaaaaattatctatcatatcaatcatgtcaatcattttttcaagtttattagccaataacccaatacttcattaatcgtgcgctaatccatctctccgttttccgtgccgggatcccaaaggagatcaagatcacgtcaagatcaatttctagggttgagatgggtgagctgaggggggaggaggatcgtaccggcggagtggagggaggcgtgcttgcggcggacgtggaggaggaagaaggggtgggagagcgagaggacgtggtcggccgcccacttgagcgcgtgctggctgcccctgtcgccgtcgacggccacggccgccaccaccttcccgccgtcggctgccgcgcggtggtccatctccgccagccgcctcatcgcggcggccgccgcctccttcttgccgccgccgccgccgccgtcatcctccttcttcctcgccgacaccgggaacggcgggtggacgtggaacgtggggtacgacatctccggcgaggaggaggaggagagagagagagattgtggcgccaaaatggagggaagcagcggatttggagggaaatgctttgcttcgcttgcgagaggagagtttttcttttttttttttccctttttgtccttctcatattattgactaaaaatagtccagttattaataattgaatttggacgaaacagaatactgaccttttagaaaatacggtcataaatatttgacgttaaaatcgtaatttgatgatttgattaagtttttgaacccttatgtatttaatattaaataaatatgatattatttttcgaggcaaatttaattacacacattatatttaaaaaaactactccctccgtattttaatgtatgacgccgttgacttttcgaccaacgtttgaccattcgttttattcaaattttttgtgcaaatatgaaaatatttatgtcatacttaatgaacatttgatgatgaatcaaatcacaagaaaataaatgataattccataaattttttgaataaattttttgaataagacaaatggtcaaacgttaaacaaaaagtcaacggcggcatacattaaaatatggaggtaatatgatttttgaaaactttatactaaaagttaatggcatcataaatttgaaatgaaatcgagggagtatattaaaaaatatttaaaaacagagtactagtaaagattggtaatctatgattaagtcttgtcctgttcgctttaccagcttaaagtaatctgaataatagattgctccagttcaatgcgaacacatcaaacagttcagtgcgaacacatcaaacaaaattgtgtgatttttgctgcaacaatcatatggttgatggatcatcattcatgcaaggctctcatgctattttttcacaccactaatcctggtaatgaaatgtgatggtattcataattgcctctttgcttcaccggcttgaagtaatctgaagaacagattaactgcttaatctccagttcagtgcaaacatatcaatttttttttgtaatttttggctgcagccaacaatcatatcctacggttgatggacgcctccgcttgttgacagaccgatcgattcacatggcagtttgaagcttgggtctcttgaagagtcacggatggaagaactggagtcttgtctggtgtggagttgctgctgaaccatgttaggatgacgaatgttgttcaataaccaacctgttgataaacaccatttaagtaatctcatcatcatatggtttacagaatatggcatttacataagctgaaactgaagcatatgatgcattcttgacaaaggtctgatgctgtaatttcttttggaaatcatatgattactttccttgctgatctgctaaagataaagagaacaaatatgaaaggtctgccgtcatacctatgttaacttcagaaaaattgcccaactgggctaagaagcttcccttccatcacctgaacaagttactgtactggagggtcgttgttgccaattgttgcagttcatatacattggtctgcagtaaagaggataataagatatctgaatcatcatatatcatgggttatcagacaagaaggaaactacaaaattaatcagcgcaattactgatgcagcttgatccagatgcctcaatgacacatgttctactggacgatttgcagcttttcctggcaaaaacttggtctcatggagctcaagaaaccagcacacagtagccaggtcagtctttgctagttgagattggagtatacctgaacagaacaccatgcttatggcgtgacaatcttgatgcaacctatatcagcttatccaataattccacactagaaccaaagcatgttgaagttgactaccactatgttagagaaagggtggcacataaattgcttgacattagattcacttaagccaaagatcaagtcgaacaagaattctgacaaagccactcccagtgcacacgcacatggaacaccggacaatctcaatctgttttaaccaggatggcatagaggatgttaaagtaatcgatgaaggcataaacaattttttttaaaagaaattgacttacaataggaggcccaaccatacagcacattctgatctattgctcctaagctcacggttcagttctatccatccagcgccttctgttctactgctcctaagttcaaagttctgttctattgctcctaagcttcagttaggtagtgacattaaaaaaagaaaaggaacaatgggagacaggagtgctaccgatttaattaagattagaaaaaaatgcataaagttttcaggatagtttgagaaccagaacaatctatatgtaaaaaacaattatagttgatcaacggcttgagaataaaatggattgagattgtcttcttcaaagaatcaaagtaaatctaatcacttttataggctagctgcctagctccttctatagactcagctaggaaacaacttgaggtgcatgctttgaatggcaagacaaacagaaacgacgaaacgtgatgcactgcgacaaatctaacctaaaaagtggtgttttcagttggcatgggtgccatttattcccaacatatatggatgtgaatatgttaatatatctcagcaaagaaatgcccctgatgcctatatggatgtgaatatgtcattgtattcatcaccagcaaagtaacacccccattacatacacaattttgaggaacctaaaaaaaccaactctagactaattgccacattcagagactcaactcaatcccaagattaatagtaacagacgggaaacaatgccatgctaaaacatctgcatgcaaactttaaaagttgtgtgattcgaatgttggcaatgtaatgaaaattcaatcgatggcaatgcaatgaatgatactcctgagtattcattatagtctagagacaggccaaatgaacaaaacaatattcacttcttttttgccaatgaactaaagagggagcatctattttccaatttcctgtttgaaaatacagagtattacaagaaattgcataatttcaaaatactccagctaactcatcttcaccaaccaaataattgattgtttacatgccttatcatagatactccctccgttttatattataagactttttagcattgccgacattcatacgtatgctaatgaatctagacatatatatactccctccgtttcatattacaagactttctagtatttcccacatttatatagatgttaatgaatctaaacatgtatatatgtctagattcattaatatatatattaatgtcggtaatgctaaaaagtcttacaatatgaaacggaggaaataggtacgatgaggacgttgtgaaatcaaagaacactatggcagaggactttgtgagcgatgctgtaacgctccgacttgtgcttgatcatccggagctcaccacgggaggtgcgctccagctcaacgccggtgaagacagcgaacctgtcgaaccgctgcgagaagtcgcagcgcacctcgactagctcttggaagaatctggccacgaagaacctgctagagccaaggtgcacaaggaaggcctcgaccgggatccattccctcggcactgacagctccatccacacgttggtcagctccggccccgtctccggcgaggcggcggcggcgaggtccacggcgcagagcgggtgcttgtccctcctggaggaggagagcccgaaccagagcttgtgctcggggacgtactccgctaggccggcgaacggcatcggccagtcggcctgcttgctccagctgcagctaaccgtgtcgaaggcgtaggtgcccgcgcgcgccgtggagatccacacctccgatccgccgaccaccgtgtaggactcgataggcttggggctgtagcccggggcaaacaggaatggcggcggcgggagcgcacgggagcagtaagaagaagaagaggaatccaccgccgtgacagcctcgaagcaatggcggccgccgcagggcaccctggggtacaggtcgaagaggtagatgtcgtcgcctacagggacggagactggccagtacttgggtttcagcggggtggtctccgcgagcagggcgtgcgtgccggcgtcgtagatggcggcgctgtcggactggtccgtcaccagcagcctgtcgcgggcgcggccgaagagcatcaccccgatgtcgccgttgctctccggcggggccggagctgggtagaacgacatggagggctccggcaaggaggattcctccgtcaccaccgccatggacgacgggctgaacggcggcggcggccggcgggagaagaaacgcgacgtgtcgatgtggcggaggttggcgctgccgttcaatgcggtcaccaggtgcacaacccgccgcagtgaacccatcctcttgatgctcttcttcttcttcttctacaccccgtcctaggtaggaaaccacatcgattcgattcaatccaatccaatattatctttctgaaaaccagatctcccaaaacaaacatacctgtgctgtggaagaagaaagaagcgacaatttgaatccgatcgtacgagcaacaggtggtagcgcggcgggcggcggcggcggcggcggcggcggcgggcgtggtggcgagggtttccttcccttgtctgtttttttattttttatttcccctgccttgttctgtttatttattgtttcgctcggcccagcaccaagacaggccaggggctcggcccaactaaggcagaccagcccgcgaggccgccgccttctccgcgtgtcgacggtggcagtggagaggagtgcgttgatcttgagcgatcgagccagcggtgtcgcacccatgcatgcgcgcgccgagctcacaatccgccgccagcaacggcgtcccgttcccaacacccgcaccgacatcgtcaagacgcaccacgtacgtcggccgaccggtcggatcctcggcttgccatgccatgctcttcgactcatatgccatggatgcgtacagctgcctactggttccaaaatacatacccaacgattttgctaaacgcgaagtaatcgaagcgagaagtctcccgaaataagatttccccacaaaataagatttgggttcatttcaaatccctcggctcgcgactcctgcctgcgtcgtcgtcgcctacctcaagccaaaaccatggctggggcggggctcccaagctggtgggcgctccctctcctccgcgtgcccacgtcgtccgccgtccgcatcatcccgtcgatcgccgccgccgccgcgcgcggccacgacctcctcctcctccgcgcctcctcgtccgaggccacccggggcttctcgtcgtcgacctccgcgcccgcggcaccggcccacgccacggctgaactgctccagccgcgcaaggacgagccccccgcaccagggtccgccaccgccgcacgttctcgtccgcggccacccgcgtcgtcgaccgccgcggccgcactggtcgagctcgagccgcagcagaagcaacctcccgtgccggcgtccgccgcggccacccgcgcctactcgtcatcggccgcactggtcccatctcccgcgccggcgtccgccacgaccccacccatgaagcagcgcacagggcagcccactccggcagcgatcaagcggcagcgccaactccaaccggcgccaacacgtgtggccggaccagccgatctgatcaacctcgctcaagcgggacgcgtcaatgaagcgatccatctactaagccagggagctcgcgggaattgcaaggccttcgaagagctcgccgcaagctgctcgactccagcactgaaggaggaattgaaagatgtccaccactacttcctgtgctccggctttcacaacgattgcggcgtgaacaacaagctcattgagatgtatcccaagtgcgatctgctcgagttcagtcgcaggacctttgatcaaatggcctatcgtacccttgactcttggcttctcatgatcgaggtcagctacaatgcggaagagtttgaggaggcgttctggcttttcaagcagctcaaaagtaattaccatgatctgcacaaaacaaagcacctgatatctccagttggatcggttgaactgatacaactatgccgatctggcaaggcaagaaaggctctcaaactgctagagatgggagtgcacgccaacctgcacgcattcttcgagatcgcagccggttgccgtacgatcgctgagctcaacctggtgcgcggatgcctgcaacgctccgcgttcagtcacaacactttcatcaatagcaagactgaccaaatgcaagccaagtttgagcagatgcacgccaacctcaagaacaaggacgggcacggccatccttagcccttgtggctaccaagtataccttctgcttcgtcacaaaagattttgcaatgttgttttgggtagtatctaggcatctctctcatgatggtagacgatagatatatttgctgacatgaactccgagcctcaaattacatacctactgtaagaaaacaccgtatgccacttggaacttaattacatgttcgtctctttcagcgtatgttagtgggccagctgctccaatagtggtgtaagtagaggttgttctaatatattcaaatagagcaacctgtaaatgcatttctagatgatatgtcccaatactaacttgtcaactttatggtcaacaacagaaatctagctacaatacctttccacgtatcagttccctcaaaattgatttccctgcattgtaacggttgtacgtactccctccgtcctaagatatttgacgccgttgatttttcttaaacatatttaattgttcgtcttattaaaaacttttgtgaaatatgtaaaactatatgtataaaaaagtatatttaacaataaatcaaatgatatgaaaagaattaataattacttaaattaatttgaataagacgaacgatcaaacatattttaaaaagtcaacgatatcaaatatttagggacagagaaaatacaacggtccgaagatgtatgtgatattccgtgcaaacacgaggagttttttacaaaaatgcccagccctctcaccgggagcagccctccaccccaaccggcaagtatgcacaccacaatagcgcccaaattagaaactagaaactattaagtgtggcgggctgggcggccgctcgactatgccacgtcagcgattcggtacagtactacagtgctcgggtgtatttttgcaaaaaggccctccagttttatgtaataacatatatgcccctcgcgaacagtttttggagaggagaatccgtggataaggacctatatgtaaaatattaagtgtggcgggctgggcggtcgctcgactatgccacgtcagcgattcggtacagtactacagtgctcgggtgtatttttgcaaaaaggccctccagttttatgtaataacatatatgcccctctcgaacagttgttggagaggagaatccgcggataaggacctatatgtaaaagtggaatatgtagggctttttcgcaaaatggcgttcactacctaacacccccaaaccctatccgttgccgcccgcaccctgtccctctccctctccagcgccgccaccgagcggctcgcgccgccgccgccgccgccgccacccctcgcgccgccatccccaccatcgccgtcgccgtcgcctcgcctcgtcacggccgcctccgccatcgcctccgccacctccaccatcgtcgtcgtcgtcgccgtcgccacccctctcccaccatcgtctccgccatcgttgtcgccgtcgcctcgcgccaccacggccgctgccgcctccgacttccccgtcgcctcgcgtcgtcgtcgccgtcgcccgcccccgccaccatctccggccccccaaaccctagccgccgccgcccgctcgttccgacggggattcggaggggtcgaagggaggaagaggcggtggcggtcggcgaagaggatgacgatggcgacggcggcagcggcggaggaggcggacgcggcggtgggagatggagacggtggtgatggcggtcggcgaagaggacgacgatggtgacggcggcggcggaggaggaggcggatgcggcggcgggagagcgagacggtggtgatggcgacgacccccgcactctctcatggcaatctcgggggaggtgtcggggaccacggcaacgctggtggtcatcaatggattcacggtcacggtggagtcagtcggggactcgcggtgcatcctggacacgcagggtggtgaggtgtagctgctgaccgtcgaccactgcctggagaagaatgccgaggagcgggagcgggttagcgccagtggtggggaggtcggccggctcaatctcttcggtggtcaggaggtaccaattcgctcccgagaggccagattgaaaaagagaggcttcctttgtgatgcattgctgtgtgacgctttgttttcagtcggccatgtcctgctttgtgatgcattgttgtttgatgcagttctaggttggccctctccggtgctagacaggtggcatgtgcctttcaagatctattggggacctcttcctgccgctcccatcatccctagttgcccgccccacatcccatcatcgacggcggcgtggattttggtggtcgcgcaggtctggctgacgagctccatgccggctcgaagcagatggcgacctcaacggcaacgtggatccaggctagagcttgataatggcactaatctgccaacgagcttggcggcaacatgcccggcggccgccgttagttccttacccagcgccgtctccaccgtcttcgctgcctccacggtcatggccagcggcggttgaccatggcatatgctccggcaggcaaaagcagagagatggccttcctcccctttctctcccatctctccttagattaatctctctctctctcaggctgccattgttgttcttttcatggataaaattgttagggatcggcaatatttcctattctaattgtgtcttgactgaaaattagttcgattatattcagagcccgtggttaggtgatccgagattggtgcttgctggctggattagtcaattagaaaaaggtagattttgatatgcagtattaatttgatcttgtgatgatcttagttcttgtaccctgccttcccttgaggctacttctggatacccaaggccctagcgcgaagacgtgtgagggggctgcaggtgagtcgggctatcgccgtggagcgaccgtggtgaagcagcagctctacagcggccggatcagtgcggtggtccggtggctttacggttgctagaggtgtgaatccttgcttcaatggttagagaaacttagatgcacctttgctgcatgtttcttccatgtttcatgtcttctttctgcagctgttgctgtttagggtcaactaggaggcagtgtctgtgtggtgattcatcacagttgcggcggtctcgacctacagcatatgtccatgatcgatgcgtgacaagagccgaaaaggatcatccattgtgtgagtgtgctctatgcggctgctaagcaaacaaccaattatgtttcactgttaaagtttggctgtaatattcgattaaaaataccttgataattttacctcccaaggatctaaatgttttgcctttgatttaaattgtttttcccctgatggctgatgcagtgatgcagtttttcaagcaagtggataagagcagcaagtattatgaatttcgctgcaaaactagattagtgaaaccatcaatcctccactttcaggtgagttataattcattattctatttaatgcaggataagctatttttcctaagctattagcatttggattattctgtatcatcacggagttgctacaccttatttcactgatcgtatgtatttgtccatgtcaatagaactaagaagttcaaaaaattgtatgaacaataatagccttaataaagggacctctgagcaagaaatctactatcccaggggaaaaattttgtaatattttgaaggaaatgctatggtggttaaatacttaaatgtttgcatgttgaactgttaaaaacactcataacttgatgatcttttgacagaacctatacaaggaagggctcttggagcaactgctacagtcaactgctctactggttagttggtcacttggtcgtcacttgtcaggtagtatgcacaaccttttgtggtatatcatctgctttatctaaattagtttggctcatttttactaatgttataactgtgtgtgcagcctgacggtgcagcatctaaaagctaacttatacagtgtgctttatctctggtatggctgacctcagttgtaagttctgaattttgagtggtgttggttagaaccatttatctgattgctcttgttcatgatgaatggcaatataatgggattactcttactcaggcattgatggaaagtttcaagatttgtgcagtcaatgatggcatcataaattgcgtggatatggtaaaaatatatcatttaccagttttctcttttgctgaatcattgattgatctactatatttgatcttgatcaaatcatatttttgaactaatgtagttctttgacatgaaaaaagcttgatgttaagtacagaagaaccaggtatgcataatcattgtgtgggttcattttcttttttcttctatagagttgcatgcattttcctttttgcttcgcccccgccccctgaatagaagtgtatacggagaactactgatctttagaatatcagagaaaaggtctaatctgatttgtatgatctctataaggatttggaactcaccagaaacatccaatttccatttctaagatagacaattatctttaccttaccctgtaattttttcgtttgaccaccgataattctgattccacatggatcttttatgtactttctcatccgccatctttattcttgtaacagtggaaatgtacatcagagaagcccctagaactgctcctattacaaataagaccgtaacaagtcattaagctaatgtcttaagggatatattatgtactcactttataaatcaatgcagttcttagctaatacgtgctcatgtgatgaagtatttttgtgccttttcctttgctttctgcttgattgatgatttccagataaaagttttagatgatactaacaacagttttttcactctagaacaaactattaggtagtaatacaatgcttaagaaacactccattatggtgtaatgtcttcatttcctgactgcttatccttctatacctcttaaacctagccattttatttgtttataccgaaacctagacattcaattttgtccggcacttgtactataagtggttagtagatgatgccatgtatgttatcttgggacaaaagtaagataattcagtggcttgatgaaactgtacaggaatatccccttttttagtaatctattgtgaaatcagttgctagatgtttcactaatcatgacgggtgggttagtaaatatgtgcggattattaccgggtaatacatttatccacatactgatcataattcagaggaacaaaatatattggcattgattatttattctgattgtgaggttaaggagtattcagcttgcaagtaataaaattgtactactacatttgtacctaggaagtcagctctttctggtaaaaattttagcatccttttattctaaatatgttttatatcttctagatttatttctttttcagggcaagtcactaactttatggtattggagttggagtagaagatcagcagctccatcatcgacgatggcctgatccccaaacatggattttggtggtgatacttccagggaggtaaaat

SEQ ID NO: 39396 - DNA, 1593 bp, Oryza sativa
ggctagatctctttctcatctgtggccaaaaacattcaagatgaaacctccagaaggacaagatattggactgtgcttcattagttctcttcaaaggtatgacccttcaaatcgatgcttctactgactttccttttgttcctctcacttgtctcaatggcatgtggacctactggtgtggacccatctcattatttataaaataaggacgttttcagatgtttaattggtggcatgatagaaattaatcctcagaagtatcaccaatgattttagtgggttcagtcatatcatttgtcatatactaacaagtcctacctccgtcccagaatataagaagttttggggttaaacacgagtattaaggaagtaggtggaattaaatgggtcaatgttatgatttgttgagaaaaggaggtagggggagaaattaaacagagaaggttttgattggttgagagaatgtaggtggtaaatttgctatattttgggatggattacgaatgctagaaattactatattttgggacggggggagtattcatttcagttaccggcaattgaaaaccaattcaacaatttatcctgaaaaaatgaatgcgagttcttttggagtttaaactctttttatcaactacaggatgcagctgtgtgcatgaagcttatctgcatttgtgtgttttctctctttttctttgcagaccaaacgggagttctgaccatctcctgaaaaatatttctttgcatattgggttacgaaccaaggctggtgctactaggtgctgatattttcatccaaattgcttacccaagaataccaaaatatgttccatgatcctttttatgtcccatttccaaaccatgtcatgtatccccccataactgacaatgcttggacttggtatgcttaaacaaactgatactgtgatgcatccatttctcaaagttgctatttggtaatcttatttgtatgaatattttttaaattcaattttttttgtaatacctgtttttgatttgtcgcaatagtttctcttacaaccagatgaaatcacatggagtttgcatgtgcatagctatacagtccctgttaaatattttaaaaagtagtatgcatgtacaaatttatcatctaaccttttttgtataattaccaatttaacaggaaaatgtaataagttttacttttggggtgttttcggagagctgcacagatactataatcaaacaggtaatgttaagattggcaataccgactcgtgagacaaatttgaagatattggcatgaacttggacttgacaaatggcaaagagttaaagagaggcaaatgtgggagttaaaagagaggcaaatgtggggttgaggtgtcatttgagaggcacaaatgtaaggaaactggcaagattttggagacacaagacaaagaaacatagaagggaaaatgtggggagattagtaataaattggatgtggcagttagcaggtaaagagataggatcaacaaatgtatgaaaatgctgaagactcctgatccaaatgctgcggcaagctctttaggtacaagtgcttttttctttgagccggcacatctt

SEQ ID NO: 39397 - DNA, 5772 bp, Oryza sativa
tcttgatgttattaagtattcaactttctttccttttcaacagccttgttttgaaatgctgagggaatgttcagcaaatgctcatgacatataccattgttgtaggatggtaacagcaaagaagctgaagggcaaggatgaggctgtactgttgagctcttggcaactcaagtaaaaggtgagttatctatgttctggactatgcacttccgctgacttcaaaatgtataaaacctgctcgaatttggttggatcattgacctgttgttctccatgttatgcacctgtaaaattttctcttcctttcaagcttaacttaaaatggttctccttacattgaattaatcgatttaccacttgtgatttgtacgctgttagagacttagatcaacaaaagcagggctaaatgttatttgtccttatttgcaataactttgatattttggtttgggttaattgatgtcagaattagacagagtgatcaactaaaggcatttttcattcagcaatactcgaaatattaactgtcaacttcatgccaccaaataaattcagttcatttatccaaactatttgttgctgaacaggtctgtcatagcctcacacatatatggtttactttattccttgcagaaaaaggtgtttttttttattttacagagaacatccttcaagccttgaaattagttgttgttgtgctaatcttgaaatgtttagtatatttggtgaattatgatgctctattgctctgcaaaacatggtttctgaatgcactattttggttggacaggttaaatgtgttgtaggagtatttttgtttttactatttcgtgaaatcaaaatataaattgatcattccagtgaagcaccctattgtgctattctcaatcttagcttaatatattttccaagcaacaatgattgtaatgcaggctcaatatgttactctggtaaccggtattagctgaaccaaaagcatcaacgcagtttacgctaggattacaaagatttaagaggattattatagcctcatataataaagatatcccattagccttattaattgtgtaccaacatcaatttatgtttatcaattcctataatgtctcgctattatcctgaaattggtgtgctgtggtgtttaacataattctgcagttgacatagctctatccacctcattatagatgattgataaacatttttttctcaagaactttatagtaatatgacctaaataaggtaattctaacataatcctccctaatcctttgactccttgcccttgttgacctcaaatgttcatcttttatccctacttgttcatggatcacaattcaatccctctagagtcgtgtccaagctagctctacctgtgcattaggatttttacatgctcatgagtttcattctgctttcctggaaagaatgtagtttatgtgatcagccaggtgtgattttggatttcatttgcattatgtcgaaatcgccctgatgtgatgcatgaaaagtgtattgcgtactgtttgtcctcctctttatactgtgccgaaaaatcgcctgaaaaagtgctctattccgttatctgagtcttggttgatttcgcttgttggcatgtgcatttgatgatgtcagaggagatcaaatttgttgctgctataattttgtgattgctatgcatctcaaaattgattaacttggcctgcatttcgttgtcttcgtatcaggggtagaaggctcgggtgattcaggtgctgctgttcattgtcggaataaacactgtgccaactggtcttcgggccttgtcttctggctctgatgcaaggatcgtacgccgttgttacactgagagtttccattatactggctggccatccccgcaatgaagcatgtccttatgaggttgtgtgcagcctagatttacctgtgtattaagattgttgcatcctcatggcttcatgagtaactgtgcatcccattgctaaatcctgttgctagatggttgcatatttgattatatgtttttatatttattgatattctgatgtttaggaagttttttaccataggagtaggtttatgtattaaacagatgtgattttcgatttgatttgcatcacgagcaaaatggtcttgatgtgttgcattaaaaagtgtatttcctacatttttccctactctttatctgcactcggtgattactccccaaaaataacctgaaaagtactatttcgctatattagctttggttcattccgtttgttggcatgtacatttgaatatgtcaagaggacatttagtgtgttactactatcattttgtgatgcctttgcatgtcagaattgatgaacatggcttatattttgttgtcttgatatcagggggaaaagggtcgggtgatccaggcgctgttgctgctcttcattagcgggattaacacgctgtgccaattgttctttggatcttgtctcctggctctgatggaatggttgtaccctgttgtagatctgttattacaaataatctgggattcataaagttctttgttaggcaaggttgcatgcttggattggagtagttcctggagagttttggtgcctcgcctgaagtgtttcctgagatttgctttgcttggaaatgaatgtaatctttttttattggcggtttttgttggtttgtaacttactaaatacatgtattgctcatctggtaattcagactcaagtgagttaacctatgctgatgatgttatctgctgctatgtacgtatactactttctttgtggcatctacttatgaactcttcctaattacaatctgctatccaaaataacaataccgtattacaccacagctctcttcaggcggcgcgccagtggcgcgccccatcctctagttttaattaaccggcgcacctcttatggacggttgcccccgcgcgcgcaacgagtaggagaagttagcagccacgtgtaaaacaacgagatagcccaaaaataattaaaaaaatgagaaaaacgatggggttaggggagttattgattgatgatatattaaagcgggtcaatatgccacaaatttgctcatgttatcagcagatcaaacaaggaaaggcttaatgacatactagctgatggggttattgtttagtcgattcctattccgtgttgttgctagaagcttagaacgtaaataagaaaaaaaaattgtctgacataacgtagtggtagattttcggagtgctaaatagctggatcgctcaagcagtttttagataccatgtttacaacaaaatttggtggtagagtgctctgttaaaccgtacacggcaagtaacacaattctgatggatgaaagggataatagtaattgatggatattttacaaaatgtatatggccacttccaagaggtttttgcatactgaagtgttgctgttccagacgaacaaaggttcaagtcatggccattacttctcaagcaagggcctacacagtgcagtttcagctggtggtggtcatctcaccttcctgtagtgaaaaaactctctaaactggagcaattgatcatagacgttcctctctctctctctctctctctctctctctctctctctctctctctctttctctaaaattaattgatcaagattgcctgcaagataattgagtaaaggattagattaggcatcaagataaattattgaactcgttgcattaatcatacacgttttgagagattatttaattaggtgtataactgataaatcctaatcactccaaaaggtgcatcacatggactcagaagaattgcatctatttttagagagaatatagtgctcttaatctcaatatttcatttttatcatttgaattttgttcttgcaactggggtttggaggcagtagaatggtaaaaatgagaatgccatttaaacaaccataataaacagaaaaaaaaagtttcaatctagtttctatcctgcttattttccaattaaaattatgcttcattagaactcttcaaacaaaagccttgctaattctagcctaaacgcaaattagttttttttaaaaaaaaacttgaccacagtaacaccttaaagaataatacatgaatgaattacaacagttagggaagtttgagttatcatccatacacaaaacctaggtgaaatttctagtaccattgaaactaaccgcccattataatttgttctcaaaatcttcagcctaacagatcaaacctagggttgataaaaaaaagccagattgaatctaatcaggtcaaacgccactaatatcatataaatccttcacacggtactttcctagtcgaatcccctcattcaaatcatcacatacatagagatcaaatcccaagcccagaagagtgtggacagggatcaatgatcgaaagcaaaagatattagggcaagcagtaggaacttacctggggttttacagcaacgttattgggcgaagaccggcttatggcgatcttggtggaaatcacatgatggcgacttcggtggtcaacacgttcgcccgttggtttcactgcagtggctggttcatgtatggaggagaggaggagaagagataaggttagtgagaaagaaggaaaagatacatgataatttcaaacagccacaaagatgtttacaacaataagccattctcctccattatctatgacaacagctccaggttactaattaataatataagaaatattatggatcagcctagtctttcaagttaacaatagatagaaatgtatgtgtttatgtggcatctaaattgtcagcggtgaaaagtaaacagttacaggataaggtaaagatgattgcctctcttagaactgggaataggaagttcctactgagtttaaaactgatagattgtagaaatcagataagccttttgtcttatgttctagagatcatttagttctccagttctcccaatgccttcgttcagaaggaaaaaaatgcatgtaactctaggtaataataaaaacaaaataaaggtacatgatgattatacataccagattccttgttcttctgtagatgtccagagctttgataaccacaagttttttcatgtgaaagaactgcaacagttcaaaaatagaacttgattaggatcaaatccaatggatctatctacaattgaacagaagaagaaaccggtaaatgatagaattaccatttccacaagggaccggccactggcagcttcggcggcgggagtgtaggccgctgcttgatgagcgcaaaaacgatggagtcctcctggagcaaagcatcgcgctccaccgccaagctcagctcctgattcatcaccaactatctctctttgagtgtgggctttgctgcatctacaagggataaaaggagtgactgtgtgacggcagatggcatgtggcattggagattcaatttaataaacaagaccatgaaacaacagaaccatgaaattcagcacaattcaaacaagcattggtaaaggtaacaacatcaagtggcaactaaaatcatgcagctagagcctgaagttaacctatgcagcgtctgatatcaacagcaacacgaggtcactgccagaaacagtctcccaaatatctcccaaggttccactctcttcagaaaaaccagcagcacgtgcttcatcaaatgacttggagcctttccggagaccaatctgaaaggaaagggcataatagaatgctggactaacagaacaatgcaaaattgcataagtgaggag

SEQ ID NO: 39398 - DNA, 22635 bp, Oryza sativa
aaattaacaatatcacttattaggagtaataatatatgaaataatttaccagcatattatctaatatctcacttattaggaaataattattatttcaaatctcacttattttaacaatgattgttacttcttaagccacaaaatctatgcgaaatcaggtaacctttccgagatccatgacaagattaacaaaaaaaagtagcaggtacagtacagtcacaaagaggcaccaacagcaaagcaaatcgagcaagagaagagaaacagacgaagaggatagaattcaaaatttatactcacccaagcaaagatccttgtgaactcaatagatcgacagggcaaccaataacagaacttaaaaaaaaattcatcatgtgtatttatgaaataaatgaatttctcaagtgattcctactacagtgcattttgttttcaagattaaattagccaaaactaaattaaactaagacatgtgacattgttgaagtacagaacaaaaagcaaatttcactttggttgggagctaactacatgaacatcctgaaaattcacatcctggaaattcagttactgcaggaacaaaaaccaaggttactgcaggaaaaaaattcacattgttgaagtacacgaacaaaaaccaaattccactttggttgggagctaactacacgaacatcctagaaatttacattaggcaattcagttcctgtaggagtaaggatgttgattctctaaataatctaaatgatcaagcttactcacatccagtacttggcactcagcacctaagtcctctaaatgtaaaagagctccagatagtactgtgatacaatccttttaagtctgtattttagggaaaaaaacatttgtttgggacagggcagtcatgattgtttaatctatttttcagtatagttttataggaacgggagggtagttgactaatccatccatttcaataagtgcaccttcacattcagaaattacatgggtttgagaaagttctaaaaatgtggctttgataaattcagagatataaaaaacatcttatacagaactgtaaaaaataatttcatcatgtgtacttatgaaataatgaatttctcaagtgattcctactacagtgcattttgttgtcaagattaaattagccaaaaccaaattaaactaagacatgtcacattgtcacgtacagaacaaatttcactttggttggaagctaactacacgaacaatcagtacatagaaagcttgcccaaaattgaagactgatcagtggaagtaatagatgaagaagtcctcactaaacacaggatgacaggaatgtgtgaattttcttaccagcactgacaagcatgaatcacacctctagtgatcaacccctgcaagccatggagcagaactgaaactactcttccttaaggcaaaactacaaacacctgcagtgcagcgcgagagaactatccctgcaacacaagcactgtaaaggatgcattgacctaccagttcttttccagtagatgcccaatcgcaatgcagatgcattgcagcgccacaaaaatgttggtcgtgatgattgagtcatggtccagacaaccgcccatcatatttgagaacatggacatcccgatctatctctgcacaattgaatgagaaattcagctagctggctacatttggatgataaaatttcctggtggacacattgcttgatgtcctcaaaacaccagcagcagtttgtgttagccaaacctactcccaaactgaacaaaaccatgcacgacaacattactccaaaacggctaagctaattaccaaactgaagctgagatatcatgaattcatcaccctttaaactaatttcggcacaatgtaactacacaaaccaaacggcacaaattagaagctacatgtaccagtctgcctttgctgaaggtgaaatctccaactcagtgacccataaagaaattctccacctcctgcagcaccggcggcttgtccagatccacctcatgcgtgcaacccgaacacctgcagagattgcgcagcagaagaaattaaaaaaaaattacttcactgtatcacacacacgcattcgatgagagagccatacaagttgaagtggacgcacttgaggcacgtcatatatgcttctgttctttactatataaaactgagcttaattaagttgaagtgtgttgttaagctcagttgttatagcatatttatttcatcatgtgtactaccgagttaaagacgcacccgaagtgtgttattgctaatatggagatgagagtagcatgctgcaactcaggccatattgcctataaactgatattatataggaaaggctcgagttataactgagttataacgcactcgacagacaaaaatcagttaaactaatgggatatagtaaaaataatcagttgttctactgagttaagacgcactcggggcgaagtctttgctgctaaactggcgttaaagaatgtactcttcgtgacagtagatataatggtataattatatgataatttttgttccatattagcaaataatcatttaacagttcctgagcatcgttgttttacatgctttctgttctttgacatttttatatttctgaagaagaaagtgctttctgttctttgacatttttatatttctgaagaagaaagtgactggagagttgaatggtaaagctaaaatgttggatgaggaactgaagatacaccagttagcagaaactcctctagggaagcaaattatgtgcatatttcacacaggatcatttgcacaaggcccagcttgcgaagccaataatctaatgcggtacccaataataaattcgaggtttagagagcatagacactccaattcgatgtaatcgaagcaaccaaatcaccaaatgccctcatgaaagcaagaacagcggcactgatttcagtattttacccccaaaatcataacacgaatccatgagcacacagtaatccagacccccaaatgcatgaggcccgtcaaatgccacagatcttgagctagccgcagcacaaatcaaccagcacacctccaaagctgagctccaagcctcgagttggagaaagcaagaactgaagagcaggagattgattggttacctgtcggtgaagagcaagccgaggcagaagctcccgctcccgaggcagagcagcacggcccatctcctcgacacccctccatctcctcctcctccttttctccagcttatcaccgccgccgctatgagtaaaacttgttcgtcctcctccgtcttagaatctcacgagcttcacaggagagcaacccatggagaacggatcacgggtcgttcttgagtcttgacttgtattctccaccgtcgacggcccacaccatctccatctgcgccccttaattttccccgatacgaaagccacataaaagatctaagcaatgaccctcttcatgtgcatgacaatgtgaccatgttttccaaatagtaatatccataacaatatgagaaaataattaatacaaaattattgccagcaagagacctaacaagagataagagtaactaagaccctatttagatgggactaaaacttttaagtccttatcacatcggatgtttggatattaattacaaatattaaacgtagactattaatataacacatccataatcttggactaattcacaagacgaatctattaagcctaattaatccagacgaatctattgagcctaattaatccatgattagcctatgtgatgctacagtaaacattctctaaatatagattaattaggcttaaaaaatttatctcgcaaattagctttcatttatgtaattagttttgtaagtagtctatatttaatagactaaattagtgtctaaatacagagactaaagttaagtccctggatccaaacaccacctaaagccctaacaagagatccatgatctcagattaaacgtcatacagacaattcacccatattacaatgcattgccatatctcaaagccactaaaacttatcctcgaatcctagcccatcgatctcattcgctttccatagcaggatctcaatctccaacagaagctctggaaactcaccatataagcattcctctacctccaattgactataagcaaagatccacagatgtacgtaaaaatgagagcggacattccagttaaagctcatgtcatcatccccggtactcacgtattccctatggctattcaaccatcttctgagaaagcggttggaaataactatgcctagccaaatcccatcatacggcaacttgctaataatctgattcttcagtcttggttgctcctgggcgagcttacccatgatgtgattgtaaaataatagaaataccgccgtcctatattaaacattataccaaccacatcagtaataaaaaaaaacaattaaatcacacaaaataaatacaaattatgcagtagaatacctgttagcatcaggtataagcgaagcgtggttgctgatgatgtactcctgacaaaccgatgtcatgctctccatctggcggagtagacggcgaaaatcggcaatacaatccacaccaatagcttcagaccccacagactctgtaatcagctctttcagaatggaagcagtttcattgtatcgacaacaagcttcttcctcactgtaaggaatctctataacaccctgaattactgcacttccatcctcacccactaagacatttgaagaagttaatgaggacagacacttcttctttgcatgaagtaaggcataggtcttgtttaatgatctcacgagtctcctgagattgtcatttggaatccatatgattttatcttctctacccatgatcttaacctttctcataagagggttggctcttgcataggtaagggcatcaatcaactctcccgcactagtaaaacatggaccaaacctataagaaaaccacaatatgaaacaaagattaaaaaaatactaaatattattgtaaaacagtagtcttggcaaagcacatctcaacaaaatctatgatgagttcagggctaggagttcagttacaacaagatcctcaatgatctgaaaaaggaattctgctgcaatggtactgtactccaagatccagagcttggccaggtatgatgcacttggcaatgcttatctagttctcaatttctgcttcacggatatgttgataacataattaaatggttgtaggtcattcagcttcatggtgatcagtgtaagaatgctgacatccagccgtgtggcatccggtttgctagcggccagaaactgaattagggtttaatttctcttttttcctctcttcgagtgtaaaattttgcgtccaactatcaagcttgttcttttcggtcataaccataaatatattcaccttcttagagttcatctatagactgtatagtgaatctaggtgacactattgcatttccatttacaggcccggctctggggcagggcaaagagggtgacggcctagggcccgtccccatgcttaaaattgtatgagtactgtatgagccaaagtagtactttaagattagtgaataattacatactatctaccactcctggttatctactagtatctacataatactgattagtgaattacttcctccgtttcacaatgtaagtcattctagcattacccacattcatatagatgttaatgaatctaggcacacatatatgtctagattcattaacatcaatatgaatgtggaaaatgctagaatgacttatattgtgaaacggagggagtaataaagattctagattcaacaatcaaaattgtatgtaaagatagattcttgttggtaatatatatttcctttataattttaggtgctgataagttgtaattttactcaagaagcatttttatggtgctaagtaaatgggaaaaataaacaagatcagtttaagtgttgatatttttctatttctaaaaaaacatatatatgaaatgttatcaatgttcatttctctctatgattagatttgaaaacacactttgaaaatgaaggggctgttcatattgtagccaaaataaatcttaccaaattttggcaataccaaaatctttacaatttagtaatattgtctagttttagcaggatttcttatgtatttactaaagtttggtaaaaaaactaaatggatacacatctttaacaactttatcaaaaattgatatggtttaaaatggcattaatctgaacaaccaaaaaatatgaatatacatataacacgtcactctataggagagagagcgttaagggtcatgttgtcaagtttgccctagggccctcaaaattgtagagccggccctgtccatttatcagggatatagctctttatattcatcatagttttaacagggaagattctttgcatcagcattagcgttgtagtgatttcaacatccgggttcttccatgtggaagctggcaacttgtaattgacacctcagtctttcagtttctacattttgtattgagcacagctataatttaattcatttcaaaatgtgtttttacatgttttctatctaatctcctgctgctaactggcaattctacatgttaggtgcattgctaatcttgttgtttaagcgatcttttagtttgagttatagtaagtcgtgtgcatgtgtgtgagggagcaaatcagcgagaacatgtgcgagttagtgtgatcggtgaaagccatgagttgtatgtaagtgactacatgcagcagcgggtgagtatttgcttggaggagcggccaagtcaagtgaagtgagtcgtgacatgaagagtggatcaactagcttgcacatgtgttattcgagacttgcatgcagatatgtgctagtggccgtgagctttgcatgcaaggattagttgtttagcaagtgtggggaataaaaggtcccattagtgccggtgtgcagcgctgggggaaatttttgtgtttgtgtgcttctcatttgtgaattaaacaacgtgtcggtatgtcaattgtgcagagtgtgagctcaatgttacttacccagtagttgaggaggtatttgttgatgcccacctagtgccaaggagtttcggcagtgctactgcagatgtaagccgcgtccatggccacctgtagctaggtccgatggcgttgcggctaagtgactgatgatgggcctgcgacaaaaaacaaatagtacgttacaagtgcgatgttcatacgatatatcatgttgagagcgaagatcatgttgagtgaagaggagtgacccaccagcggcagtgactcccttatgacctgcaatgggtaactcttgaatggcgagaagatgccaatgaatggttgcttggtagcccgaggcagtggcagcggtgaggggctcctgacaccctccagcggtgacggtagcggaggctctgatgaggccgacaagatgccaattaatgcctgcagtggtggtagtggagaagcctcagatggggcggcaagatgagatacgataccggtgaagaggcggccgacggcatgcggcgaagcctccgacgacaggatgtcgccggcgaggaacctcctccccacccgtcgtaggagcgacatggttgctccccgttccccggccggcttgcttggttggtgatgggatggcggcgcagccccttgccacccaccaccccacccggagagagcggccgggcggcggggcggggggcgtaacccgcagcctacgactccgggagggactagtgcgtgggcgacgagcgcggcggccggcggcgcagtggctgcgggatcttggtacagcggcgggcggcgccgccgccgccggaggcggagacgcgtggtggcgagggtttccttcccttctctttttttttccccctcccttgttctgtttatttattgttgtttcgcggaaaataattaaagaaaaaagaagatcatggcccaaaacctagcccttatatggagatgggcctagcgcataggcgatttttagcctactaagaaaggtccatgcttgttgggccgacctttttatcctctgccaaaagaaaaaatgtaaagtaaatttgagtatcagaaatccctaatatagacatacttttttttttaaaaaaaaagaactactagcacaaaatacatgcgtgttgcaacgagtgaagataattttaactctacatatgtgaacactattaatataaactctgcccacttaaaagagaaaaaaccgaatgaggactgataaagttgttaagttgttttttgtgtggaactctgcttctgaggcctgataaagttgttaagttgtttctgccataattatagatcttttgtgtggactaataattgttaaagtgcgcagcccgggccatctaccgtgggccaccccaggtcacattgggcctgctccaccacaagcccaaccagagccacaattttagatcctgggcctacacaactcaaaagactagtatgatgggtgaggatcgcccccacctttttaagtcgtgctcccccatcatcaattactgatgtgggactaaacccaacaataatgatgaggcctatatgtatgtatgtgcagagaactccatccatgattaaaaaaatgcagatgaactaggaaattgccgcaccacatctttttgccgagtcggcaaaggggccgaccaaatttcattaagattgaaagggggaaagttacagatttttacacgacattaaactattgagccgggggccaacacccccggagagtagaaatcgggatggaagtaaaagagagagagagagatagagagaaaagaccgggattgctagggctactcatcacaacactgaaacgcaccccgcagctctccaaactgcaacttcctctttgatatctgccacaaggtgctcggccatcttgctcctttggtcaaaaactctggcattgcgttccatccaaattagccaactcaccaacataaataaggtgtcaaaagcactcatgtagcatgtctgaaaacagcgtctcgccagttgccaccactccggcggggaaggccttgtcgtcctttggggggggggagataaaattcacattgagccaatccctcagcaaggaccaaaccctattggtaaaagagcactttgggaagagatgatcacagtcttcttgctcatatgagcacagagggcaaccaaggtcatgcggccagccgcgcttagcaaggttgtcggccgtgaggcagcgacccttaaccatcaaactcattttttttagataatggaaatggattacatctccggcttctgtcataagacacacagcaataagtttaatagtaataaaaaggtaagataaaagtaaatcagaatgagaaataaggtgatgggacaaatccccaacccccctttattattgactagcgttaaaccacataaaatattttagctagcaattcttatggaactacgccacccatagtggaataagagacccttggctaccgattccaagagtgtagcaccattgcgcatagtatcatgctcctcctgtggtagcattgtagaccagaagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattaccgaaaatatttttggcgttacggggtggagaaaactcataaaccgaggctacagaaaactgtccattgcttgagaacttccaaaggatggagtcctccaaaccacacctgccaagacatacataatcagagatgtcaaaataccataagaatctctacatacatacatatctcagataccaaaacttcagacaagagttcccaacaatggcaatgcaatgaatgatactcgtgagtattcattatagtctagagaagggccaaatgaacaaaacgataatcacttcttttttgccaatgaactaaagagggagcatctatacatcttcccaagggaggtataggatccaatttcctgtttgaaaagacagagagtattccaaggaatagcacaatttcacttattaaatactccagataactcatcttcaccaacgaaataattgtttgttaattaattatctgcctcaacataggtaggtatctatggcagaggacgttgtgagcgatgctgtaacattccgacttgtgcttgatcatccggagtattaaagtaaatcaatatcacaaatctacaactgtagcaatttttttatcagatatttccttttagaaactttctaatatatacgttttctaaaaaaatccttctattgcattgtttatatcacttgttttaagtatttgttaagtctatctactatttagtttagagtaaatttcacaaaactatagatttaaggtgttatatcatataactatatattagttatatttaacgtgaaatttctcacaaaactacacacacacacacacacacacacacatatatatatatatatatatatatatatatatatatatatatatatatatatatatatatatatatatatatatatatatatatatatatatatatataaaagatggagtatcaaaaaaaaatatcagaaaactacaaatttagtgataatttaatcataaaactataacatttatagctccaacataacgtaatactagggatttaactatagaatttttagttttgtgatacttgaccttaaatttataggttcataataaattagtcactaagggtgtatttagttcacgctaaaattagaactttggttgaaattggaacgatgtgacggaaaagttggaagtttgtgtgtgtaggaaagttttgatgtgatgaaaaagttgaaagtttagagaaaaagtttggaactaaactcggccgaaatttaaattttatgatacaacgtcttaaatctatagttttacaataatttggtcaaattgtatgtagtttaatttatcttaggtagataatccacgaggatgattctctctcaataatccaaattaaatagggcctcagactaatcgagaatcatactagctaatccaaatcaagttttcaaaaaaaaaaaccctaatccaaaccaaaagagtagcatacaatctgccacagtgtgaaatcatagcagatcgcagtaacacatactgacatctgaccctcaaatcctggtgcttactcccttcgtccaaaaaaaaaataaactatggtttttcgtatccaacgtttaaccgtccgtcttatttaaaaattatgaaaaaaattaaaaagacaagtcacatataaagtattaatcatgttttattatctaacaacaataaaaatactaattataaaaaaaattatataagacggacagtcaaacgttatacacggaaacctagtgtttgttttttttttgggacggagggagtacctagctagtagcagtctccctccgtttcacaatgtatgactttctaacattatctatatacatatagatgttaatgaatctaaacacatatatatgtctagattcattagcatctaaataaatatggacaattgtagaaagtcctacactgtgaaacggaggaagtagcaactatagttgttacttgttaatacgttgctgacaacaagccggctctgttcgaaagagcaggttgggaacgtttggctctggcacgaaaaacggaacgatccattagcgcgtgattaattaagtattagctaatttttttttcaaaaatgaaacaatatgattttttaaacaactttcgtataaaaactttttacaaaaaacgcatcaaaatagtagtttgaaaaacgtgcgcgcggaaatcgagaaggagaggttgggaatcatcacaaacgaactgagcctcatattcatctggtgtcgaactgggttcagttggctgaagaaatcaatcaacgcaggaaacgaaaagcgtgaagccaaatgaagtcatttactacaagtaaatttgcagtggcattcgtgaaacagtctatctccatcatttcacctagaactgattataagcgtaactatataattggtggataaaactttaaatgttgaaaaattaactcaaaataattaaaagtatgtttagaattcaaattttcagaacgaatcatactctaattacttcacacgtctcacaacgaatgcatgcacgcttattacaggcttacagtgcattgttagttcttcggatggtgaccggtagtagttcagaaagagaaggggaggtaaaggttaggccttttcaggcagcaaagacgaccaacttcttttttttttctacctttctctcttcctcatcacaagcaaagtcaaactacgagtgcatgcagatatatacatgcaaataaactatttaacctgatgcagctactgccaatcttttactcatacttaattaaccaaattaacaattgtgaaaaaggtcatgaattgttcaacctaatttgtgttctcatctctatgcaacaacccaatcaagctcttgctttgaatatgaatgtatccactaatccacatgaaaaaagttaatgctttaattttcatgtagtagcacatcacctctcagtctcactacttgcattttaatttggccccatgtataaataactaaacatatgatgcatgtacctagatatatatccctatttttctaacaatctacttaccttcctatctagcttggaattcaatcaatcatttttgcttttagactgacaaaagggagaggaattgaagatgatatttgggaccttgacctggtagtgatgattctttgatccgttcacaggctcccatccgtcgtcaaggttcggcgttgaacttgtagtacattgcttcaactgattgtaatctagttaatgccgacaattgacacgttttcatgtaattactgatgtgtttagttgctacgtactgaatctttgtcattttcatatcatatttctcatgttattattttttaaaaaaaaatggatgaaaaatcctgcctctcatgttaattactaccggaattgaactgtttcctgcgaaatcaagtgaatctctgaatatagatggaattaactaagggttgctctgcctgtcatgacgaacaggtgacgcaatatatagctgggcaccgacagtttgtttgattatgtagacgtatgtctgatggaatcttggaatgttttaatctctccctaacggtaggctgtgttggtgaagctgtgtttgcttaggttttgatttgacacggcagcgatattaattcatatgttaaagtctgaaaatatgttcatgatatctacctgattaactaccagctagctggcttatttgtaatggaatatttctctagagtcttaatccgttgtagcgtaaggacatgaaacaactcttatcagacagtatttattcctactctctctgtgcttaaaacacagagaatttaatttctaagcattcaaaatttgtcaaaatattgatttgggattccttatctattttcgtctataaatcaaggtattattaaatgaatcttatcccttcaatatcactaacctaccctcctgataatagtacttttatatcaaccagtgacacagtggtccttttccctctgtactaatttgtcttggaattgctacaaatcaactattttaggagatacaactccgcccccaaaaaaaaaaattcctagctacgaatctgaacacatgtgtatctagattcgtaggtatgattgatttttttttttggacagaggggtaggtggtacagattaagtagtatctgggaattgggagaaatatgcttaaaattggagattggtatgtaatttttctccttctgcgtattaggcacaaatactaaacacattagcattttttttactcttatacatatgacaagatcattattaaataataacaattactacattcagaactaaactgcaaaaaaggaagcctttttcttaagcttaactagtatcttcagggtgctgctagctagctgctgacacaaacagtagcactaggattagtagtgggtctaatttaattactcagagcatccgcaatggtaaagtaaggtgctctctataaaacatgtacatctcaacaatagactagattaatagtaaaccacctcaatagtatgtctacatgggtatctatagctctctcatgtattgtctcgtttttctctatagattatctctaggttagtaaatagctttgctctctctctttatttaatctcttccaagtaggaaaatatgctgacatggatctcttataagagactatagataaccattgcgggtgccctcataaacagggcccaattttgaccaacagttagttacagtaattaatgaactaaattgagcttgttgtaaacgtggacctaatctttctgcaactccaagtccagagactgcctctttcctgcttcatctcctctagctaccaactcatgcgtcaaagcataattatgttaagaattcccattccttttggattccaaccgacgcatcctcctctcctgttcctctcctgctacactttggtcagtcagtcacagcacacacaaaaacaattgcaacttgtgtggtgtttacttgctaacacctcctgacagcaacatgccaacgaattgattgctcaacctggattaacagctagccacatatatatatgcaagtaaaaaaaattgtattttatataatgggcgaatcaaatttcaacctatcccttttcatggatttaattttctgtcccttggttaattttgtaggtggtgatattttctttgctagctaggtctcctttttttttgttcgcaattgggtctaggagagttttcacctagaaattcgttagctgaccttttccttgagagaactatattgccatgacatgcgctctaatagaaccctacttgcttccttgaagttccttccctgcaccttaattctcttctagagggaataacccaacagaaattatttctcacacaatcacaagtagggcttcaacattttggatttttcatgagacaaaaaaatgaaagaaaaaattaaagcataatttgaattgcaggggacaaatctgcaagaagttcctgccccaaaatccacacaattcatttctagattgaacatacatataaacccaatttcttctcttttaaagctccaccattgatcggcgatcggacgacgctccaagcccggggagtcccgtggaccagcagggctggacctaccaaaaaactgaccaccggagcaagctagctataggaagtgggggccagtccaaccagaacaaaactcagcttaggaaaggaacatgaggatagctttgttgcaacaccaccaaatcagccttgtggccttgttgcaaccaaactgcagagaatgcagaatgcaactccactgtggtgtgcctgtctttgtagtttgtaccatatgggagtaccaagcagacccagtagattcatgtccctgtcctcctcttctcaagacactgccatgccaagccaagccaaaccaaagcctaccttctcaacctcaccaactcaccttccctttccacacacatggatggcagtggcacccacaccttatattcctaccccattttgattgcttcctcccctcctctcttgatttgaagcccaattcttctccattaatctctcctccctctcacatatacccaaacacacatgcatatatatacatatatatacatgaatgcagctaactagcatatgtgtctgtgtgtgttcatcagtgatcagtagtgttcttgttcttgttcattggcagctggaggttcttgttcatttgccttagctggaagtgattaaatcagtagccattgttgtttagtggcgccattaatcttcagttatcagtttccattccgggagatcaggcggtggtcagctggcacctgcatgcatatgcaggctcattgattgattcgattttgggaagagagttattagtgatcgatcttggctggatcgattgagcttgatcatccggtggtgatatttctggattcttgtatatttgtgaggggtgtgagctgtttgatcgatgtgctgtggttgggcggcggcgtaggatgagcgacgtctccggccgcttcgtggtggccgcggccgtggtcgccgtgtcgctggccatggcggcggcggcggcggcgcacgactacggcgaggcgctgtcgaagagcctgctctacttcgaggcgcagcggtcgggccgcctgccgtacaaccagcgcgtgcggtggcgcggccactccggcctcaccgacggcctcgagcaaggggtacgtcttcgtctccgtcgccggcgaggcaaaggtgttcgtccggcgcgtcgtggctgaccgccgtgtgtggctgtgtgcgcatgcaggtggacctggtgggcgggtactacgacgccggcgaccacgtcaagttcgggctgcccatggcgttcaccgtcacgatgctgtcgtggagcgtgctggagtacggcgaggagatcgccgccgccggcgagctcggccacgccctccacgccatcaaatggggcaccgattacttcatcaaggcgcacacccaccccaacgtcctctggactcaggtacgtacgtacacgaatacgtatactgtacacatacgcgcacaatacaccgtatatatatcagtgttaaatctttcggtttagtcgatttgatcggacctcaccgaaatgccgaaatttccaaaattttaaacaaaatttagttgaatttaaacaaatattaccaaaattattgtatcagaggggtcggacgaaataagcgaaatttccgaaatcgttccagaatttcaaaccctgatatatatacgtgtatagatataataatggattaatggcaggtcggcgacggcgactcggaccactactgctggcagcggccggaggacatgacgacgtcgcggcacgcgtacaaggtggacgccgagaaccccgggtcggaggtcgccgcagagaccgccgccgccatggccgccgcatccatcgtcttccgccgcgccggcgacgcccactacgcccatctcctcctccaccacgctcagcaggcacgtcctccctctcactactcaccactcactactccaaaaaagaaaatcaaaaaattttaatttcgctttaagctaccttttcctttgcttaatcacctaattatttcgcatcaaaaaaatgtcatgacaacgatagagcaactgttttcctgactttctttttttaaaaaaaattaccacctcagtactaaactataaatatttctgcacgttttttaaaaggtatcattttgaggaacgcataaaagtacttgtatattttaagaatgtagggagtatttgaagagtatgtatatttgtaattatgcgtacaagtacaatttatatgtacatcaccctatccccaaatacttatattttgaactgtagaaagtatatattttgaagagcaggtacataattatacgtaaaagtataattgtatgtatttgtgggtgcagttgtttgagtttggggacaagtacagggggagatacgacgagagtgtggaggtggtaaagaactactacccatcatcaagtgggtacaaggatgagctgctgtgggcggcgctgtggctgcaccgtgccaccggccgccgcgaatacctcgactacgccgtcgacaacgccgacgacttcggcggcaccggctgggccgtctccgagttcagctgggacatcaagtacgccggactccaagtcctcgcttccaaggtacgtacataatacatgtatacttacatttatacatacataaatacgcggtggcggatcagaaccttggaacgaatttaactaaatttaatgcttaaaagaagttatattttaaatctctatattaatattgaaattctgttgcgtatgaaacccgggaatcctttagttttttttattgaaagaaaggttaggaatgttttaaattttaatttatgttgttgctcgctgaaaaattaataatagatatggctgacgcgcgcacgcatgagtgactgcatgcataatcaacctgcatgttttggtcagccatgcagtcagatacactgtagtatacactgtctacagtctactacagctcttctttatagttgatgactgcatctgattagcttaattaattccggcatctgtcagtgttaactgttaagcacaagaccaacggaagatcgaattttccaccggtgattgcgctagctgtaaattgttgacgtatacacatcgcgtgacagactgaattaattaaccaaattattcagaggcattagcatcagaattagcagtagtaattaggtgattgatcaggagatggctaaattgacaccctcttcttggctgacctactctgatgtggatggactgaaaaaaagattgtgtaactgcaagaagccctgcaaactagagccattggagttgcatgaggagcaaggctgtttggtgcaaaggcccttttgcttgttctggcttacaagcatactagctagagctaccatggctttgcttgtgttgggagttgatgcgtggatggatgcaccaccatgcaatgccttggccaccaacaaccccatcttgtagaggaataagcatagcttatagagtcttacaaaggctgagtttgtttgctgaaattttcgatgccaaaacaacgtaagccattagcacaatattaatcaaatattaattactacaaactttaaaaatgtttttttatttttaaagaaacatctatataattttttttcacaaaacatatcgcttagcaatttgggaagtgtgcttatgaataacatggaagtagttgtttcgcaaagctgtgtagaacgcaccgaaagcatatatgctgatttaatttggatttggggcatctgcatttaatttctttgccacacaaaccatgcaactatatacaatgtgtgaatgcatcaggattgatgattaagctgaggagatgattcttctcgcacaaaaggagggcacttaggaaaaagctagcatatgattctcaattcaccccaaggaaagatagtgagatgccttaggaatgatgatcaatttgtttaaataattaaggacctttcatgctgattgttttcctccaactgtgcctttgtcctatgctaaccatttcaaacgtttttccacatgtgttctaggtagaactattcttctggaaacagactgttttcctaaccttggaatagttttttttttctgaggtgtagactgatgacattattggtgtcttgtagaaatggactgccttcctaatgataactccattgaccatagtctttttttccccatgcttagaatacaaggcagctcttaccatgcccatatttcaatattcatccataagctgatcttcctgtcttaccttctctgccatgcttggaatgtgatctttgaagtaagaaaatcagttaattaatcttatatatcctattcctaggcttatagctgctagacattctgctactgtccaatagagttcatctgttattaatgaaaaagttgactggcattgatgtgcatatcttggacttctattgccattagtgaggagaggaaaatgtattttttgagagcttgagacaattctttctaatgtggacaacacaaagtgccatgcatatctgaggtaaacaatattatatcatggccatgcatgaggcattcaacatttcaacaaacagtagttacatgtctgacagcacaagaaaagttgtatatagtggttggatcacaaccagagtcctgacaacttaatcagtaaggatcatgtggcccagattataatagttattatgtagattaatctgccttaataatttaatcgtactgtgagcatctccagataattttgcatttgaatatataacactaaaattcagcctacatgagctgtattttggctaattggcattggctatcctgaaagtcagccatgcctaactgtagagatttggcagatagtttgactaacatgaaccgttaattaattaaaatacatttctctcgatgtctcactttctaattgataagtactcgtatggactcttgtagtacccattttcaacttaaaagtgagtgttgacattgaaataacgtagaaccttatgttttcacgcaattaaaaagtgaatgcatttgtccgatgcagaagaattctctacatctgtaatacattttcttcttcttaaaacaatcactatacctccgcgtttaaatatattacaatgccaattttattcggccaaaacttttttgaaactttgactattcatagttgtcaaaatatttagttttaacgtaaaaataatatgggtaaatttttctttgcaagtatttttataatattacaatattattagattttatcgttatattttgaatactaaaagaaatgatcaaagttgcatgtcaaaaccgaagaaagtgaaaagtactctaatgtatttaaatttggttgtggtattatttgagctctttctaataagtttttaatttgctcacgagaatttaatctatttcgcatatattgatcatatttaatcaggcagtaataattattaacaataattttgtgataatgcatggatggatattggagagcagctgctggtagaggagaagcatctgagctcgcagcagcgcgaggtgctggagaagtacaggtcaaaggcggagtactacgtgtgctcctgcatgggccgcaaccccggcggcgccgcccacaacgccggccgcactccggcgggcctcctcttcatccgcccgtggaacaacctccagtacgtctccaacgccgccttcctcctcaccgtctactccgacgtcctctcctacctctccctccccctcctctgcccggaccccgacgccgccgccgacgaggccgctcctgcggcggcggacgccggcgaggtgctggagttcgcgaggtcgcaggcggattacatactggggacgaacccgatggcgacgagctacctcgtcgggtacggcgaggcgtacccgcggcgggtgcaccaccgcgcggcgtcgagcgcgtcgtacgcgcgcgaccgcgacttcatcgggtgcctccaggggttcgactcgtggtacagcgcggcggcggagaacccgcacgacctcgtcggcgccgtcgtcggcgggcccaacggcaacgacgtgttcaccgaccacgcggcgcgtacatgcagacggaggcctgcacgtacaacacggcgcccatggtcggcgtcttctccaggctcatggagctcgagcggcggcggcgcggggaagacgcgccgccgtcgtcgacgtcgccggtggcggaggatgatctgtagtagatgttgtataagttaggagatgagagaatttatatgaccccctctgattggtgaatggtgataataataaaaaaaatgaaaaaagggaaattttatacattcgtttttgtttatatgattcgtagagggtttttttttcatgttttgaaatttgaacatagaagatgtagggattaaaggaatgaaaaaggaaaaaaagaacaaaaaaaaatcataccgatatatctactcccatcatctgcttgatcaattgctcaatttaatgttctgttgcatttcacttattgtctgtttttttttaaaaaaaatgttgggtttcacaagttttatgtttgaaatgggctgtacgatttgagatgatttgggctctgttctaccattatttcttgggcttgggcttgagcccaatcctggaaggcccaaattgctccccttcggtttctccatctcaatttcaacttctccactgatcacacagtccacccgcgccgtgttcggcgaaatgccggcgccagcgccgccctcctctgcccgctccggcgctcgccgccgtgcgcgtcgctcgagagagctcgacaccctcgtgtcggcgccggagacggcgcccgcgcaggagtctgcggccgagttcaaggagagtagagatttctggccactcctcgacgaattccgtcaactggatggtcattactggccgtctccggccagcggcctcatctgagcgccgacttcgatgcctcgacgtcgtcggaggtggaagggggacgcccccagccacgcgacgcgacgggcccctgagcggctgcgctgggtccccgaagtcgccgcgcgcgtcgtcgccttcgtcaggttcaggtacgcaatttccgcaccttgtggatcgatatcgcctgaacaatgttgctgggggaaggctccaactgcgcagctcacgtcgtttcctttggattcagaagttgtcgtggacatggatgttgtaaaggattatgaaatttttggtagaattgccagggttcatcgctcgttt

SEQ ID NO: 39399 - DNA, 2321 bp, Oryza sativa
gccaattctaataataaccgtgccaggtgggccaggtccattccattgtgttaataacgatcatgagagttgaaacccagtgaacagataatgagacagccttcaaataatgtaaacaagacattcacataattacaaaggtttcaagaaaattgtcatatctgcatcctttctatcagcgtggcataattaagtagcatgtcaagtaatttgtttattgtatcgtagttgacctagtggtttcttgtaccttgactacctataaaaatagcagagtaggacacctgagtataatatgaatgcatcagttagtcccatggatatatatgcatagtctctgtccttctgttagcttcagtgctctggttatgcagttatgttcacaagagtgagcaggaaggatgaacatatgtgcggcaattctcctgttctacatcttgcaatttgtccatggccagcctgatagtcaaggtgtgctgctcctaatttgttcaactctttatgttcaggcagtacacaatggaaagcaactgcggactcacaatgttcacatgtatcattcagaggtatgtttcttgatcatggtggatttactgagaattttggattggtgttttctatccaggtttcataagcatcgattgcggcattccagagaaatcgtcctatcaagatcccacatcaagtataatatatgtttcggactatggtttcatcagcacaggagcaaaccataacatctcctcagcatacattaaaccatcactggcacagcgcaattacaatgtccgattctttccagatggcacacggaactgctacaccctgaggtccttgcaggagggaaacaagtactttgttcgagctgtcttctactatgcaaattacgatagcctgaacaagcttcctgtctttgatctgtacctgggggcaaactactggcatgaggttaagtttagtaatgccgatgcagttaattggatggacatcatagttgtggctcctgctgattacctgcaagtctgtttggtgaacaaagggacgggaactccgtttatatctgggcttgatttgaggccactgaagagtactctttacccagaggcaaatacaactcaatctttggtgctgatcaattccaatcggttcaacatgggacccacagacaattcaataaccaggttagttttagattttgttctgtctgaactctgatttgaatttaactaaccaagttggttctcttaccatcttggttaaaaactgaaatattgccaacatttgggagtacctatgatggctgggtatcttgcggacttgttgaaatatctctatgaactaatgcagatgtatcagttttagtcacaccttgcatgaattgtgtttctttaagctttacttttcaacgatagtatggtcgttttgactaaattcagtgaactagtatactagatcacacaaataatttttcttttgtccaaacagatacccacttgatccccacgaccggctttggtcaacatatgatacgatcccagactggactgagatatctgcaacatcagtagttcagaattacctcactgatgtctatgatgtaccatcagctgtcatgcaaagtgcagcaacagttaatagctcgagaattaatttcacttgggatccatctgacccatcggtgaacatcagctccaaatacttctttgtgctctacttctccgagttacagtctgtaccgagcaatgggctgagacagtttgatattattgtcaataacaatacatggaacacacaaccttatactccaccattcctatttgccgattccttgtctggcaccgtacaggggctggcaagttatagtgtctcacttgttgctacgaaaaatgcaactcttccacctatcctcaatgccatggagatgtacttggtgaaaccgctaactgagtttgcaactgatcctagagacggtatgaatttactggcgcaattttatgttcattatcatcaaattctattatattttaacttcacatgcaatttgcaccataagaggtagtacactgacaatgctacagcttttgtttatcacatttgacatgcaatagtatctcaaaagttttctttgctgattgttcatttcgtatgagcttgatcatttccttgttcttgcaaaccagctagagccatgatggaagtccaacaaaattatgatgtgaagaaaaactggatgggcgatccatgtgctccaaaagcttttgcatgggaaggattaaactgttcctatcctccagctgattcctctaaaataacatcactgt

SEQ ID NO: 39400 - DNA, 3250 bp, Oryza sativa
ttagatctgatttacgtatatagagaaaaagttttcttctatagccttttcaattgagcatactctcttcattttgaataccatggaagcatattcctaatgacaatcactgctttcttttgatactgtcagggttggttataatgcaaaactatgtggcaacgatactgaatgcggatcaggtcaaaagaaaattaaagggtcacttctttctgcaataattattacaatagttgccactgttgcactaattgttgtcttatttcttcttctgcgccgaatgctcaaggcaaaaggtaataaagtcaggaggacagtaggagatatctgcttagtgcattacagattgtttgctgtttttcttgccttgttctaacaatagcatttcttgcatttaactatgttcctgatatttgctaaaatgtgttactgacatgtcagacaagagaagagctgctggtcctacatatgaatcagcattacttgagaacagagaattctcttacagagaactgaagcatattacgaataactttagccagcaggttggtaagggtgggtttggagctgtgttccttggttacttggaaaatggtaacccagttgctgtgaaagtgcgatccgagtcatcttcacaggggggtaaagagtttctagctgaggtattagtaatttttaatttggagaagttgtatgtatcacagctctttcataactcgtaccattttgtctacaatatactgtcaaaaatgcagtttgttttccttacacatgttttttctgtgtaaccatctgtttctgaattctgatgaacgaacaatttcaatatttggtggttttgtagataaattatgctacttactaatcactctcatatctgctatgcttgaattttctgaattttatatttcaggcccaacatttgacaaggattcatcacaagaatttggtttccttgattggttattgcaaggacaaaaatcatttggcccttgtgtatgagtacatgccggaagggaaccttcaggatcatctgagaggttatccatcttattatccaaatatagatgcttatgtagagctttgaccctttgtttgtgtcatgctagtaaaagataaagttggtttatcatgaaaatactgttaatggctaatataaatacaattatacgaacataagttgttctgaggcctgaatggagggagattagctgtctgttatatctttagaatcagattatagagtaatcctacatttttctcaaaggagaattgcaaagacacaagaacagccacggttgctaaatgaaaaccacatagatatattagaaagtatcatttccatggatttctccaaaatctgcaataaactgattatgttcattttctgttgatatgtgaagctactactaataagccactcacttgggagcagcgtcttcacatcgcccttgatgctgcacaaggttaaaacttaactagctactactattaattttcacccggcaaaatactactattagttttctgatatttcattcatacccgcgcattattagtttattacctaataaaagtttaatatctgtgtatctcaggattggagtatctgcatgtcgcgtgtaagccagcactgattcacagggacgtgaagagtaggaacatcctcttgaccacaaatcttggagctaagatcgctgattttggactgaccaaggtattcagtgaatcgagaacacatatgaccactgaaccagctggtacattcggctacttggatcctgagtaactcctctaactctcgtatactgaactttccttttcaatattgcgcgtgaacaatcgcattgtttttctttcaaaatgaaatatcttcagttctaccaagtaactgaacttccatgtcatattctgcccatcttgttcaggtactaccgcaattatcatatcagcgagaagagcgacgtgtacagcttcggtgtcgtcctcctggagctgatcacaggccgccctcccgtcatccccatcgacgagagcgtgagcatccacattggtgagtttgtgcatcagagcctcgaccacggcagcatcgagagcattgtggatgcaaggatgggaggagggggaggctacgacatcaactcggtctggaaagtcgctgacttggcgctgcattgcaagcgagaggtctccagggagcggcctacgatgacagaggtggtggcacagcttaaggagagcttggagctcgagagccatggcgataggaagcacttggtgactggtgatgatgacgtgagcgtgagcaatcttggagaggagactgcacttgaggtagaagagcaatctggggagatatcaagagtttctcctgggcctgcagtaagatgacagcttccatcttacatgcgaaatggaggttcgatcttacatatataaattttctactgtttatcttcaaaaaaaacttaggtttgtgtcgatttcgtagttgtagttgtgaaacttgaaatgaaactttcatttgctccagttcattttctttttcttttctttgtttctactttctatgaccatccatttcgcttgatgtggtgatggtgtccggattttgaagtttttggtgtaagatatattaattagaggctgtccttgtgtaaattgcttgatgcagtacgcaatccaattaaacatcaaacctttgagtaagcttctaattcattcatcccgtgcacgcaactgtcaacaacatttaaacaaacgcaggactgatgcatctgcttaaaattgtcaactcagcaattttatcctatatataacaactcacctatcaactaattctaagcatgcaaacttgtctataatacctggatgtaccaacacacgcagtcaacacccttccatcgcttcctctctctctctgtttttttttaataaaagtcatgctcttgcttaactggaagcaaaatataggttttgtgatcttacaaaaccaaaaagaaaatgctgggtataccagctcacaaattacaacactatcacaaaccaactcccctgtgaggctgtgacaacctacatcaactcagtatcttcaatgacaaaggaaattctgaaacatacttatcatttgtcggggtcttcatccactcattggcctgcaccatatgactctgcaatctcgtgttcaaatctcctacagctctgatctgacatggtgtacaactgtacaagcatacaagtccatgcgcaa

SEQ ID NO: 39401 - DNA, 2240 bp, Oryza sativa
atgatgagtatatctcatacaaggtgagctattagctggctgttcttctgagccacctgtaagaggtagcagagatagctgctagtacattaactgttgactaaaacatcacagtgccaacataaattaacatttcattggaccttgatttaaaagttgtctgttcaagagagattcactacctgaaaagcaaactagatagccaaatatgttaggcactcaccaggtgtcgattcatgttgtgacgtggagaatggcaatggcaggaataccagggctcatggcgaactgttcaccatttgaacattgcacccaaaatgcaatctgctctgtattctacaactcaataaaaacatctgaagtggcaatatgccaatatcacatctgaagtcaaaatatatcaccaaaaatcttcacaggagcagctaccgttcctaaaatgatggaaccgatttccatccctaatgtcaatttgtctcttggtgacatgagatacaaacttgataaaagtatgacagtcaccacatattctaaggttcttcagtatctgtataggcatgcccttaggtgtagcaagaaggcaataagcaacagcaagcttctcactgtggtacaaaagggagctctccttctgctcttcatcaatgtcatggagaacaaattctgtgtcaggcacatagcctgtagcctttaacaaagtgtacagttcttcgagggtagcaactatctcttcaatctgctcatgctgcttatcgccagtgacaaaggagtgcattttgtcttttatctgtgtccagctgcaaccaggctcttttatcacaccttgttgcttcataatttttcgtacctctgcaacttcaccccacatccctagggaagaatatatatttgacaacataacatagttgccagcattcgatggctcaattctgaagagtttctcagcagctcttttaccaatttctgcattcttgtgaatcttgcatgccccaagaagagcactccaaatcactgtatctggctcaatgggcatatcataaataaattgttccgctccttgcacatcacctgttcgcccaagcaggtcaaccatgcaagcatagtgttccggcagaggagttagtccataatcttggctcattgacttgaaaaacttccatccttcatctaccaaaccagcgtggctgcatgcatttaaaagccccacaaaggtaacctcattcggtaacaccccagcagattccatatgttgatacatcttgatggcttctcttccaagcccatgttgtgcataacccgtaatgatggtattccatgtaaaaatatctcgctcctccattagatcaaaaatcctacgagaatctgcacagccacacttgaaatacattgatatgagagcattggctactataagttctgaatccattccaagtttaatagctacagtgtggatttgctgcccaatcttagaagcacctagactcccacatacaccaagaagtatagttaaaattggtgagttgggtaactcatgttcacaaaacattgttttgaaagcccccatggcctcattggattgctcagcatgtgcatacgcagatattatggtagtccaagaaacatcgtcccgactgagcatattgtcaaatgtgtttctggcctcatccaacagatcattctgcacaagtgcagcaaggaaagagttccatgacacaatatccttagttaccattcggctgaatacttgtcttgcgtactccatgtttctgcacttgccatacatagtaatgagtgcattacatgcaaagctattgaactggcaaccaacctttactgcaagggaatgcacttgtgttcctgtctcaagtgccacaatatttgaacaagcaaagaagatactagtcaaactagataggctaggcaacatcccactcctatggagctcttgaagtaaacccagagcttcttcacttctcccattttgtgcataccccgcaatcatcccagcccaagatattgtgttccgaaaaggcatcttatcaaacaactcctttgcctcattaaccattccattctgcatgtacccagtaatcagggcgttccaggacacaacaataggttctggaatctgttcaaataaaatccgtgcatcatcaatcctaccacattgagcaaggcctgtgataagtgcagtccgacaagcaattgattttacaaggtctctttcatagacagcaata

SEQ ID NO: 39402 - DNA, 5099 bp, Oryza sativa
gctctctagaacatcaaggtttccaagacccttaactgctgagagcgcaaacgcaaaattggactggttggtaccagtccttcacggtgcatcttacagaagatgtcccaacccttcctatggctctcgattcgaccgtacccagaaatcattactgtccacgaaaccaaattgcgctctggcattttctcaaacagattccttgcatccaccatctgtagactgtggcaatacccagtaagcatcgagttccatgatgagacatctctgctcggcattgcatcgaacagccttcgtgccatagtgatatccccgttctggacatagcagctgatcatggcgttccacgccacggtgttccgctcgagcattccatcgaacaccctgcgagcctcgagcacgcggccgaggcggccgtagcccgacaggaggatggcgcccgtgcgcatgttcccgccggagatggcgtcgtagaggtccctcgcggcgtcgggcatcccgttgtggcagtaggcagagatcatggagttccaggcgatgatgtcccggcgcggcatcgcgtcgaacacctccctggcctcccccacgcggccgaggcggccgagatcgcggatgcgggcgctgcatccgctcacttcaagctccccgtgggcgtgcctcacggcgaaccgcgccgccgccgacgaggcggccgcggctgagaggcagcggcggagaagcaggcggcaagccattcgcgcgccaccaactgtaggagagagagagagagagagagagagagagagagagtggtggagactgtctctgggggggcacccgcgcctccgagccggagaagccgctggagctcagccccgcgccgccatcgcccctgctccggatcgccggagatggtggtggtaaaagcgtgaattttcttttttttttcgttgctcgtcttggaaaaatcgtactgaggcctacttcgggccgggctgagatttcagcccatttatggatatgggccggataaatttcaggcccatttaagagaatgactatgacatgggctattgggctgggccgagatggaggcaccgacgtctcttggcagacgctgtaactaatgacctggtttggagttactgatgcaacaaggagaaatggaacagatctttcagaacgaagaaatgggtttctatgaaattcctgtaaaatattttaatttatattgctcccaccattctatattacaagatgctttaggtttgtcttaagttatttcattagtattgactaaatttatagaaacaacactaaattaattttattaaatcattagtgaatacatttttataatgtatttgttttgtattgagaatgatgctatttttttctacaatcttatcaaaagtttaacttaaaaaaacaactttgtgtaatataaaagagggagtacgaatcttaaggatttttagcaattacatagaaaacgttttataatttgtttttttaccggctagaggattttacgttccctcctccaaaaatatttttaaggtgcgaggagtagggacggataaaaaaaaaaccattatagggaatcatcttcttcttcctctcgagtcatttctcctcttcctctctttgtttttcgcctctcttcttttatcaatgtgatccagcagggtagcttccccattagcacccacgttaaaccaatcccaccggaggattttgttcgatattaaatatgagcctatgcaaagaaaaatccagagtatgtaagcagcacatttaagtaatatctttgttaaactatttctaaggttttgatcagatctgccacctcaattgataaatatcaatcagtaattgtgttctggattcgtatatatgttcctttttcttgctctgaaccgtctatttaatgattgtatggcattgtgcatgcagtactattaagcatacaaagaggattaattagaggtgtctcttctttatgatcttgctaatgacatactagtactccataatcaaattaacatcaaatcttggagtaatctcctttccaatccattccttgcacgcaacaggcaacattaaatttacaaacatgcaattaatcagttgcatgatactactagtgatgttaacaattatgtttcgcatttgccatctcctaatctgaatctaacaacatcctatatacttaaccagaaaaatccttcactttcctatatgaactgtcagaaagaaaatctttatctgcacacccaaaaaaaaaacaattttctaccgcatacaattaggcatgcttgacacgtgtgtgcacgcgtgcgtgttcgagaaacgtgtaagctcgatctctctgggttgggttgattgatcggtggacgtgtaccaaccttggcatggtctgaaattaaattagtaaatgattaattgatgaaatcagtttaaatctttaattatttgtgattcaagacaacacgtcggcacgtacactgccggtgccagccaaacgatgatggtgatctcctatctttatgaggtgtgcagtttttaaaacagaaccacacaaatataattgaatctggatgagaaaggctagtttaactaatcaattgataagccaaaataattaatatttttaatacattgggaatcataattaaaataatatgagaggaagcactgtgtgtacatattttattataattataattcatgaacaactgaaatggaaaatagaaacaagaaattagaactaaacaaggaaaaatcctttttgatttttgctctttccttccgttgattcctgagaaaattaaaaaaaatggttggaagagctaatcatgcactcgcaattaatggcgcaaggcttacatgcatgggtcaaaactcaaaacaccccggccccatgcgtgtgtcacgtgacaactatgaatgcacattttgtcaacttaaaaaacgtgcatttatacattttgttaattgctcacatgagtgcagtaaactaactgtaatttaaatttacttatgtaggaacacattttcttttcacaaaattactaaatgttgatttaagctgcatcaggttaattggatggacaccaaactgaatctaacccgaggaccatcctttccgtttagcttatcaaccgcagttaaaatttaaattttaaaacttaattttaattttgatttaaaggttttttttatctaagtttattttgtagcattggtttttaaatcactaatgattgctcataaattattttttaataagccaaaggattaaactgcacatgattttacttttttcaaaatgcagagaagcattagatagctactaaactagactgaaaaaaattcaccacttgtgaagatcatatcgcagtagatgcaataaacaacccgtctgttaagcttttgcttagccttgcaataatcaagccctctttatttacgtttaggcttattgatctagacttttaagttagcttattggcttatataatttataagccagtgaatttaatgttctaagtttagtggtggagtcatacatctatcttatacaagccaaaaaaaacttctccaacctaacttttggcttaatagtgttagagtggcttatggtttcaaaaaagccaaataaaaaagctgattgttttgttttggcttagactttttgacttataagttgcttataagcctaaacaaacagtgcctcaatctgctgtgctgacatattttttactctttccacacaagccaaccgtccttttttaattaactttccttttctttacctttttttattctttgtctttatggcacattacaatttaactgaaagaaaagaaaatgtggggctaatgacccaggttaccgaaagtgcatgtcgttgcatctactttctagaagggaaaaaaaaaagcatcacaacgcacacaataaatactacagtgcatttctggaaggaagttgggaattttacttaagtgactaattctttttttgacaaaaccgctcaagtggctctaatattgatatatttgtaccaatttcgtgctcaaactataagaaattccattgaaagatcaggtagccagatgcatattctttctggtcacaaatactagttgctttatgcatacttcctatcataactttggcataaacattttttttgaaattatttagattgcatccacaaaaaaatatatgaggacttatccagaaaagtatatacacgatatgatattttaatggttctttcaaaaaaaaaacaatcgagactagtgaaatgtcactcagaagtctatgtcgttattaatacgacaagtatatatttgtggattgaatagtattttgtgttaattaattaatgtaaatgcccatccaatgggagacaatcatcttgacctccgcatttaaacaaatctgagtggaagccacgagacgaattaaatagtgccattttggtttagttaagtagcagaaactaatcatttgcacaactcttaagtgatagtacttgtgttttttttcttctttccttgttttgttgatctgaaacctgatgtgttcatctgccgaattatatatatatatatatgtaaattctgacgtagtactgcagcgaataccatctaacacatgcataatcaatactactactatactttttactactgcgtaatcgtacactgtgttatgataaatgaatgttttgtctccggtagttgaaatgttatcaacaatttaaagggacgttgaatcaccaacctcaccagccatgaaaccagggaatcctccataattccattccaattcaaacccctattttctactttatctttccctaaatatattcatattttagattgtttcctaaggactaaggttggatcaaaagattattttaaacctttcaattatcaatttttaatttttaaattgcttagattatttttcctattggctatgggactattgaaataatgaaattcacaagaatcaatgctaaaatgcttatattatggtatacaaattaaattctaaaaatccttacattctaaaacgaagataacagtttgtaaacttcatat

SEQ ID NO: 39403 - DNA, 2638 bp, Oryza sativa
  unsure (1)..(2638): unsure at all n locations
ttcctgcaccccccctcgggatctgttgacataagggaaatcagatttgatgaaatagatgatgaatatatagttacaggagcaatgcccggcattgcagcatccaggaggatcgccagtcattacaggtgtgtgcatataattttatttttcttgctttctgttgctattaagaggttatattgccaaaaggacatacacttcagctctcaaaagacttgaccgtagccgaaagctgatatgaacgcatgaatacgcatgtcgacaccaaatgataagatgcgaaaataggcagagttttgtttgacattcttccttgagaaaaagtttattttctcactaggaaaataggcatagggcatgagacaatcactaggaaaactctattttcaactcttgagagaagtcttgagtgtgtactttgaaaagccagcacaattaacacaactcttgtttgagctcgacactttctgatgcgccttctactattattgatctttgcagggatcctagatatggacgcagacgttcatactactaggatgaaccagccagctgaaatgtaatgcagtgcagccacaaccagaatattgtgcctctacccgcctctttttcttgttctctcaaaaatctggaagatgctatcccagcccaaatttggtgtgcatataagatagcagcaaacccttcattgttgttcatttacagcaggtttcaacatcttaggttcctatgtaaatatgtaaccactaccctatagcaatgttgatccaaggtttctctccgggaatccattttatcttaaaaatgtttctctggaaatacaccaaacttttacaggaaaagctcacaaatttgccaagtcaatttgttctctctgctatctctctaacacgataattgtcggaaaattcagaattttgctgatgtttcacatggtgacacaagtgtgttggattgtgagaagcatacgcatgacaggaacagcctgattgacgctttgcttctgatgctggttttgtagagaagatttcgtgttggagtgtgctgagatttgtaaatgattttgattagttaaaatgttgcttgttgcttaggctgttcttctcgcgaatggcagaaagcattcgtgctaaatcatctaaccgttgttttgctgggttttcagagctttttcgtgcaggataagaactgctaatgttgtcagaatgctggttgcttctttggcttatctacttgattctggttgacttccattagggttgcgtcaatggctttaagatgcctgccttgttcaggatgtgcatcttaatctttatttagttcttaccgtctttgtcaatcataggtaaggaaaattaagacccaaaaacatgtgaacatatgttgacatttcaggatatcagcaaaatctccataaacattggcatattaatgtttaattgctgcaaaagacagatgtttgtatggaagcaaaatctccatgttttccaatgatcaatccaggtgctttcagctacaatcaaagttacaaaagtataaccgtgtggtctatgtgaacagacattgtcatcacaatgtttaaagattaaacatacaacacatgtgagagaggagagagaaagaggggggggggggtgatttctgcagatatggtgtcctttggtaattgacactaaatgtattgccagagaaaaaaaaatggtgtacaactaatcgaacagttttgcatgttcaacaaaagatcgaacaatttatcagaaatattggatcagtacagcatcatcactatcattttggcctttgaagagcatgcttgttgcattgcatcagagcttccaactatacaattccagatccttttggttgagtgtaggaaacatctgatgagaacaaacagataattattaggttatgggtgataattattatctattattttgtagtaggccaaacaaatagcgacgcagagaagcggtgagtaaccagataagtggatctactacttgagactagtcatcatctctttccaaccaaacacaaactacccttccaaggagaataactcactttgcttgcacatttcaattgtgtttctgtgtggcttcaacggtgaaaatgtccaggcttcggtcaaatgaaaacaatagcttctctctgtatacatcatcacttcaatgaagctggaagcctgctggggacttgacttccatcctcagactaaagagcttaccagagaaagctcatgcagttcagttagtgtccactcctctccagtttgtcctccaagaactatcgcctttgtacctcccacaacacaggtactgtggccccaggcaaatcgcggagggcggccaggaacattcagtatcctccaggtaggcttctcttcagtcggatccagcaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39404 - DNA, 3048 bp, Oryza sativa
  unsure (1)..(3048): unsure at all n locations
ccatgcttagttcaactagtgcacaatggggaaaatcctattaatgtgtagactgttggttctaatggtattgttggattagtgccaccgctttggagttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgatgcatccaggcaagggtgggcgtgatgaagtggggcgggtcctgcgacggcctctgtcgcttccggattcacctaggcacgagaggggactacccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgtcgcaacgtggtatagcattggacactggatgaataatattgattaattatcacgactgttttcttctttaaacttctgtttataaatgctcgctttatgcaaatgaaccactctagctctcctttgataaatccctgcatcatacccctattccggtatgacttgctgagtaaagtgggtagtactcagtcttgctctattttccccaaccccagagtacgagtatgtgtcagatggtggtttctccgaggagtaggcttcgtccgtgccgtcgaggatgcctgtggagtggtgttcccgctgcagttcaagtcaaggcttagctccagttatctttcgtttttctgctgcatttatgtaagacttttatgatgtttgtaagacgtggatctgaatgtcaacattgtcgtttgtgtaccccggccggtcctggacggggattttaatgcacattctgcttggaattctactcaggaatttctgggcgtgacacaaccacactccacgacgaatcaggtaacatatttaaggtaaatggtcaacgcctaaagattttccttgagccaaaggaaactttagatgaagaagtggatgttattgaattaatcgattatgaaccatgatgattattgtcggtccttaaatcataatatttgaccgtcaatacctacatatagtgaattaaaacatggtatccaacttagtggtagggattattactaatcatttccactagtgttggtgaaatatgtgtatgcaggtattttgagaagaaaacacatccgtcatgtgacaaaatgcaccttcgcgtattcaggatgcgtttacacggattagaggcccaataagtcaataaaaatcatttagaattgggtcaaaacatagcccaggttatcgggggcccactaagcaacctcccagcagaaggagaggccgggaggacactttttgggttcggccgaaccaaccagttcaaccgaacctgttctgtggccgctcatcgctatcttccacgtgtacactcctgatcacgtcccaatggcagttccagggcattttggacatttcgcataggctgtaaccgtcatacctgcctataaaaggaggagctcactctcattctaagacacacaactttgagctgaattacaagaggctctattgtatctattgtacactagaataaggtagagagtgaggggaagctctggaggagtgccctgaagtttggcgcttatccgacttctacctcgacgagtgtagctgtcggtacactctcctccaggttcggagtacttcttctattaagtaagcattcgtgttcctttcttttgttatttaattatttagtctgagtaagttatatttccatctttgcgagttcattgtttagtattcatactaagtgctctattactaggactccggatagagaaggaagttcccgcgcaagtattagagtagtaattaataacttagacatggtgtctaggttagagattacctttgtttgttgtgtatcccacggatttgtcagaggtaagcggcaggtggtgacagccctgaattccgtcccagtaatcctccacgttcggatatatcatagagctatagccggaaccacgctggcagaccagcaggggtcggtgcccgaagcaacagataggaatttacctttgcttaccgtgcataattaaaacacatagaaagtcctctctagcctagcctacctatcatcatttgttgtccttggatagccttagccttaggtagattacacacattccctgagttcgatatcctttaggggttacccgaaggtgaagtgctatagcggtattccgggcgcttgcggatttatctgtggtcgtaagaaataccaacaagcatttctggcgccgttgccggggaacggttgctaatttatccgagtctatgtcatcctcgtatctttatttttatttcttcttcttttattcctttccttgatggagcaacccacaattcaaaacctttatgctcctcgggctgatctttgtgagccatcctgttcttcaaaaccaatcctttccgatggctacgaaatcggtcctagctttatagccatgattcgagagcaaaccttctctggtagtatcagtgaaaacccatacatccatcatcgggactttgagctagtgtgttcaggcctatccatcgtaggcatgacacatgaactgttaagtggaaattgttcctttttctcttagagataaagcgaagcaatggtacacnttctgttctgtcccaagaaattcccacggtgaatgggaggagcttaagtgcaaattctaccttgctttctttccattaacctgtctaattaatcttcgattagacatcctgatctcttt

SEQ ID NO: 39405 - DNA, 4167 bp, Oryza sativa
tttaggatagtatgcactttcaggtattcttggttgctaaccattttaggttgaaattaagaacgagggtcatgcgatgcctaagaacacggtagctacatcaactgtacactttggtgatccttggtattggaacacactctataggagaatctgacatcacacacttggtttttgttgtcttgcgacacaaaagtccaagtgggggggagggggggaaaggtcgatgagcttttcatgacgagttccatcaaccaaggccatcttggtttgaagatggtgttagtcctagcttgctagaaaaaaaggaagaaaataaataataaaaaaaagaagaggagaaaagagagaccgaagaaaagaagaaaaaatgggaggagaagaaaagagcaagagagctggcgagctacatttggatcaaagaccgcattatgtgcgtgtcggctatacacctcactagtagcaatcatgctgcctggctacacctagtccctctctcaagctcatgtgccgccttggctcagcctatatccactcctagctgtgcacaacctttcgctcccgcagcacctacgcgcatacaagcaagaggagatgccctcttctttaataggtgtttgctgctccatttcagttggcacttgcacatttgccaaaaagagatgtatcctacgtctctacagtattgtgccaacggatcacgccttcaagacacaaggttcttgcacccgaggtgtgtgcatgaccaaattgcttgcctgagttggcatggtcaaaataccttcctccggtacaatctgcatggagatggaggagaaatcgccaatcatatgtgaccatgccactgcctagagatttcaaaatatacatcatgctggaggtaagtacactcaggtatgtgaaagataaaataaggttcaccattccttttactcatacttatcttcatttgaatgagacttgatcatacatggttatgtttcttgtgtctatttgcatatgctctgttttagatgttcgtgcaagacatctataggctttttaaattaagcatggtgcttaggttaaaatagtctgctttaatcaaattagacatggagtttagtttgactaatgaatttcagagttaatatgttcatagacattggatatatatcttctgtggactaacccctgcaagaaagttttcaaattgacgagtgagtcctcaagttcaattcacaatggaggtagatcagggtcggaaacaaatcaattgctaacatacaaaggagacacatatcacctatcaaggtgcacggtgcgtatattactaattactcctttagcatgttcatgaaaatttacctccgccctgtatgagttgtgcttaaacgaaaatttggtgaataataaaaaaaaattgaaaaaaatatgtttcagaataaaaggattgtctctcgaaaaataaaataaaacgatggcaaatttgtgggatccacgcttcttatgttttgaatccgatttctttttagcatggatgtgaacaattaatcttgaggctacaataaaatcatttcaaatcttcacagtgcttcgagtatttgttgtccactaaccttttgcaggaaataaaaagacgatcaaggagcagtgtacagtaacttcaacacttatatcacgctccttattgttggtattccttacgaccacagataaatccgcaagcgcacagaataccgctgtagcacttcaccttcgggtgaccccaaaaggatatcgaacgcagggaacgtatgtaatctacctaaggctaagactatccaaggccaacaactgatgataggtaggctaggctagagaggactttctatatttcttaattatctaagctaagcaaaggtaatttcctatctattgcttcgggcacaaacccctgctggtctgcaagcgtggttccgattatagctctatgatgtatccgaacgtggaggattactgggacggaatttagggctgtcaccacctgtcgcctacctctgacaaatacgtgggatacacaacaaacaaaggtaatctctaacctagacaccacgtctaagttactaattactactctaatactcgtacaggaacttccttctttatccagagtcctagtactagagcacttagcatgaatactaaacaatgaacccgcaaagatggaaatatatcttactcagactaaataattaaataacataagaaaagaacacgaatgcttactttatagaagaagttctccgaacccggagcagagtgtaccgacagctccggtactcctccagaattcctcttaggaagctacactcgtcgagggagaagtcggatgagcgccaaacttccgggcactcctccagagcttcccctcactctctactttattcgaatgtacaaaagatacaatagagcctcttataattccgttctaagttgtgtgtgttggaatgagatgaagacctccttatataggctccaaatgatggttaggggcatgggaaatgaccaaaacaccctgcaaccaccataggggaggaatctaagccatccacgtggaagtagacggtgaacggccgcagaacgggttcggccgaacccaaaaagtgtcctcccggcctctcttttggccgataggttgcttaatgggcccccaataacctgcactatgttttggccaaattctaaatggtttttattgacttatggggcctccaattcatgtaaacatgtcctgaatgtagagaggtgcattttgtcgcatgacggatgtgttttccctcaaattacctgcatacacatatttcaccaacactagtggaaatgattagtaataatacctaccactaagttggataccatgttttatttcactatatgcaagcattgacggtcagatattatgatttaaggaccgtctacaatacccccacacttaacctttgctcgtcccgagtgaaggctatggactctacaatagagttatgacttccttactaataatcatgcaaacaaattattcaaagctatacctgtacttgtggatctttgtagtgtctaccatgcaatcctaagcaattaagaaatggaacaatcttgactcaagtcaccctaacttttcgtgaagaacaacttggggtttttcatgtaacacaaaattatagctttgctttgctcctccattgattctatcgatcactcaaggtgtatgattcctcacaaaggcatatgattgtgccttttcttttcctaccatctagtaaggcttatgtgaagctcagggtatggaaaagagtagagcattacttgcatcacatatattgcaaagtaaaataatggatccacggaaatacaagatatactttatggatcaagaatgtgcacgtgtatgtgtatggtgaatttgtgggtggaaaacggaaaataaaagtaactccttttgtatacctcctcctccatttattttctcttttgaaatttaggagagtacatggctatctttttttttctttttctttcttttttttttctcatcatcttgctccatacttgtatgagcacttcttttttcttttttcatagccatgcctcttatcttttttttaaagaactttggaggaagaggcataaatgatatggagtatttattttgtggaagatggatgaaatcgatgacaaatgaaagatgctaacttctagtgtagaagtcaagcattggtgggtgtatgtggaatttgtgtgatcttgaccatgaaagtatgaaaagtatttcactagggtcacaaaatttgacaacgctcaatgtaatgacaagcagcgtatgtagcaagctaatcatggatgatcaacctatggctctagtgggaataaaaaatatcaatgaggagtttagcatcgttatattttttttatataaaattcccaagtgtgcaacatgtagagctggatttctatcatcagactatatcttattcatcaattacctagatagcatggggtccctattggatatatcaccacaagcaacaggtaatgagcaaagaaaaataggcatgcatgtcattttcagggagaccatgaactctagttgtaccatccctagcttgagttcacgtggaagcaaacagtgaacggccgcagaatgggttc

SEQ ID NO: 39406 - DNA, 42163 bp, Oryza sativa
tgacttatggggtctccaatttatgtaaacatgtcctaaatgtgcagaggtgcattttgtcgcatgacgaatgtgttttctcctcaaattacctgcatacacatatttcaccaacactagtggaaatgattagtaataatacctaccactaagttggataccatgttttatttcattatatgcaagtattgacggtcagatattatgatttaaggaccgtcaacacttatccatgagaaaagagatgcacatggaaccaagtagaacaaatgcaaaacttgttgcatccttgcattcggttcgaatcctggtaagacctatctggtaagaatcttagacactatgtgcatcctcatctcatgtctccatcctgtcaggatacccaccatatccattgttgccataaaaaataagaaaaaaaagaaaaataaaataaaataaaataaagttggctctttggtcttccaaccaagtgagtcctttttgcttcattcgtgtctttgtttttctttttgtgtccaataaagagttccaggtacaaagacaagtgtgggggtgatcttgcacatcaacgccataaccaaagcaagatcactccagaagtgacgagccatgacgaaccacacagggaaattgatgcggccagacccaatgaatcgtcctctgttttatatagagcgtaggtttgcacaatttttactttggacatccattctatcttgagtttaatttgattaccaattctaaaatatcgaagataattgaactcaagctagggatggtacaattagaaatcatgatctccctgaaaaataacatgcatgcctattattcttagctcattacttgttgcttgtggtgatatttttaatagggatcccatgctatctaggtaattggtgaatgagatatagtctgatgatagaaatcctgctcttcatgttgcacacttgggaattttataaaaaaaaagaaaaaaaaataacgatgctaaactcctcattgatatttttattcccactagagccataggttgatcattcatgattagcttgctacatacgctgcttgtcattacattgagcgttgtcaagttttgtgaccctagtgaaatgcttttcatactctcatggtcaagatcacatacacttcacatacacgcacatatgcttgacttctacactggaagttagcatttctcatttaccattcatttcatccatagtccacaaaataaatacttcatgtcgtttatgcctcttcctccaaagctctttcaaaaaaaaagagagagagaggcatggctgtgcaaaaagaaagaaaaaaaagtgcacatacaaccatggagcatggtgatgaaaaaaaaaaggaaaaaaagaaaaaagcaaagagaaaaaaatagccatgcactctcccaattttgaaaagagagaatagatggaggaggaggtatacaaaaggagttatttttatttttattttccgttttccacccacaaattaaccatacacatacacatacacattcttgaccagaaagtatgacttgtatttctgtggatccattatttgactttgaaatatatgtgatgcaagtaatgttctactcttttccataccctgagctccacataagccttattagatggtaggaaaagaaaaggcacaatcatatgcctttgtgaggaatcatacactttgagtgatcgagagaatcaatggaggagtaaagcaaagttataattttgtgttatatgaaaaaccccatgttgttcttcatgaaaagttagggtgacttagtgaagattgttccatttctcaattgctcaggattgcatggtagacactacaaacatccacaaatacaagtatgactttgaataatttgtttgcgtgactattagtaaggaagtaaggaagtcataattctgttgtagagtccatagccttcactcgggacgagcaaaggttaagtgtggtggtgttgttgacggtccttaaatcataatatttgaccgtcaatacctgcatataatgaattaaaacatggtttccaacttagtggtagggattattactaatcatttccactagtgttggtgaaatatgtgtatgcagttattttgagaagaaaacacatcgtcatgtgacaaaatgcacctccacgtattcaggacgcgtttacacggattagacgtgcaataagtcaataaaaaccatttagaattaggccaaaacatagcccaggttattgggggcccactaagcaacctcccggccgaaggagaggtcgggaggacactttttgggttcggctgaaccaaccagttcggccgaacctgttctgtggccgttcatcgctatcttccatgtgtacgctcctgatcacgtcccaatggcggttccggggcattttggacatttcgcataggctgtaaccgtcatacctgcctataaaaggaggagctcactctcattccaagacacacaactttgagctgaattacaagaggctctattgtatcttttgtacactagaataaggtagagagtgaggggaagctctggaggagtgcctggaagtttggcgctcatccgacttctacctcgacgagtatagcttcataggaggaattcgagaggagtaccggagctgtcggtatactctgctccaggtacggagaacttcttctattaagtaagcactcgtgttcctttcttttgttatttaattatttagtctgagtaagttatatttccatatttgcgggttcattgtttagtattcatacaaagtgctctattactaggactccggatagagaaggaagttcccgcgcaagtattagagtagtaattaataacttagacatggtgtctaggttagagattacctttgtttgttgtgtatcccacggatttgtcagaggtaagcggcaggtggtgacagccctgaattccgtcccagtaatcctccacgttcggatatatcatagagctatagccggaaccacgctagcagactagcagggatcggtgcccgaagcaacagataggaatttacctttgcttagcgtgcataattaaaacatatagaaagtcctctctagcctagcctacctatcatcagttgttgtccttggatagccttagccttaggtagattacacatgttccctgagttcgatatcctttaggggtcacccgaaggtgaagtgctacagcggtattccgtgcgcttgcggatttatctgtggtcgtaagaaataccaacaatgatctcatctattgcatgcttaaaaccctgtatagttgtcattattgtgcttagaataggttttagtgggcctaggaagaaaattgggggcctgccggactcaccagggaaccagggcagtgcccgatcggccccgaatttgaatgctagtctcccccgctcgtccctagtctgtttagatgcgcgtgtggaggtagaacgttcggatcacaccagaacacttcttcttcctcctttcctccacatttgcacactcccctctccaattcaacccaattcctcgaatttccactcatacccactaatggctggcaaatccctaatcccattcattggctcctcctccaattccacctacaattttgatggagagccgacactggcaaatcaattgatcccggtggagcattacacgatggaaggggtgaacacactatgggcgcagcccctcgcaacagtgccgggttcccctgtgaatctggagcccgtcggcgagctccctggttcgaccgaaccaggggttcggcagaacccttctcggccccaattggccccccgttcggcagtgcgatccctctcccctcgccatgttacaagaataaaaatccagggggattcgcctgcgtgacggccgacaacgggagagctcggtctcttgaaggcacgacgcctttttcaagatgatgggaaggccgcgccgtctcccgccgagtgctatgtgggcaccctgttcaccaaggcaagggatgaggtgctccacaagtacaccacacccaccgctactccatccactccgaaggaggagcgattccgtattcagggagtgcgaactaccggcggtgggtatggtaagggtttactccggcttttgatggcatcggagaaggagggggcagcggagtcccgtagccctccacctatgaaggtgaagcgtcatttgacgccccctccaatcgtaagggttcccagccaattccaagaggatgaggtgaaatcgccggagccctcgatccacaagctcgccgctcaagtgaagaaactccgcaaggagaacatagagcttaggaatcgcaatgcggagctaggggtagaactttctgaaattagaaatgatttcgatacccttagttgcggtttgtgcgctaagatcaagcgtgcattcatagaggtgggaaaggaaaataagtattatgctaattggatgtttcctttcccatgaataaagtagtagtaggtgcttggtttttatctttccaatcatgtaagcacttgctataaataatatggctcattggtgttaaccccaatgtttcccaaagtttttttttgttttatgttcaataaagttcaggttttgaataagtgtgggggagatatcccagcttctggcgtgcatatactctgaaaattgctgaatatttgaacacctgtgttgacggtcgttatcgatcagtttcgaccgtcaatattaccaaaataaaggagaactagtgatgcttgcaatgcgtagatatgttagaataataatatttcactagtattaggtttactaacctttcgcagagaatgacaataaagtgaaggagaatcgacatcaacacagacgataaatcaatcggatggtgtcgagaaccagacttatgtatgaatgggccaagaactcagaattgacatgatgaattgggccaaaattcacaagttctacgaacaggagcaacagaggaggccgccagctcaaatttggctgtattgggccggccccaggttcggccgaacctggtggttcggccgaacatcccttgcctccgttggatccaggttttggctggacggttgagatgaagccccaatgactgttggagggtattaccgaccattccaaccgtcacaaccatcatagttcagctataaaaggagttcactcgcttcacttcaacacacaccttaagcaagagctctctcattcctctcaagtttagtttggtagtatctagctggtggaatagaattagaataggaatcaagagtccagaagccttcgaaagagttcgggtatggctctagtagctttcctttcctcttttgtaagctttgtacttttattagtatactcttatatatacatttatggtattgaaatactttccgagtatatgagtacctactttacattatgttcttgttatactgaatatacggctagcttatctgggagatgctttggtgcgggtatagtgtttgcttatgcaattactctatgtcatgacgatgatattagagtagtatctggtagtttagacgtggtgtctagattacgggatatcattatttggggttatatattgcggatgagaggtgggccgctgatggtgacagctcagtacggatattcctccgcgcctatatataatcctaagttaatttcctggggagggtattcctctgtatttagccccggttggatggtcatgacgagctgtcgtatggaactcggcagtcaggggtggcttctcgaagtaccaggagggcatcggatagagggtattagctagtatatcagttaactagaatgtatgtatactatgtatattagaagtatagggatagatttcttttctcttttctttccacctagcttagattatttattatgaggatgagtagaaatgcttgtgtgtcactctacccttggattatcttaaccccttcttagaatatgattatcacaagtaatatataaattattagttgagttctctctgcattatcttcccatgagataaaataaatacgatacccttggaatactctcgggtgaaatgctaaaatggtatatccgtacgcttgcggatgaactctgtaaccataatataccaaaagtatttctgcaccattgctgagaattatatttctagtaatgttgttaagaaataccaacaacctggaaggcactgaactctgcagaaaattgcagagggatcaggcaccagagtggttcggccaaaccaccaggttcagccgaaccaaagctggccccaatccctctcaattttcacaggtaagcaggtgagcacgttctttatctatatatctccaccatggtatagtactagagctgaaaattcagaaaacaactggttcgagcataagtgtaagataaaatttccaactaatgaaattcttcatgtgaccgatcttgtatattcattattctcagctgaacttctgcttgtgaacaaccatccatgattagggaaccttatacatctaaatgattgctttatgagagatgattaagatgaaaggaatccttgcaactttgttatgactcttgggaatttattttcaaaaataaaattgttttaaaagctccatcctccaattgactttatcttatacctaccaaggccatatgtaagtatatcattgatcaaccttatcatgcatatgactgcttgacattatattgaactttgtcaaatttgtgtgacttgtgttagatatctttcatactctcatgatcaaggggtcattttcatttccactttccatttccacatataaaattaagctaagcttctacactggaagttggctctccacaaaaatacccattcaaataaactcttacattgaactatgctttcttctcctggaaaagttcttggcaaaaagaaaatgagaaaaggagggaaaggcatggctatgaaaaaaaaagagaaaagaaagaagaaggaaataaaatttgctctcaagacattgagcaaagtgcaaagaaaatatagccatgccccttccataatcatgccaagaaaacaaaacggagagaaagtataggaaaaaggagaatcatttctttattccatcattcgacaacatattttactttttcaccatgaataaagacccttgatctaggagtataattgatgatattcttgagtccatatttttggcttggcaatatatatgatgcaggtatgtcccgatttatccctaccaagctccatacgttagccatcataatagggataaattctggcacattttgccttggtgaggatccaaaaagaaaatatacatctttgagagacaagagagaaagtcaatatgaggaaaagagctagtttgcgaaatttcataaaaatcccatgagtctggcagagaagcaagaaggactggaatcaagatcgttccatttatcaattactcaagatggtaagatagccacttataaagttcacaggtgcaggtatgggtgtgaatgatttatatgcttgattcatctcttgaaaaaattcattctacactaacctttactcagggacgagcaaagagctaagtgtggggggttttgttggcggctgttaaatgccgattctataccgccaacatctgcataaagtttagataataaaacattcaacatagtataggtgcttaatctcacatgttccacaagtgttggtgtatagttgtatgcagatgataaaccctgaagttgggaggaaatttagactaaagtgaggaaaattatgtatccatacaaggaggggttgcgaacttcatcgaaacaccagtggatcaacccaaaaatccgcgaaatggatagaagaaggtacagggagttcaccgaccgaaggccaggccaggagggcccagcccaggttcggccgaaccaggggatcatcgttgatcctggggtttagcgtggacgctcctgatgttctcccaatgacggtttgggggcagttcggacatttccccttctcataaccgtcataactgccctataaaaggacctcacttccaagctcgagctgaattataagaggctctattgtactatattgtatactagaataggaagagagtagagtagaaggagtcggaagaattccggagttgtcggtaatcttctcctatttcttttattctgtttattactctgaattcaatatattcttcttgagtaatttagatttatcttgtgagaattatctcttggttagttcctaaatagcatacgggattattgttcactataatcaactaaaatatagtgattgctttggtgagttataaacactaaagtagatattaattgcttagacatggtgtttaggtaattattatccagtaattgttgcgtatcccacattacgtttgaggtgggtgtagaggtggtgacagccctcgagatcacttaagtcctccctgtccgggtacatagtagagcgatatctgggaacagcgggttgccagtgcctgaagtattgcgttaggattaaaattaagctttccctagacactgtttctcactagtgaatcatctctatcctagcctatcaattgcttggtgtccttggatgaaccggaggaagatctgaccacacacgttcccttggattcgatacccttggaatactctgaggggaagtgctacatcggtatatccgtgcgcttgcggattatctgtaaccgtttcaaataccaacaccatgttcaaattgtgaaaaaacaggtataatatctatagctatgtattatacgaaaattgtagttgtaatttatttattattaccttggaagcatcttgtttctttccttaaattaaaaggaaaaaaaatatcccctctagccatctgtcctgaagtgtgaacaacatactaggttgggataacaattccttgaaggtcttgcattatttatactgtgggttatcagtaatgggccacaagcaaaccccatcaaagatcaaccttcatcgatgatgggcttcacagttatttttgtcaggctgttatacctggcccgtcaccgatgaccatgaccctcatcggtgatggattttcgttgtggcctattatcaattatcttggacagaccgcaacaaaaccccatcactgatgagggacgggcctggccccgaggactcacatactgcctctctcggtgcctatgtgatagagttctttgaggtctgataaagatgaatatctctataacaggccgcacgactccatcacagattggtcgatttggatgtccggtgcagttttgtactagtaatatcaacattataattactctagaggtgtggttagtccattgttccatttcttattatacctttctgttccagtttaacctgactgcaatctattttgttttaattgctgctccttcatgatatcaaagctcggttaaccgttacatatgaaagaaatggatgaattatttaatgtggtgcaagaattttgtgatattgaaggtgttccagttccaaacatgtacgaagaaatactggtaagtaggggtgaaaacggtacggaaatttccgagaattccggcaaccgtttccggtttgcaccgaccgtttcaatcggtatcggtaattgtcggtatcggaaatggaaacggtaatctctttcggaaatggtagcggaaatgatatggggttttttccgaccgttttgtcggtaactgttttttatcggtaatttccgtcaaatttccgacaaaattccgaagaaggaagtcggctaggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgatgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctactggtaaggggtcattcgaggccgttaactagagtgacacattgaaatgccacaattcatctaaaatcacaaagaaccgaataactactttatttgcaatgttcgcattgttttattagtgctctcttgacatcgtggagtaattgcgggtttggtaaaactaaaattttgctgaaagaatatgtagcgagtattaatttaattagttgatttcccacgttttgcttgtgggattactaattagttttgaatatgttttttttttgttaacaatcgagttaggagaaaaaggatattagttattaacaactggtttgtcaaaccatatctcaagaaaaataaatttaatagatcatgtagcagattgtagatgaaatattaaattgttgcgtaagatttgcatcgtaagaagcaagaggtaggaaaattgatgaaaagtttgtgtttaattattagtactaatcacgaaacaaaataaatgatatacctcactttgatgggagatatatggatggaaatatgttaagtattataaaaataatagatatctatgttaaaatattgtggaaatgatacgagggggtgttgattggatttgcttgcatattgattcgtagaatttgatacaatatagatgatgtgcatgcttgcattagctttgatatgtaattattactaatagatgatgaggtggtatgtttgtatgttaagttttaggcttagtgggttgtaactatataaaatgtacagattagaggccgaaagtcagacaacgacaccttgctcatgtagcgcctattttatgataatgatttcattttaaatgcattgtttcacaaattatcatttctatcagacaaaataaacaacagaaatagacattaatatccattccatttatcatttctcgaaaagaaaacaaagattacaacgacacgatgcagttgctgtcttaagcctagttaaaacacccccttgtctccacctagccgatccaccgagtcctaagagagcagtgaagactgtctgctcggcgccatagaacacagtagacgaggacgcgttgcggcacgagaacagaccggcgagcgaccgaccatggcgtttgctgctctggcctcgctcgctatggttgccagctgctctgccacgggtagagctgctgcggcagttgacgtaatgcagggaatcacttctgccaagcgtgctgttcctccttccttgacccttctgtcttgctgctccgtccataatgcagggaatcacttccacaaactgggagggcctgagcccacctaggatcaatctgtattattactttctgttttgacgccatacactgatccttcaattattttcgggtcttcttatgtgtaagcaaagaactcattagcagattcactacgactgtaaaaagtgaaaaatgcgtgttacttcagaaagcatgaaaaaaaatgtaagctgcaatgtgttggtaatgttcgtgggtacaaaatatgcagacatcgatagtcctgcccgttagtatatttcaaactttttcagccatagtaagtagagctaatagcatgcggcccaacaagtgagatggacaagttcctattgaagtatttcgaaatgtggttgtttaaatctttgattatggaaaaaaagttgaagttccccaacactgcaatgtgctcatctcaggttaaaggtacagtaagaaataaaggattgatccacagtcagcatttgatttagcctatttgacatctcgaatcagctcagtagaagaaaaaagaaaaggcatgctgctgattatgtccagacatttaatatttttttttcactcacaataggtggagaaaggctaagtatgtgacacagccgaaataacccccccaaaacctctatgtttctgagggcaagaaatagttaagaaaaaaaaaagaagaaacagagttcatacatgcaagcattacaagaaaaggagtaccaatacaagtaagaacggctagattttggaggaaatacttataacacaagcatgcctttaaaaaatcgcagaaaaaagtgcacgcaagaggaagaaagaaagacccgttcgaatacctttggccttgatcaacgagatgttctatctctgaagatgttgacacaattattggatctttcacccacctactgctggtgacgaaaaggtttcaaatcttcaactgaaggaaatgtaagacaaacaacggtgtagtacagttttgctcacattttgtagtacaatggccaggcaaaactcaatcaccaagcccttggttttatagaacggaaaaggtaagcagatcccattggtgcagtagatagggtccatgcatgcactggttgaaggaagcatgggcctctggctgctgcaaacgtagtgaatgaagttgcactaaactaccagtctgaaccattctgaaacttgtgtgcctctttgattttccaggaacataggaatggcaaatgtcacagagcaattaactgcagcgtgcaggctacagttactgcgacatttcggcaatgcatttcttgttcagttcctactgctcacataccacttcagttttgtttcacaaactggcaagtggctaccaattacaaaatcgatctctctttctattaggtcctaaaattctctagagacccaactatagataaaccaacccagctaatgaaccatagatagtaccatgtaagttgaaactacccagggtgaaaggaaccgaactagccagtccaattgcacaaatcaacacggaactgatctaacctagcacaccatgttggtgtaacggtgttacaaccaatgtaagagatcctaaagtcaaatatgttcattatcacaatagagcatgaaatcagggtagtgatctcaggcttgctgcccgtgcggaccataatgaatctggtgtagttgtgcagaacgatatgacttatgctaggaggcatcattatgtggcaactcgcaagcagccatctgattctttgacttcaccttcccaagcatctcagctactgtcctgcagcgacattgctttccaggacggatgacatccccatagacagccatttcaatcacatcaagttctttatctgacaaagaaaaaacactatcagattaaatttgcatgtcatacgaaactaccatggtaggtttttcatgctaaatagagttggcacaacagttacgttcgattagagattcagttggatctcctgattcaggaatgagaagacaacttaagatataaaaataaataagagcagtccatggccctatttgggggagcttaagattctaagaatctgctggttagtagctagcttccgagaatctggagaagctgggttttccagcttctggattctagttccggattctacaattacagattctcagaatctgggtaacaatctggactgtttgggggctgcagcagctataagctaccccaaataggtcccatgtatgttatttgttgaaactttttatcctctggccaaatcagcatagtttgccaaaacaaacgcatgaaatagatattatctgaaattacttgtttatttttacaaagtcatgattgttttgaagttttatggctagttcaaaaagtacaattttatagcaccttgcttatagacaaatgcatcatgatcctaattattcacagtaacaaagcaatttttcgaagcaattgttaataatggaatgtacaatgaacaattctagagaaaaattgtaatctagctccatagaattgttctcagatggctcaaaggtaacttgttttatattgataacagtacggtgcaacatccccacctctgcaaatttaatttcactatttcaaagaacatcgaaacatacacagccattaatacgtggataacgcataacagaacatctattaccatccatctataccatttataattgctaagggagcagcataccaatggacatataagcatgtacagcagaccaatgacattatgaaaaatcatgcattgcatattgcaagctgtttattctgttaaacataagaaatcagagggactactacacatacattataaagatccatgggagcaaatgaatcgcaatatcgacatactcaccagtgaacttgatatcacaagaaaatccctgcatttctgcctgctctatccatgctttatcagattttgaccgattcacccttgtctgaagaatctggcaattgtcaacagtagactcccctcctaaagcatgacaaaaaattcaattccagttccagaacaatcaacatgagaaaatctgagtataatggaaaacaaattgtacaaataacagagaaatagacaaaggattggaagatgactttgttacaaaccaagtgtccaacctacaaagtaaagtagggccagcactgatcccaaatttagcacaatttggaagaataggcatcaattttcagacctggtaattataaactaagggatgctaacagcagaacagtaaaacatatcagtataaagcagggaatcttaatagcatcaaagacaatattctaagcattgaatcgtaaagggcctttctcatccgcaaaagatagtttccgggatgagggtcttgcccatttttcagttggacccttccgcaacttatgtgaggtccaacaatctcgccttgtttgttctccttaaccatacaactacagactctcggatcaaagaccccatatccacccaccatttatggcgttcacacagtaatgttctcatgccaatttgttgaaacaaaatgacttttcatcccaaaaactagcctatgaagtgggactgttccaacatcaatatcagattttatttcggtaaagccaataaatagtacggagtatgtgtgcggttaccaaaggagtgaagtagaactgttaaaacttgcagttttgtataggcattagtttgaaaaccacaggtgcgctccatatatggtattatgttaacaattcatagttaaattagacaagcaaaggctatataagtaccaagtacgctgatttaaaaccaagttgtgtcagcctttataacaaataactgatctgaaccaagtctgaggagaaggggattggggagattggggagattgggaagatacgcaaaacgaggtaagccattagcacatgattaattgagtattaactattttaaacttcaaaaatggattaatatgattttttaaagcaactttcctatagaaattttttgtaaaaaacacaccgtttaacaatttgggaagcatgcgcgcggaaaacgagatgcttttctctctcaatcccccagattgcccaggaacgaacgatgcctagtttaatattcaataatactgatatgaatactcacaagtgatagaaatccaaagaaaaatacatgtttcttgcttaacatggattgctaaatgttacatgatattgttgcacagccatctttattgattggagaaggcatctccccctaatttaactaaacataaatgatttacttagtaaaaaaacaaaaacatacggcattacagattccaattatcatctactgacccacaggagattaggctaaaatttctccatctgaactcacctgtgtactcatatccgattttaaacatcccaaccttaatctaaatgttcctctgaataaaacaaaattagtgctcatctgcggatgaactcaactcagcgacaactcctccaatacttgatcgagcaaaaatagtccgagtatccaacattgcaactacaccgcggcaagcaaacgcatcagaatcctacagatacgaacttgacggatcgaccaccacctctccaagcaagaaacggaaaacttgaggattctccctaaatcgagtgggcaagaaggaggggacgcacctttggagaaggggacgatgtggtcgtactcgtagcagaggcagccgtggcagctccagaagcggcggcacacgacgttgccggcggcgtcctgccgccaccgctccgggtgccggcccatcaccaccgccgccttccgccagcacgccgaccgggtcttctcgtcgaaggacctcggccgctccttctccctcgccgccgagctcccgccgccggtcccctcgccgtcgagtcgcggcggggagaggagggagccattcaccccagccgccgcagctttactttcggctggtatattcgcgttttcatttttttttaagtccaaataccccctatgatttgaaaacgtcgatgcagcaccctgaactctaatcctatcctatgatatcgtttatataacacttaaaatggttttgcatagtagtttttatttaatttacataatcgttggatgagtatgattatgtgataaaggggtgaaaacgggtcgggttcgatcagatttcacccttacaaatggatgattaatataatactgatatgacatcactatagaatataaattgataaccgatgattgacagtatgtgaacatgccataccagttatccaaaacctgagcgtagctctgttggtatgttccaaaactgcttgtttaagatttgaggaccactcatcgactcacggacctcacaggggtttttcccgtttcctgagtcaacttcggttggtcctagttaggtaatagggtacatatacgtgcgtgttcggtggtactgtatgtttcccgtacagtgaggcataggtcctcgaatctctttcctaacgtgtgttagggacgcgcacgcgtgtgtgcgtgcgttgtggtgtgagtgttgtgtgtgttcgtgtgcgttctgatttgtaccctctcaaaaaaaaaaaaaacaaaaccactatcaaagtaactcagaggtaatttgaacggtttaggaggctaaatctccgattttaaagtttatggtgctggacaaacttctatcaagccggtgcatcggcaatctctggatcctctagccggtgttgcatccttgcatctgcttcaatctagtcattaaggcaaaagattgcctgtcaggtgcaaggcatgacctctattcttcaataatttttccaacctcgctaattgcaagctctgaagagatagaagaagttggaaccaatccaatagaatgtcatgtgcaaagtgagctagcacaggaagagtccattctctcttaatttccaccactcttggagatcgaaattttcacgatccagtgtttgaccatgttctgtgtggattagtgttaaggtaatggttaagctctacgtctgagttccaatttgacctgctacctgatgaggaggcttgttccttgcccctgatcttcttccacaaattcatcgcacttgatttactttgcttttttttttgtggggttttcttaggcacccgacgagcaacacttagctcagtctggtacagacggaaaaccctgaacaactcatctctagcatgttgataagctttagaataatcaagacccattgcatcactattggtatgaaagcagcctccacaacctccaactttttatgaggatcaagtaccaaagcaaaacaataaaggtgtggaatagcagtgaagtatttgagaaatttttcttccatgggttgaacaacataagctaaaactctgtcatgtcggttttcttgaaacacaaaggacaatttccaaatacattcaagcaccttacaaagaagtaggatagtaaattctagatagtaggactgtagttttataaaaaggctttagaaatatatgcagacgtgttgctatgtcccattctcccttagtaagaaacaaaatctcaccatcaccatcctcatcagtatcattacttctaaagtgcaatgaatcgatgaaaacagaaattattttctcataccctttcagttgatgtagcatgaggtatgttgtgttccacctatgtttcacatcaatgccaaacatcctcacaagtttattctttgctcggcaatagtcttggaacatctccttcatcactagctgatccccaacaataaaaacagcttaatggatcttgttgagtaaattagtaacaacagtaatcctgcatagacaataaattccttgtcatagatgcattaaaattgataaattatttacactaaaaaaatcaataaattctcaacgactcctaatacatgcttgcacagtcaggttgatgatgtggcagatgcatctatgatggataacataacctccaatgtagctttacaaatttgtctccaaaatcgtcatggccgttgtatttgctgatgcattgtcaagagtaatagaaaccaccctagattctaaattgaattcttgtagtacatcaagtacaacactaagataagaggttctttggtgcttggatatccaaatgtcatatgtcacagaaaaaggaaagctaacagtactgaatgagcatttcaactcatccaacctagaacgatataacacaacaatattgttcttggtagttttccttgaaacttgggtgtactgtggacaaaaagcatttcggatcatcctctgaaattttttgcttttgcccatcctaatcggtagctcctcagaaactatgtaacaagcaatttcatctcgagctactcgtggctcataggtccatgtacttacagaaccattgggtccggagctcagttatgtctgccaggctcctgccgatgctttatccttgaggtgcgtcaaataatgtcggttttgatgtcctgttcctaaactagaagatggggataaagtttttccacagtgtttacaggtagcacgtgttactagttgaccgtccaccttacccttattttttctatgtgttgccaacaatccgctctccctgcagatggtgtggatggctcggccttgcctcccggcaaagacaagaccgtgtcgtcattggcctcgatgatggactgttccgtaggatcatccccatctccctccagaccatccatatggcggttatccatcccatagtcatccataccaggagatagttggcgggcatcgaccgacctacgggaaggaccaggcgagcattggcggcgcctttgcgagggtctcgacgaggttgacctccgacgagtatcgccccacatttttgctgtggaaaggaaataactatgttgctctgtttatttgtggtgcatttttcttttatgataggaagaagaagaggaggaggaatttataaaacaaattgccctcatgagctagttgtttctcgttgctcttgcacacaacacacaacacatttgctgcctacgggctccacagaggcacatggcgcagccaatcgcctcaccatgcccatgcagcttctctgccactctgcctctggcaactggaggtctggccctctactcgtctacgcctgcactgctacaccaggcgacccggcgtatatgtccttcgcgccggtgtggcatggtctaaactcaagtcgtcccatctccatctcaatccgaggcaggcgccagcctttcttcacacatccgcggcgtcgtgcggtcgtgcggtcgtggcgaggcggcgaatggcgatggcaggatgcagacggacagcagcggggcaggacaggatcaaccaagcaagggaatcacaggtacccagccttcccagtccttcatactacctactacctagtcctagtactagtccgagctcttcgtttttccagcggtaaatcacaagtggtgcccagcgccgcgcgtctgcatccgttcggccgtccctgtcctcggtactcgaccagtcgaccttgcagtgacagcagtggactagtggtagcgcagttgacggacgctttgattcattgcgccaatgcggaagggaatcgcgggacaccgtcgcagctttgcaggagatgctctgagcgtcttgtagagacgtagactcgtatacgcgtgggacgggcagacagagatgctttgatgcgctgcagacttgcagtgccgagcttgttgccggggcacggaaagatatgcaatgtgcgcgggtgcaggatgcaggccgagcgtgcgtggtggtggaggcgcgtttcacacgatgagtatgtagaagcatgcgtcgctccttgatgcgcccggccaggcctgatggctattgcgaagcccattgggccttcgtcgtgcctatgggttgttcatgtgctgtgccggcccatagcccactggtcgtgttgtgccggggagcactaatgggcgatcagtcgcgccctctgcacggcgcgcggtcagttataacccgtctagtctctcctctctactactagggcggtggatggtgcgtcgcttggagcgcctgcgttttgtttctcttttcttgggagtgcccgcttttcccttttttttttgttttttttcggtttctctttttttttttggttttttctgtttttcttccgtaccttccgtttcgttttttttctgttttctttctttccatatctttttctgtttttaatatgtatgtatgcaaactttatatacgtacaaatacaaactttgtatacgtgtattttttagtttttatacgtacatataccaattttttatacatgtatacaaagtttatatacacatttataaaatttatatacgtgtattttttttaggtttttatacgtacgtacaaatacaaactttgtatacgcgtatacaaaccttgcatcccgtacgtacatatatataaactttttatacacgtatgtaaagtttgtatacgcgtataccaagtttgcatatatacaaactttgtatatgtacatattaaaaaccgagagaaaaaacacgaataaaaaaaacaaaacttggtatacatatgaatataaaatttgcatacgtatatcttaaaaaaaccaaaaaaaggaagagaaacaaaaaaaagggaaaaaaaccaaacagaacgagaaccgaacaaaaaggaagagaaaccgaacaaaaccgaagaaaaccaaaacagaaagataaccgaaaaaaggaaagagaaatgaaaaaaaaaaggaatcccgcgcgggcgccgtcagccaccccctccgtgcgcgacacgtgtccagtcgcgcggcggagggcgcgtgcgattgttcgccgattagctttttcgtttgtgctgcccgccatgcccgttgtctaggcccaggcacggcccatatacgggccgtgctttaatttctagcgtgctaggctatcatgtcttgggccggcctgataaagcacggaccaaatcccagctctgagacatgtttagagcttggtgggagaaatcggactacctctaggagtgctgaagataatttattgatctggaccgtgaagctggttctccattagcttcacaaccccatgtggataaggtcagagctcatcctaatttgtacattcatgtgttgaccaacaagttaagagagacatgggatgcaactgatgctttcacggctagcgtctgccttccaaataatttactctgctatctccaaaataataactttgcaagataagattgctacgatcatcaattcttatagagtaaatttcacaaaactacagatactttgagcaaattatcacaaaactacagatttatggtgatgtattataaaactacatatttaacactaaatttcacagagaactacaaataggtggggtatcgtaaaactatatagatttagtaacaaagtaaccacaaaactacagatttagtgtcaacttaatcacgaaacttagacgtttataactcaaacataacactagtgctatgtactccaaaatatatatttttatgataactttattactaaattatagttttgcagtactctaccttaaatctgtagttctgtgataaatttagtgttaaatatgtagtttgtgatacatcaccttaaatctgtagtttaattttgtgataatttggctaaagaatgtgtggttttgtgaaatttactcattcttatttttttttattgaagtatgcaactgcctccatatgatacttatgaaaagtttgtctcatgaaccactgacttatcgattgattctctgtagccattgattgtactacgactgacttgaaagaatcttaccaccttactttttatgtgctatttattgtattttatttattttctcctacaatataatgtagatgaacctttttttttctctcctaagggctctatgtatttgctcttctctttcgactaatgggagaaccttttgtatttcatttatggcacaatcgaaccacatgatgtgagatgacgatcattttggcatggcgagaaagggcaccgacgtaagtgtagggttgattgcaaagctgatcggtaactccatatatatgggagagagaaatatggatttgctcttttttgcaaaaaagaaaaaaaaaacagtgttgctcctaatggtgactgggtcatgtgaataggatagaatagacggaaaattctttttggtggcaggcatataaggaaaaataatatgaattatcttgtaaaagggatgtagatcaaatattggatggtcatgaatggtttggacttttttttttttgtctatgcacttattgtgaagttgtacattaagaattacataatttcgaaatatggaaatggtatgatgttattttatgcttgattgccaaaacatacacattctttttattatttagttaaatactatcgtagcgttagcatggacaagttgctagtcaattgagtgactcatcccatagtgcatttcaccagaaaataaaatattatttacggtacataactatcctctttttctgaaacaaatttctttattccaaggatcagacatataagttatgatccatagttcacaatcaaacagtacatatataacaaagagcaattaaaacatattgttttacaaaaacaaacaaatgtgctatagcacggtaacatcacatgcccttcgttctgatgacgattgccagcaatatacacaatagacattttcttttgacgtgaatgtacacaatagacatcaaaccacaccattatttattttccgagtagttccaccatttcttgtacttggactgctgcatgatgcattattcggcctgctggtctattgtattcgttgtagtcattacatcctgaatcattataatatcacaaattttgttcatgccattattataggcttataaacaatcaaatcatttggtgcatttcaacattgtacgtccgacagttcaagttgtctgagagaaaaacaatactatgcataggtaatgaaaatcagcataaactcagatgtatctgcaactcttatttgttgggatacttaaaacaaattaaaataaacagttaacatgcttgtaacaaggtattgtattttaatatgtatgtgtaactgaaacacaattaatagcacacatagatttaatgtaaacctttagagttttccacttacagcttgtgtttgtggagtactatagaatgcatgaatgtcaagctgtctagttgtctcaatgccaggattgttcttgactatgttgtgctgaatagtgccatatgccatagcaagttgtccagtcccaccgacaatggcccactcaccagtttctggagtagtccccatcacctgaagctttgatccattaaacctgtaccatttcaaaattattatgcgccacaagaatctacaataattgaagcacatgaagcaactaaaattgtgaaataattaatccattagtcatggatgctgcaatcaagttaacaagcatcagactatcatgaactaaaaagaaatcgaagcgcagttaagcacatatattggtcctagttcaatgctgtggacaaaaaagagttattagcatgatgttgttcaataaaaaatataaaaacttgttagtacctggcatccacaaactctatgttcatagatgtgtaccaggtgttgttaacttgatcaacctggacatgcattcctcttgcattgcaacaatagtactgtgttgaagtcaggtccatcatagataggccaatcgttgataacaatcataccaaacgaagcgggatgtgatgagggcaccattgtttcttggttgtggtttggccctgtaacaacttggtgcaagtacaatctcatggtaatctcacactgatcgcggagcacaggccgtactggaataactttgaaaaatggactagccatggctaaaatgtgctttggtaggactggcaaagtggaactaggaattgtttgattctttgcttggtgtcgatgatcagagatggtgtatggctagctgtatttatagcgtagtggtagcactctagttcatgaggccaactcagagcttcatcgattttctcgtttgcattccctggctatagcatttagaagaagtatggaataatgtcacaaccaaacaaggtcagatgtctaattcttttgcccccacttgcattagccatccaacatttttttcccctttattttcactggtacacaacaagagatccctgccagttttcgaaacggcaggctgcatgtggcgcagtgatggagttggagttgacacaaaaatatccctggaggtttgtcattccaggtttagtccaccaaccggcagtgatatggatttgccgcgaaaaaaaaatagtccagtccaaatgtgcacgaagatgacggtttgtatatgggaagtaaacatttttgtttttttggagctaattatccatcatttcttttgaggtgcttatttaaaaggattgataatgcatctagagacagccatgcattatgcatagagctaattctatcagtgtttttttttctctaagttttacgaagttattatcagtgaaaagaagaagcagttcatcattcaagtaagataccctgggaaaatctgattttgcggttcctcaactcttggtccaaaattatacattagcaacatgaacatcagaataacttcaaaagacatctcaaatttttggtttgaaggtgtttttttgcgtgatttgattcttacatggtacatgcctgacatattattaacttctgtcaaaaattaaggtggttattaattgttcctgtaaattcatgggaaatcataaacagccagtcacttgtggcaaacaacaaattaacattcattaatatatattcttaaggaaattgtaataatgcaatattgttttaatacacattatttggttcgtcatttattatatgtgtgatttaaaattaaacaaaacttatatgcgtcatttatattttctcgcattttcatacctgtgtcctttcaatagagaagtatcttgtagttctgataatttttctctagcgtggttaacggaaggtgcattcctttacctgcatatacggtgtgagtggtgctgtgtagcggttaatccacaattgtattttagaaaagcatgtatgtatatatttgtcctttggtgtggtctggtccacctgttagggttgaattttcaagagatgacaaatatggcactttacagaaaacaaatatgatgacaaatatggcactttacagaaacactagagacatgatgaatatgaaacatatattcctttttttttgaggttcaaatcgaaaaaaaaagaagccctgattatcagtgtatgcgtttagtattagagttagattagatttgtatagattgtatccgtatataacttttatttaagagtttgttgtaatctctattgtattggatatataaatacaatcaccctcccacgttgggttgtgaggcgttgtgaggcgtctcataattctctacatggtatcagataccagtttccttctaccctaattcaccgcttcctctggccttcgctttttccgcgttcgcttctcttccgctgcccacgcgacttccacgtccccaccaccgcgccgcgccccagcgatttcccctcacgatctcgccacgccccagccccactgcgccttccatgtccccaccgcgccacgacgcaccgcgccgcatcctcgctcgttccgtgccgcgccctgcctacatcgcgccgcgccgcgctctgcccccatcgcgccacgccgtgccctgcccgcgccgcgccctgccctgctctgctcacgctgcgccgctttctgtcttcgccacgtcgtgattattctgcctctctgccatgtctaccgagtccacctcctcttccacaacctcgggaacaatggcatctacatcatccggctctactccatcttctgctgccagcaccggggattctaccggctcgatcttcgtcaacccgtatgccaccgtcaacgtcaagactcacataccaattaccctggagctcaagcaccccaatttcaacaagtggaagaccttcttcacttctatgtgtggcaagtttgggctccttcctcacattgatggcactgcaccccctcgtcccgacgactcgacttgggcacaagccgattgttgtgttcagggctggctgttcggctccgtttccgatgctatcctcgacgtcgtcatggaaaccgaccagaccgcccgtgacctatggctcgccatcgacgatctctttcaagcaaacaaggaaccccgcaccatctatctcagtcacgagttccactcaatgacgcaaggtgacatgcccattgccgattattgtcagaaggtgaagactgctgccgatgccctccgcgacgtcggccaccccgtcaccgaatctcagcttgtcctcaacttgctgagcggcctcaactctcgtttttcgagcaccgccgacaacatcgctagcgcccctgttctgccctcctttgcctcagcgcacaacaccttgttgctcaaagagctgcgaattgccaatgcacacaaggtccaggctgagacaaccatggtggtggctgcctcctctgccaatgcctgcacttccggcacctgtgcgtcctcttcttcatcacagtctcatggcgatgtctccaacaacagtggtcgccgcaaccagtgacgctacaacggtggccggaacaacagcagtggtggcggcaatggcggacgacagaacaacagcaacggcggcggctatggcaacttcgggaacaatttccagcagcagcagcaccaggctgggccacgaactaccggcccatgggtctgtttcaatccatgggctgtgcagcagcagcagtctccctggcgtcccagcaacagtgccggtctgcttggcccatatcctcaagcacacacgacatttgcaggcccatatgtctctccaccaatgccgggcttgccaccaatgcagcaatctcagcccaattgggatcaggcaggtctgattgctgccctcaatcagttgtccgtgcaaagtccaagtccttgggtgcttgacacaggagccacttcacacatgtcctctaccgacggtattctcgatactcgtcttcccaattcctataccttcattaccgttggcaatggtcatactattcctgttatttgtcatggcacttcttttctacctataggaaccactaaatttgatcttaaaaacatccttgtcgccccctctttggttcgcaatctactttccattcgtcaattcactcgtgacaataactgttccattgagtttgatgagtttggtttttctgttaagggcctccgtacccggcgcgtgattcttcgctgcaatagtcgtggtgacctctacactctacctattgctgcacctgctattgctgcccacagcttcttggcccaatcctctaccctgtggcatcgtcgtcttggtcatcccagttcagctgctattcagactctccacaaattagctattcttccttgtactaagatagatcatagtttgtgtcatgcgtgtaagttagggaaacacacgcgtctacctttttctcggtctcagtctagtacatcttctccttttgagcttgttcactgtgatgtgtggacctctcctgtcttgagtacttctggctttaagtattatttagtggtgctggatgattttagtcacttctgttggacttttcctcttcgccataagtctgatgttcaccagcatattgttgagtttgttgcttatgttacgacccagttcggctcttccattaagtgtttccaggcagataatggtaccgaatttgttaaccaagccactacctcgtttctcgctagccgtggaaccttgcttcgcttatcctgtccttacactctcctcaaaacggcaaagccgaacgcatgcttcgcacaatcaacaattccattcgcaccctactcatacaagcatccatgcctccttcttactgggccgaagctctagccacagccacatacttactcaatcgaagaccctcaacttccgtccacaactccattccgtttcaaatcctgcatcacaaagttcctgattattctaatcttcgggtttttggttgcctctgttatcctaatcttagtgccatgactcctcataaactctctcctcgatccgctggctgtgtttttcttggttacccagcttctcacaagggctatcgttgtttggacatttctacccgtcgtgttttcatctctcgtcatgtggtttttgatgaacagacattcccgtttgcagctattccccaaactgcttcttcttttgattttcttctacagggtgtttctaaagcggtagctccgtcctccttggacgtcgagcgtccgcgttctctaccggtcgctccctctcctgaggtcgagccgccggatgacttggccggccctgatatgtctcagcttcttctccataatagaaggctacaatcatcgcaagctccagaaccagctatattggcgccttccagtgcatcctctagtgccgatgctagtactacgggcgggagcatgtcttcttcatcaccagtgcaaactatatcgagttcttctattgctcagccgcctgccttgcatggtgttgcttctgctcggccgctgatttctccatatcaccatacgtatgtgcgtcgtactcagcctgtggcggttcatggtcctatacgcaccaccagagcttttcgagctgcacaacattcacaggatcaacagcgtcatgctatggtaactcgctctcagaccggcaatcttcatcctgcccagcgcttcaattataccgctatgcagacttctgtttcgccagttccttccaattatcgtagtgctttggctgaccctaactggcatgcagctatggctgatgagtacaaggctcttgttgataacaacacttggcatttggttcctcaacctcctggtgctaatgttgtaaccggaaaatggatctttcgacataagtttcattccgatgggactcttgctcgacacaaggcacgatgtgttgttcgtggctattctcaacagcatgggattgactacaatgagacttttagtccagttgttaaacctgctactattcatgttgttctcagtattgctgcctctcggtcttggcctatccatcagcttgatgtcaagaacgcatttctccatggaaatctagaggagacagtgtattgtcagcaaccatttggttttgttgatccttctgagcctactgctgtatgtttgctccaaaaatcgctctatggtttgaagcaggctcctcgtgcttggtaccaacggtttgcaacatatattcgtcagttgggtttcacatcttcggcatctgacacttctctcttcatttataaagatggagataatgttgcatatttactgttgtatgttgatgacatcctgctgactgcctcgtccacttcacttcttcagcatattactgctcgcctacactcggagtttgctatgactgatcttggtgacttacacttctttttgggaatttctgtcactcgatctgcagacggtttatttctttctcagtggcaatatgctgttgacttattgcggcgagctggtatgtcggagtgtcatcctactgcaacaccggttgatgctcgatgtaaactttctgctacagatggagctcccgtttcagatcctatggagtacaggagtctagctggggctcttcagtaccttactctcacgcggcctgagatagcttatgcaattcagcaggtatgcttgtttatgcatgatccccgtgagcctcatcttgctctagttaaacggattttgcgttacatcaagggtactctacacatttgtcttcacatcggaactgcaccagttgactctttgacagcttattctgatgctgactgggtgggttgtcctgattctcgtcattccacatcagggtattgtgttttcctcggtgaaaacttggtctcatggtcctccaagcgacagaccactgtctctcgatctagtgctgaagctgagtaccgtgcagtagcacatgctgttgccgaatgttgttggctttgacaacttcttcttgaactacatattccacttgcttcgaccactatcgtttattgtgataatgttagggccgtctacatgacagttaatcctgttcatcatcgtcggacgaagcatattgagattgatattcattttgttcgagagaaagttgctttaggacaagttcgtgttttacacgttccgtccttacatcagttcgcagatatcatgaccaaaggcttgccagttcagttattcactgagtttaggtccagtctttgtgtttgtgatgttcctcccgctttgactgcgggcgggtattagagttagattagatttgtatagattgtatccgtatataactcttatttaagagtttgttgtaatctctattgtattggatatataaatacaatcaccctcccacgttgggttgtgaagcgtctcataattctctacatttagccaggctggaaagttgggaattaccataacttcacaagacaagaaacctaattatgatttgattagtgctgaacataaattattggctaatcagacatttcttttgtgaaacttatcaattttttcacgagattttgtatctggtgatgacgactctaccatttaggtttggaatccttgatggcatagattatgcttgataacttggctaatatgctgacattaaaatatgtccaaatgttcataaatgtcacggacttcatagcgtttccataaagaggacaaggccatgtactgatgcacatctgaacaaaattaatgtatgtcataaaaacagataaattgtgagaaaaatttgaactgtgatgggcaattgatcatatcgtaattgtgacaaccatttctaatcacaacacattagtagcgtggagttaattctgaggaattttcatgtagctggaatatttcttttgcaaaacttttttagcagcgttcagtagcgatgaacaagtgtcttcattttttcgttgcagctagttaggtaacattatttttgcaataagaaatcatgcacgtcagcagtaaccagtaactaattcaatagtcctcaaaattattggatgtgtagtgtcatatatttatgaagtttagttgcatggtacctacactaggactttttttttcacgaaatggaaatgcaagaaaacatgatgaattcctatctcagcctcctaaaagttaaggccgcctcaactctacaactgaaatcacatttgccatttccatttaaagaatcctgttcatattttgttcgcttctctatctctacttctgatttatattcatgctcgaaattgaattgatagaagcaatttctattgatgttttcattgagcatcgatctgttatgcagaatctgcttcaaaatccctcgccaaggttaacaatttcagaaagctaaatttttttaagggaccactaaacctgaaataacccagcccctcagcggagctcatgtcagaaactttttgacgtatcaagaatattaatttgcatattcaacgactggacattctttggattaacctgtcctagccgatgaccattagcaagaacaatataagggcacattcaacggtttagcctgctatggactcttaaataggccatgtcagaaaaaaaaaacaattgttctacaaaggctggttttatgatcgtctctccactaatatgcagtaatatataattaaattcttgtagcaatggtgctgtgattttctgcattttggatctaaatacgtgacttttcttgaagatggaatatacaacggccgttgcttatcgtctgctcgtgttttcctcgttgtgagggccgatggcatgcaaaagatggatgcatctcccttctttttttctctctcatccacatcatcaaatctgcttacatggcaacaaatagagcccactaattaatactctctccttcccaaattaatcattagagcaagtttaatagtatagccaactactagctccaaatcatctatagccgatttaatagccaattcatacaatatttacccagaaaacctacaccacggcatcccgtggagacgggatcccctcctcctacctcactcctctccccaaaatcatccgaatcctctcctcctacctcactctcctcccccaaatcacacggcactgcagccctccctctccctctcccctctctctctctttctctctctctctgaagaaggccgagcggagaagaagccggccgggaggaagggatcgtcgtcgtcgtctccggcggccgaggaggacaacgacggcactgcgtcagcgaggtcggccaaccctcggcggggtcaccctcgagctcgcctcccctcgctgcgccgctatggctcgctgccctcgtcggtcgggtgtgtgccggggagtcgtcgcctcggggagggcagaagcgggagctccccttgtcctcgccctcggcctcggcgtcaccgtcgtccccgcttttgcacctccaggatggacgccggcagcctgcgtcgacctgcaacaggtatggccgtcaacctcctcctcggctcctcctcaagacttctcaaactctctggctcgggcctcgaccctcacctcgtcgtgcctcctcgacgtcatcctccgcagttgcggccctccctccctgacgtctcctcctctttttgacagtaccctctgataccccataagtaccaggctttataccttggtaccaaggtttgatacctaggtatcacctggtaccttaggtactgggcatcaggtatcggtcgatacctagtcggtaccaaaggtaccaggtaccaggtacgaaccggtacctaaggtaccaggtactaggggagcacacgtccctcaccttgccgtgcctcctcgacgccatcctccgccgttgcggcgctccctcccccacgtctcctcctcttttttgatggtaccctttgataccccacaagtatcaggcttgataccttggtaccaaggtctgatacctaggtaccacctggtaccttgggtaccgggcatcaggtatcggtcgatacctagtcgataccaaaggtactagttaccagataccgaccggtacctaaggtaccaggtatcaggtaccaggtactaggggagcacacgtggacagaggaaacgaaaagggagagtcagttaaaatatcccgttgcaacggtatcccgttgtgtagctgccctcatatttacctataaacatatactacactagtaatacttgatcccaactgtcatacatacattttgtcttatggtctgtgctgtagctcgctacaaatctgtagaccgctgctcttttctatcatcatttatcttcttgatatgtatttataggtggcttatagcctgctattgtacttgtcttatataagtttaagcaccaaaaccaaagacaatttaaatcacatcaatcaagacaacatgcacacattctcccacaatgcatgcattgattaaaaccccataccaattacaccctagcattgtcgcgcccagggattcgacaacccgaatcaccggctatctgtggatttaacctctgtctaggcatcaaccagagtacatagatgacaatttgacacagatccacgtcttacaaaaataacacaataaaacccatatgcagcggaaaaactagagaactaaacttaatcttcacagcaacgcgaagcttcctccataactccataggcaaactcttgatggctggcacaagcctaatcttcatagaactcaccatctgaaccaacttctgcttctgggagattgggaaaaagaagcaagactgagtacaaccaccataatcaacaagtcataccaaggggaaggtatgatgcaagggtaatcaaaggattggctcaaaggatattttgcagtaaaaacagcatttgtaaattataagttgaaagcaataaaacagtatataattaagtagtattaaccatcatcgcagtacaacgctaaatccacgttgaaataggcccaacccaaaaccacccgaactacaccagttcattaagacaaattattaaggtgagactaatcacgatgagctggttgaccgcccaataaccgtaggcgtggctattcaaatagttttactctgatcagaggtgcacaactttacccacaagacacgattccacacatgaaaccatgccccgaagtactgccacgatactgcaaagggggaaatcgtgacaaaccctccatataaccacccctaaccaagcacacccacctctggtttcggtcccactccaaaatccagcagcccccgctcatgtctggtaaatccggctgcagcatagaccgcctcccggtccatccatactccatcacgcttacccttgccaatggtgtgctagctagaaaagattatatttaagattcagcctggagcccatctggcttgtggttagtacgagtacatcttccagggattcccgagaaccggtccttaattgtcatgggcacgaccaccaaataaaatcatgcatgtgcccacgacccaccaagtaaatcatattttaattaattaaccatatgccaaggtggcataacatcatcataaaattaaggactatattatagtgaatcccaaagtgagctagttgatctaagcatgactaagcaatcctagaccaatcatctagtcaaattattaacctaggctatcaatgaatcaggataaacaaaggctgagtatgggtagaaaccatcccacatgacattataaaagtaatgcaattttgagagaaaagcaggggttttgcaaataggctcaatatgatgaatgatatatgtatgacttgccttgctcttcagctgacgggacctcggcgaccacttcaaaataaactggagcgtcggaactgccggagtctaaacgacaaacaaggcacacaataaatacaagctaaaaagctactgaaacatcaaaagaaaccaattttaatggattcttgacattttaacgaatttactgcaatttgaatgggttaaaacaaagctctgattattaagttatgaattttacaagatgctctgtgttatttactattgacagaaacttaatcaattgataggaattagagcccaaaaggaacataggatcaaaggataggttgactagcaagcaaacctcacgagataccgactcaacgagtcaatttaacgtgacacgggatcaccgaaatgatcgaccgaaactggcgaacggaaccggccgctctaaacgactctaacctaaagaacgaatcgggttggacaaacgaacaaaccatgggggaacacctcgttcgaacgaacgagcggacgactcaacaacggctgtggctaaaccggtgggctagacatgattcacggtaaagccccggtacagcaaacgataggccagtaggaacctagggttgcacctatggctagacaactcgactaccaagctatgggacaaaaacaacggctaggattaagcggcacacggctgcgacacagcggcgcaaagcggcggctcggctcggcagtggcggcggcatggcatagcacggctcggcggcggcgggacgacccgacggtggcggtgcaaggtggcggcacggcaacgacacggcgacgacttgactaaactacgacacatgaaaagaaaaccctaaaaacaggagagatttctcatcggggagcaaaaaccagggagagatgacaacagcagcggcggcggttccggtggcaacacccgggatcaacgacaacgctagaaggagacaaaaaggggaaaaacttaggttgctagattgatgattgtaggagcaaatacatcaaagaaactgggagacgaggtactggcggcactcggtggcgacgttgatggtaacgacgacggcggcggtgcagggcagcggcggcggcggggtgcaggggggggctaaagctaggactcggaaaaatacaaaagactggagaaggaacacttacaaaggggagtactcgattaggaaaggaggagtcctagcgggagtagtactaggagggagggagagggaggcgcggccagctggggaaaggagaagggagagaggaaactaggggagactaggactttcccaaaaaggaaaaacaatgtggtgctgttttaggaaaggaacggaaacagtcccgcgaactgacacgaatatggttcaccatgcaaaacgaaactgcggactgagaggggagtgaattgggcacaattcacgaccaaaggcaaaggaagaagattaacttgacacttttaactttgcagcattgcctctggtgatctgatgtttactctctacgtcctgttagtgattttcagagcaaagagaattcgataaaaatattctccctgacaagtccgagtattaaatgcattgttaactggggttttctcctggttaaccaaagcaaatccttgatgccatttattagtgatttgaaacctaagggaagggaaaactccgggtgtgacaagcatgcacatattctcctatactacattaattatatttcgatgaaatccgtatccatgcagttatatgatgatcaatttgaaaaattctggactctattacatgatgttcaatttgggaaggaggaaatacctttttacatgccctaagtacaataatataagtggtctctggggcgatgaacattacaagttatgacaggacataaatgttggtggagttttcttaatctggtgagagcaactggaaggtatgactgcactacatcacccatatatattggggataactagggatcggtcgccccatccaaatcttcaaaaatcgggcgctgacgttatgctgacgtcaacgcccgatttatatgcaaaacaaattcaaactgatttttctcttaaattatttatccaaatcattatccgattgcaccattaaattcgttgcaattaaatcttcaaaacaagactacacatggatatattccgacaaaaatttttttagcttattattgattttttttcatgttgcacgatgttccaccaagtatatcggaattgtttcactgagtagatcgaaaatgtttcactcgtttaaatcgggtgttgtttcaccttatataaaaacattgtttcagcaaatagcgaaagaatatttcagttcactgcaacatttgatccatgcatagtgaaatattacgagtatactagatgaaacatttttcgatggaataaaaaataaaacgaattcacttaatagagggtttccaaaatatgtgggtttttttttgttgcaatggagtatctcaaaatcactgcaacattagatctataaatagtgaaacattgtacattaggtgaaatattttttgtggaacaaaaaataaacgaattctcttaatagggggtttccaaaatacgtgggtttttttgttgtaatggcgcgttccataatataaaaatccactacagcatttgatccatacatagtgaaacatcacgagtacactagctgaaacatcgtaaaactactggttggaaacattaaaagagaccatatgcaacattcaaaaaaatatcaataaaaaagctaaaaattttttttgtcgaaatataatcatgtgtggtcttgttgtaaagatttaattgtaacgaatttagtggtgcaatcggatcgtgaattagataaatagtttatgattaaaaaatcttttgaagaaatgagagatggaagcatgtagggaaagattctttgtatgcaaatggcagaccatgcagcgtctgatttttcttccctcccatcagacgcccgacaactagcattctccatatatattggcggttcacctagatcagacatttatgacagaaaaccttgatgtccaaaaaaactggtcaggcaccatctagactccgggtgaaacctctccatgggttggcctggtgctgcatcacccctagacggctagacctcggcagtggaacaaaccaatggttaggccattttggtggggagccgagatagctgtagtggactggatggtacgctactcgaaatagttctatgtgatgttacttttgcagttattgataatatattataaaaagaaattaacgatgaaagttttgaagaccgtgtaaaaaatcttagactttggacagagggagtaaaaggtttttttttttattgtgagctttatagacgaagcagaaaaaagattgttactaggatgacggcctcatcagattgttcggcttcatcgacgttattccacgattagcaatagcatcagcttcctttcttcagcaggtctcaagattaccataggcccaccgtatcacagacgaaatgatgtgaaaatcgactgttatatatagggcggggttgagaggagtttatttctgaaaaacatgtcatttctcactacccacagataccaactaataacagttgcaagcaacatgaacttgacattgtttttcctttgaccagatctctcaagttttttgtggaataagatcccaacctgaaccatctctacaaagtcaccagataacttaagaaatcagacagtgtacaaaatatgttgggtatattttgaatttgtacacataattaaaggacaagagccacctggatttatattgatgttggacagcagattgcattttgtctctgcgaacaaaatatagaaagtgttggtaataacagggttgtaagttcttctattatttaatatatccaccctgttccgcaaaagaaaaataaacaaatataagaggtgttctatttttcacagggatggaggcagcccaaatatcagaaatgaaataaaattgaaaggaaatataggagaaaaatggctggcttgagaaaagccaataaaacggaagtataattatattgttcatgtttgtgccacgagagacaatatgccgtaaatgttgtgtacagataacagatagccaggtctaatattaatgaggatgccataatcaagccgatgtgtccagactatacatcatttttgtgcccaagacaaatacgcaacacatattcgtgtccagactatacatcatttttgtccagagtatacaaatacgtaagcagcataattgcttaaagcaacaaacctgattaattattattgattaaagactggacatatttgtgtccaatcatacatttatcatttttttgtttttgcttgtttcacgaggatttggatgtggtgagcattatatgtacgctgatatgtactttcagaacttctgcagatatgtacgcggccatttaaaaagtacatggtgtcagggtatagcacgtatatttcagttggcacaatgcatatatacgattagatcaacagctagcaacggttttgtatcactaccagaaactccattagccctgacgggccaaaatttttctgacgtgtatctattaggctgtcaggagtaaacaatttttttctgacgtgctttcggtaccgtcacgatatcatgaatttcgctggcgtggtttgcctgtcagaaaaaaattttaggttcagatggttctcctacagagaccacatacgttttcatacataaagactgaccggcctggttataagaaactatagcatatattattattattattattattattattattcaacatgcatcctatgatgcaagacctatgatgcacacaaccattacatgattaaatcaccaaatgcaaagcatgcacttactacaaggaaagttctgaaaggccgaaaaaaggcatgataaagaaatgaaatttgccaatgctttggctgatctgcaaaaagaaaagccatagtgccaccaccaagactatcagtacatcagccatatatacaaactcaaataaactctactacgcaatcaactttcgcggacgagcccccgtccaaccttcaagtggaccgcatatcgtccgcctgtgataatagtgatcccaaagaaaaaataagacccatatgaaaaatcaatttttacagatgggcctattaagagacccatattcctccagcccactagtctggccccctcccttcttccttaaaatatctaagtcgtatcctcgcccctctctcctcatcctctccgccgcaccacctctactccactttttttttgagcaaaacctctcctccacttcaactacttctcctctcctctcacttcggaaggtggtggtaggctctcttgcagccaaggtggcacgtgtcgacgacgggcagtggtgatgaccaatgcgacagcggcggcaggaagagtccgctggatccaccggcagcaacgagggaaggtgcagatttggcaggctctttccctcccgcgtggatcacgccgcctcccctcccctctgcatggatccagaggtgcacttgatggcgacgagggggaatgatgactacaacaacgatgagtggagggtagatccgacgggctctcccccttccacgaggatctcgccacctcccctcccccacgcatggttctggtgatgcgctcgacgatcggttggggtaacgacgattccagtggcagcggggagagcccgccggatctgccggaaatagaggatccgtcatgctcttccccctctcgcatggatttttccacctgctatcc

SEQ ID NO: 39407 - DNA, 6730 bp, Oryza sativa
ggcagcgatgggaggggcagatccagcgagctctccccctgcctcgcgcatggctctggtgggccgggatctccccctctacgtggatcccgctgcctcccctcccttgtgcatggatctgtcggtggcagcgatgggtggtggggacaccggggagggcgtcggccatggtgacaatgaacctagagcacgggaatgacagtagctgtgacggccgacatgcatgggagctaattagctgccgctttagccatcgtctccattcaccgttgccgccgtcaggatcgcaaggaggagcaaagcatgtcagccccatcgccaccgccgctcaccaccagaatgttgccgccgcccccgacccgaactgagccgccactccaaccttgccagcatctactattgcaccacccaccggtgagtcccctgcgccaatccgaacccaccatgccctagatcgccggccaccatctggtcccgtgccactcgcaaccagccatgaacccaacaccgccacatccgcgctgcttcagcctctgtctgccacgtcagccgcacatgtggtgaacccgatttagttcagccgttagatctaggatagatcggtcccttttaatctgagccgtcagatccatagactggctctgcgcacccggtctactgtggagccgatccatgtggatgcagtaatccgttttccaattcataaataattcattattgcgtcataaatgataaatattatctgacagtggtttaaatcctattgaacttaggaaatccataactaattaaccgtaactcggatttaggtggttcaagtctcgaaattcatctaaaatcgagatatatccaacaaaagtatccacatgtcatgtttatgctcgtttttgtactgttttgttgattgtattcatttgctttggctttcgacgttcccaaagaggctgtttatgctgaaggttcgaaagtcttcgcaggcctgcaaggtaagtcacacagatcctaaagctcccctttgggagggttgacctatatcctttgttatgaccctgttgacattccttacctttcctttgcaaatgggttaacaaattgattagctagaactctatgtggtttagctaaagctattaggatgcagtcctgcttagaaacattagcacactaatgggataacttatgttacactatcacttattcatgttcatttgacggtagctcacgatggtcagttgtgattggttaaaaactgaattttccaactaaaacctaataatggtgggttgtgagcacttggttttgatagtcatgctcatgacaattaaggaccggttcacaaggtactattgtgaatgtttaatcatactaaccacaagccagcgtgggaaacggctggacatgttgtatagcatggttcatcgtggagtgccagttagagaagtggccgagataagcccacgagggtcactggggaatccatacctgactaagggggtggctatgatccgggtatacggtgcaccactttgaattgtgttatgctagttttgttgtcaaagctcctttcaaggtactgtggtggtattgaggtgcatggcaacatgttgtgtggttctgtcttgtgtgtgcattggtacacctctgggcagagtaaaactattcgaatagccattcccgcggttatgggtgaacctaataataagatgataattggtttaactcctggattggaatgtttaattcttggtttggagataaggtctgtgcaatagggcatggttgttcagatacgattgggcctatgcaaacggtatgttgtatatcgttggattgaaattgctaaattaaatacattatagtttattaaatgctatttatacaaatgatcctgtattatgctatcctttgtattttgtgcatttgtatatttgttgtgtggtttgttgagtattccatgtacttatcttaaagtaatcatcatcaaaggaggagtattacagtgaaggtgatgctctcgaggattaggccatgttcaggtcaagctgcttaggattttattgcttgagaagagctatcaatgtttatattcgttcaataattagttaaagacttgtacttttttttatcaatttgttattgtgtgcctcagctgattcctggatgagggtttacacacatgtaagtgtttggaattttggatagaaatttcaggcttgatacgccggcagagaggaggagggggagcggcaccaacttggacctctccagcgctcggaagagaggatggggcggtagtgctagcgtcagggttgggcatgcatggacagaggaggggtgagtgggagagaggaggagagaagtgaataaggtagcatgaggaggacaagggcatgcgggaaaagaggaggttttgctcggcgcaactcttagctcaaatcagctaagctttttttgtaggtatcggtttttttaaatggacacctatatgtataagtgccggttgtttaaatgttggcgccaataaatattgtaggtatcagttcttttaataaaactgacacctatactattggtgctagtttttattagaataatagttgctgagaggttccggttctatactgttccatcccacctgttttaaatgaatcagtacctatcaggggttttgtagtactccctccatctacttttgatggtcatatttcatcttggcacacagaacaaggataagtaattctacttatcatctatttaaacatgctactagtcattcctcgtaaacaagcgattcattaatatttacatttctcaatgtccatgtagccaatcatgtgtggaagaatgaagagtcacatgttaaatccgagaaaatcattaagatgataggttgttggattgaaatatgcctatcataaataaatttttcagatttggaaatataactatcaaaagtagatggagggagtagtccgtttagattggaacatcagcagattgagcctcatgatcgcttctccaatgttgttagattagttatgggctgtttggttgggcagattcatgtagtataacaaatattttctatttttaatcaatataattaacgtttgcatgcttgaaaacatctttttacgacaatatgcaaactattttgcatgttagtgggtagaaaagatttgatgcatggaacttccagagagttaaattgttttatataagaaatattctgcatcaccaaatcttttgccatggaactgtgcttggaacctttcactactaaaaatcgatttttcatagcggcaccatttttttttcattggcggccctgtgcacgcttcacctgccagattgtaatgatgggtgggggctaagaactgccagtgaaaatgactcttcgctagcggttgagttacgtagaccgccaacgaaaatatagctattttcactagcggtccacttaagcaactatcagcaaaaatctattttccctggtggccaccaaagagcaccgatgtattaaacaattcggctcgatctcaaccgtaccgaactctttatgtctccttctccctgccccaccggcgcacccctcctcctcctctcctccatctttcttccccaccggcgcaaccctcctcctcctccttgctgcttcaccactgatgtgcacaccctctcctcctccttcccaccggtggccgcatccatgggtggcggatccggcggcagcgagtgttaaatatatgatccgaattttgggcccacaatatatttagattagttttctaataggctttgtattataggattagtttccgattaggactttgagtctttgtctattaggactcctagatttctcctatatatatcccttgtaagccgcacggggagggtgcgacagcccaatgtatcccctgcgtttgtatccaactcctctatagtgattattgtcggttggcgcccatggttttttcccgcaagggttttccatgtaaaattcgtgtctccgttgtgcatctattttcataacggtgagtcaagtgagaggtcgatccagaggcagcgaaccaaatgggagtggatctggcggcaacgactttcacgtgtggcggtggcgggatggcagcagatggagcactggcgtcagcgccctactcccctcccctcccggatctggccggaggggaggaactaggcagtggtggctaccctactccctccccttgcctccctctttctgatttgcccggaggggaggtggccggtggcggcgcgacaacaatagatgggagagcggcggcggtccctccacttctctaccagatctggccaaaggggaggaggcgaacaatggtggcagcagtagagggagcagtggcagtggtggcgactggcaggtggctccgacggtagcaacagagaggtagctctggcggcagctcattctccaagatccccggcaagcttgtccatggctgctagggttgctagatgtgaaattttttatgtgtttgtttttcgggttctcttacagatgatttgatccatttgatgcacatttcgtgtttgatatgtggaaatggatagctgcatgcgtgttaatatttaccattttttttccccaaaatccatcttaacgtggtgaaccatcccttaaggtaaagccttttttttaaaacccttaatccttgccgctgggcttaggttcccgcttagaaaaatgaattggccgtggtagttggcatccgctagtgaaaatagtgcatattcactggccattagtcactgaacgcacgcccggccgtttgagaaaacttaaaatgaccgtcagaaaattttattttatagttatgttttacaccactactagaaaaaccggctttagcgacgttggccatttatttttccaggcgggtagacacctaaaacaagcaacaccgcttacgaagccagctaccggggccatggttgctttccgcctgggaagatagttctttgcaggcggacccccttagcaagccgcctgcaaagcttaaacttcgcatgcggaccacataagggaccacctgcgattattccaggcggtctatttatgtggtccgcctgcgaagctccatcttcctaggcgcccattttttgccgcctacaaaactcaatcgtggccacacaatttaccgcctgtaaaaatctggccgactatatagtcttgttcctccctgagctcctgttcatacccgacgattttctctctcttaaaggcaccaaaatataggggggaggttttgaacttcaaatcttcgagggatttttctaaagtggttagatctatgcctttgcactctatatacataatttttttgtaatttatacccccttttgactatggatctatgcatgcaaaatagtgaggggaaaagctagctcccatgattgttttttttttggtaatttgcttttgatatgtgtgctagatttatgtgtgtttcttgatgctatggggttctctcatcctctagtgattttataatgtaatataatggactaaattatatactttgctcttatgtatttgcctagatctagataggagagagaaaacttcatgacatgaagaaactaattattatgtttaatttcgtatattatgatcttgttggatttatgtgtaatctttgatatcatgtggtcgtcccatcctctagttggttaaatataatatgttaacttcaaaagtgttacatgtttgttaaatttttttattaatataaattttgcagagatatttgttacaaatatatttgttaatttttttgattaaataaattttgcagagacatggacaggctcgaatggatgtatcattggccgatgtttttatcgccatatatggaacaagtgtctaaatttattgatattgccaaggagtacgttgagaaggagaataggaggggtatttattgtccatgtgctaaatgtaagaatgaaaaagtgtgggaaaatctgacgaaggtaaatgagcacttagtcactcgtggatttatggagaattacgttatatggacacatcatggcgaaaatgatgaagttagactcgttgaagaagaatatgaaccggttgttgaagacatggattgcacggatggttgtgctgaagacaatattgatctggaggaattgttatgccatgtagaacctgagttgcttgttgggtcggctagaggtttagataatttcgaagctttgaagaagacaacaaaggatattctatatgatgagtcaaagggctgtcacagtgacttctcaattttacggtcagttcttgaacttatgaggttgaaggcgagatttggatggtctgatagtagcttcgacagtcttctacaacttttgtagatcatgcttccgaggcctaacttgttgccatcgaacacatatcaagcgaagaaatcatatgtcccttatcccttggtgtggagaagattcatgcatgtgtaaaccactgcatactgtacagaaaagagtacgcctcgttggttaaatgcccaacttgcggtgctagccggtacaaatcaaacagcaatacctgcctagaagaggatgacacaatcggagagactaagagaaaaatcccgcagcttgtgatgtggtaccttcctgtgaaagaccgcatcaagcggttgtactcaaaccctcgagatgcggaactaatgcgatggcatcaaga

SEQ ID NO: 39408 - DNA, 24945 bp, Oryza sativa
cattgatgtatttctcgaaccactgttggaagatatggcagatttatggcatgaggggttgaaagtgtgggatgagtacttacgacaacacttcacagtgaaggccatcattttcgttaccatttatgattaccccgccatgttttcagtttcaaggcagatcaaaggtaaaactggatgtgtgaatatgcttgaatggaacgtactataggtacctcccaggttccaacaagcttgtttacttgaggcaccggcagtttctacccaagggtcataagtttcgcaagatgaaagcagagtttgatggtactgaagagaatgattctgcaccgaaagttacacccggggataaagtatgtgaggcaacagagaaaatagaatgcgtgtttggaaaagggactaagaaaaaatcaaaggggacaaagcgtaagaaaacatcaaagggggcaaagcagaagaaagaagatcgcaagcccccttccccattcaagaagcattctatattctttaagtacctgccgtactggaaagatctggagattcgtcatgccaaagatgttatgcatcaagagaagaatatattcgacaacgtaattggtacattgttggacataccacacaaaactaaactaaggatggtttgcaatcacggtccgacctagtcgaaatgggaattagggaggagctacacccgcaagaaggagaaaagactggcaaagtttatcttcctccagcctatttcacactaactccagatgagaagaaggcatttttcaaatctctctgtgatgtgaaagtgcccataggtttctcatcaaacatcagacgactagtgtcaatgaaagatttgtcggtatctggttataattcacacgactgtcatgtcttgctcaccgtgtttctcgcagttgctattcgggccattcaacgggaacatttaaagattgctatcacaaagatgtgctactttttcaatgctatctcccagaaagtcatcgatcctgaagagttagcacttcttcgtacattcccacatgagatccaatgccaacttgaaatgtatttccctccatcattctttaatatgatggagcacctcatggttcacatcgtgccccaaattgttgccctcggcccgttgtatctacatcaaatgtggtcctatgagcgttacatggctgattgaagggctatgtatggaatcgcgcccatccggagggatcaatggttgaggggtacaatacagaagaggtggtcgagtgttgtattgattacctaaaagatggaaagacaatcggaatacctgtacctcgacacgagggaaggttgactggtagggggacggtagggaagaaaagattcgtcgaccttgaatacaaatttgtttcagaagctcacttcagtgttcttcatcagcttgctatcgttgagccttacatcgatcaacacctcgaacttctcagatctgaaaataagggacgcacggatgattggatgataaaagaacacaagcgccgcttcgtagattggttgcaagaactaaatttacctgatggagataccaccgaggaaattacaatgaagcggttctcatgtggtcaatcaagtactgtaaattcctagcagggatatgatattaatggatacacctttagtacaagagcccgagatactaagacagttacacagaacagcggagtccgagttgaagcaatagattcactaggggaaaaacagacatactttaggtttattgaagaaatatgggaaatcgactatggactcacaattcaattccccatttttaagtgccagtgggtaaaacatcttaacggtgtcatcattgataagtttggtcttactgttgttgaccttgggaatgtgcgtcacaaggatgactcctgggtactcgccgatcgcgtggcacaagtgttctatgtgacagaccctgcaaatttgaagaaagaaatagttttatccggaaagcaaaagatattatgagtggatgggattcaagatgttgatgaatacaaccagtatgatagtatgcccctttatactcaatttcttcaaaaaattaagcttgtggaggaatctatcgacagtaccatcaagccatacatgctagaggatggagttgggaaaaaggtgaaagggtagcgtatgcatgcaatgatataatgtatttctgaatttttttatgtaatggtgacatgtaacggctatttgtactcactttgcttactactatgcatttaacatttttaagtgcaatagcctgcttgcaacattaattaataccaacatttattaagtgcaaaaacccaccaatatgcagaagaaattacactttataggtggaaaaaattctcctcaattttctgtaacaaactattagtataaaaaattacactttcaaataatttttaatggtttataattggaagttacaaactattagttttgaaataatttatatattcgaattcacaacactgttaaaaaattctccaagtgttgaaattatcttttcaagcggccggtccgcctgggaaatttatataaagatcacataggaattatcttcgcaggcggaccggccgcctgcgaagatttgcaaaacacatcttcgcaggcggataggccgcctgcgaagatatttggggattaacttcacaggcggtcggcccgcctgcgaagataggaggcctataaaagcgcgaccaccccggcgccaaattctcaaagtccaggcgggaaccctagaaaatttggcgccgttaggctaccgaaatttttggtgcttccgaccgccggctctcatccgaccgccgcctctcctccgaccgccgcctcccttgccggcgccgaccgcctgctaggccaccaccgctgggcgccgcctcgtaaccgtttggccgccggcgccgcccatctcctcgagccgggccgcacgccgcgacctctccatccggccgggccggcgcggcctcctccccggccagcgccgcctcgtcctccagcgccgccacccgcggctagcgccgcctctcctccggccggcgcggcctcctagctacgcccgggccggccgccgccgtgtccactcgaagctcgcggccgccgtccactccaacctcatgccgcctctcctccggccgccgcctccatcaatctccggccggcgcgcctcctctcctccggccggccgccaccatctctccgcgcaactcggccgatcgtcgtcatccccgactcctcatccacgactctgtgcatgtgtgtgtggcatatatatgtgtgtgtgatgatagtggctgacatgtggggccgggtttgttttttttttggatgagatgtggctatgtgctatgtgctcatacatgtgaatggggaaatgtgggttttgtttgtgatatataagggtgaattttgtatgcaggatgaatgtgttgaatgtaggaaatgtcggtttcgtttcgttcaattttaattaaataacatgttgggaagatattttcaatttttttatatgactttcagtaaatgcttgtatatgacattttcgttatatgctttcatatgacattgtccgagtagatagtgcttttatatgacattttcgggccatttcggttgatatgacatttagatagtgcttttatatgacattttcgttaatgctaaacgatggtgctttgatatgacatttagatagtgcttttatatgacatttctgttaatgctaaatgatggtgctttgatatgagatttcggttatatgacattgtccgagtggtagatatttttaatttttttatatgactttgagttagtaataaattcaaattcttttatatgtacgcacattaaataatttttattgtcattcctataatatagaacgatggcagatagtgcgaaacgagatgaggataaggcctctcctccggcatcacaggctattgtggttgcttcgcaaccgaacgtggaggcgtcaacggctattgtggttgcttcgcaaccgaccaggccaccggccgatgggtctagcagtgacgactctgacgagcccggcaaatattcctcgccaagtgacccacatccaagccctaaacggcggagaaaagttgatggccaacaagacgacgccgattatgtcccccttaagaaagcggtgggtcttccgtcatattcgtttgagttgctaattcattgtttgacttgaaagtactaattcatgatttttgtaggaaaaggccccatgcagatctagacgccgagccgaaaaatccacccaaatcgaagacgtcccagctacgacctctgacaccaagaataaaccaaagtctcctaaaaggagaaagggcgagaggagcatcaacaagataaacaacggggtgtacgtcatcacccacataagtcccaaaggggagcctctcgctcccgccactgcacgcgcaaagttcagctcacagtgtggggtaattgtaagggacaagatcctaatcacttacaaggactgggataaagtgccagcaggggacaagaaacttctgtaggatgagataaagaaaaggttccagttccctgacggatctgaagcaatggcaaggaattgcgcattgcaaacaatggacaaggcatggcgtgggtggaaaaacactttaaacagaaactacgtgaagaagggcaagacaccatacaagaaatatgggaaaataacgctgtcgcaatgggacgaattcgttaagttcaagacctccaaggaagaaatggagaagagtaaagtgatgtccgacttggcgaagcgtaacaaatggcaccatcgactaggttccggtggttacgcacccaagatagaacaatggaataaagaggaggaggaaatgaagaggatgggggttccggtgcccatggaaaactggaacgtacgatcgaagcaatggatgaaagctagaacaccgaagatcactgcggaaggcaaagtgcaatttgaagaccctgagctgcaggtagttgccgacaagatagatgatctatcaaccaaggaaaagaaaggagaattcactccacagagggagaaggatgtgctaagccaggcactggggaaccgtgagcacggaggctgggttagaggcgtatcctctaagctgagttggaaagaaggcttcaaacaggacgcctcctcgtaaaagaaacatgacgcctacaaggaaaagttgagggacgaggggggtaagcggtttgaacaagaaatgatagatttctgcatgaaatattctattccactacaggatcccaaagaaccggagccagaatatccgttcgaggatttacaagagactaaaccttgccggttgcacatcccaattggacgcgctaggaggacacttgaggcggcgaagggaattgctattcctggcagaaactaccatggcggatttattgaatctgcatatgcgaaagtgcagccgcaagaggtgaatccagggttcgagtcgtacgacctagacatcccaacacatgatggaatcacagtacttggggatgtggtcgaccttgtcattctatggcacaaaaagaatatcatatttagcaatgtcgccgctggtcctggaaaaccaccgagacctcctaagcatcgatcgttgaaggacaaggcggaagaggctaagatacctctgccaactaaagggcctgacacacctgacttgccacataaagaacatgaggtgcaaagtgtaccggatgtcgaagaaccagatgtggctctaccagatgtgcaagttctttcatccatcggtgtatagctagaagacgtaccaacattgcaatgggatgaatcagaaccgaccatccatgaggacccaaatcctacaagggaccctgttgaggagaccactgttgaagccacggacaaagataagtccgaagtgcctagggtgctcagaagccacgaccccaagaaaaaggatgaacacaaggagaaatacatggtaagcgtcttcagagggggcaaggaaagagcactactaagaggggatgatgcgaaaaaggccgctgcactatctggaccgaaatacatctggactgaagattgtctagaaaaatttgaacttgacaaagcttttctgccggattgggcacttgatgaggctccatgggagatgaaaaggctccatacatggtacatggatgccagcaagaaaggcctaactaacataactattcagtcaccggcaaatgtcttcgccggcgaaggattcttctggcttgatttcagtgacctacacgccatctatcgtcgggataagatggacgtaaactacgttgctgcttggtgcttgtgagtacgagtgttgtatttattgcacgaataagtatgtgatcaattattaacgaaatgcttttataggatgcaatccatgcctggagaacctatcggatttctgtatccaacaaggatctgtcaaacttagcatactgtcacattatcaccaaattccgaacagctcaagggcaagactcctgcagagatagcggaatacaagaagagcttgcacaagcaaaagatgactacggtcacacagtacatcggacgagccttcttgcacttccaaaataagagagtcatcaaggccgcgtacaactttaagtaagtcaagtagaattcattgcacatacctatgttaattcatatgtgactaactgcatcgccattaatatgtagggatcaatacatatgtttccttatcgacccaaaggcaggcgtggtgacggtcctggacccccttgattattctcacacgatgtatagacattttctacaaatcttacaatagtaagtgattctcatacttgcatgcctactaatctagcaatagtaagtgattctcatacttgcatgcctactattaattctatacagtgcgtacaattactacaagttcaagggtggagaacagactaaaacaagggagaagctactagtacatacgtattggccggtacgtaatactaatatctcacttaatccggtacgtaatactaatatctcacttaatgtatttcaattgttttacaaatttcaaaatttaactatttccttcaatcacatgaagtgtcacaagcaacctaggggcactatcctctgcaggtattatgcatgcgaatacctccgggttaatgggaggtacagggttaatgcagaggatgtaagtctctcgactcaatgtacaagcctattgaaccactacccttatagatcgtactaatgttttctcgttctttcatgtttacagttgcctagaattgaacgtcgagaaggattcgatgatacaagcattaaaaatgtacaacaggacctctgccacttcatccaccgcgagtgttatcatgtcataggcaagtacttcgaccaagacagcatcctggctacaagcgatgaattcaaggcccttcgggagtggagtaacgcgatgccatgacgtgttcattagttacatacgacagtgtacaaatttttgtataatactttgaatgatactttgaatgcaatacatgtcagtattcaatgctcattagttactatcattaattatgaattaattaattaattgcaacattattgaaaaaaattattaatacaaaatttgcggctattttcaattcttggtgcttttttccctggcggccctatcctatcattgcgggcggcctatactaatcttcccacgcggctcgaactagctcccagccgcctgggaagaacatgttcccaagcggaccggccgcccgcctgggaagataatctatcttcacaggcgattgcctacaggcggaacgccggtccgcctgggaaggccattttggcccgcctgcaaataccatttttctagtagtgcactatagtatactcatagtacatactgccagtgtaacaaaggctgtgtttggaatcagttattcccaacatgaacggtgagcgcggaaaacgaaacgagccattagcgcgcgattaattaagtattagcgatttttttaaaaatatagatcaatatgattttttaagcaactttcgtatataatctttttataaaaaacacaccgtttagcagtttgaaaaacgtgcgcgtggaatacgatggagaggggctgattccaaacacagcctggcattttagtagtttcacaaaattaaaagggcattctcagcattccatcaagtcattatggccccgtacacagtgagccaatcgttctgatcccttcggtgtaaaggacgatggggaacagtcatagcaccctataaacattcacgggtctacattataacaattatagcaccctataaatacaccattgtctattcctaatctccatcacagagcagagaaactagctccagttggcattcaagctctctctccctctccttgctagctgctcatcaacaatttgctatacttcccatggctacttacagtagctctgcacttttcatcctcttcttgcttccaacattcctgagcatggctgccagcacctactatgatatatgtcctgtggagtgtggttgccctgaccaaaatgaggttaccatgcacttgtacctgcaccagtttgttgctggagcaaatcacccaaaccgcaatgaagaatttgtgatagcctcgagctatcctaatggattcggtacaacactcgttgatgactggtatttaacagctacaaccaatcccaatgataatatcgttgcacgtgtacaaggcatgcatgtccaggctggccaaagcaatgctaacatgtggtacacttcccacaacattgtgttccaggatgacaggttgaaatttatgctagcataactagatgtataatttaaatttccctgctatagtgttgagtaccttattgacttaattaattgttcaattgtatgcattgtcacttctataatcttctctgatatatatgaagctttatattttttatcaaaacaggtttaagggatccacacttcaggtgatggggattattgctgcaagcagtggtgagtggtctgttattggtggaactggagaattttcaatggcccatggcagtataaagttcacaacggacccaagctctaccagcgaggatgctgttcgagaacttaatattcgtgcaatctatactgcagataatccacaagctgtaagtagctttttattctgtccaatgttttcaaccatgtgtcaataaatataaatgaaatttttcatcaagctcttaatgcagaggttaggaatacctacccccgacacggtattaatgaaggggttacgatcttaatgatagcaggaattttaatattttattttttttcattgttcctatatagggtctacctatttatatagcctagctagtttttgttaatctaaacaaattttcgttgtagtcaccatgatattttagtggactacagcttgaataactgttattcatcttattatgtcataataagcatcttactttacttgttatatgaagaaaatgaaactgtgcatgtaatggcatgtataacagtaattcattttatgtcattatgttcaggctcgtggtacagcatcggtcgcaaatgctactcgtctgccatgaaaagaattgatggaaataatattgtggcgtctcaccactactgcagcgtcaagatatggtgttatcaatgttctttcctaccgcctttctctgtctgatcagttcaaggataatgtgtggccttctctggtggtattatatatcatcagtcctgaatagatgatcaattattttccagtttgctgttgtgtgtatgtggttttttattccttccatatgttatgtgaagtgtttgtccgcggaataatgaatgaaccaacgaattttatcttgtagagaattgaaatgactcgcctcaataatgttttacttgtatacggtcaaaaaaattccacatgatttgctcgtacagacactagtacacaaacatcacatagaggcctgccggaaccatatgtgccgatttgcttaacatcggagcctattaggtgtttcctgcttaccgaatcttttttttttctcgaacactctccttaccaaatccatttgggcgggatgcaattaaggccctgtttgggacagcttaagattctgattctgagaatctgctggttggtagccaatttctagagaagcttggtttttcaacttttgggttataattcatttccagattaagtaactacagattcctagaatctaggtgataatctggactgtttggtggagctagagattctgagagaagctgcagtagctagaaactcccccaaacaaacccttcaatacaaaagtagtatttgggcgggataaaaattaagaacctgcctgtaagatcccctccccaacagtcctcaattctcaataagtttcggataatatgtaagaatcggcacctagaacaaaactcctaataggtaccggctcataggtgccagctcatttaaagccggcacctattgatcatttcccacctccgcgggatggaaaaaaatatagaactagctccatggagcagatacagatgcttattctaaataaaaaccagtacctatagtatgagcgactacccgacgcctaccttatctacttgatcattcttgtgtccattcgtctctcctttacctccctctccctctccacctctcccttcctctccatctctcccatcacaggagacacctacccctgacacggcggccatcgacgtggtgactcgctccctctgtaagccgcttattcaccttcaccgtcgtccgttgcccccaccttacatcggcgggcgacaacaacccccccccccccgtctccccctctcgagaccaaccttcaccacattatccctctcctccctcacaatccctggccatgtggctgaccatggcgacctcgattcctcctcctcggccagtcggtgaaagcagggaggcccgaagctgtgcctcgctaacacattccctccacagtcttacatattcctccgggcaacctgccagtgtttggctaccgggtccggtggtggcctccgacggcaacgacctagatgagtattggattttccagtgagcagttgatttggggatttcttctagtcgatgtccttattggatttttgtgtttcaaaattatggtaaatagcataatcaaatgatatcggtatttgatttggatgattttgttcttgtcaaatgattttttgtgcaccggggagcaacttgaagcatcggctcgatttgagccgatgcatcgaccctatatttttgggtttattggatccatgccattgcaactaccatttattttgagtttgtcaattttgattgttcttgacctcgatatttcacaattttatattttatagttactaaaaataattaaattaagaacatatagtgccatggaaaattaataccatgttatttttttcactccaattttactaatgtgtaaagctttactataacttttagcttgaatatttgtaaatctttatatttgtgtaatgctttaccataatgtgcaatgctttactacaacgttgaaaccaagatcggcccctcgtcactcatgcaccatgaccacaccctcactttacattctcatcaaagataaagaaaatagtaacaagttcttttaacttgataaaccttagaacaaaatataaccttttttgtcaattatttattaacataccacgaatgttttaacatgcctcgatctatgggttgataggcagatagggtaataatccgggtgtcatcagactggagaaatgtatcacgccacacaattgctcagggagcaagttctctttattacctggttaattgagagctggacaaaatctttttacgcacttgagcctacattttcctctcacgtcgccctcccccaggggtggctcgcgaggcgacgacccgaccgctccctctcccccaccttcatcctccacatcgccaccaccccgagtggccgccggcaaagccgtgcggccgcaaggacagcggcggcggggcttctcgcttctcgctgacctcgtgctcagacagctggggagccgctcagggcggtggcgacggtgattgctagatccgcgctgctcctgcctgatctggcgaggagtcagctggcgacggggacggcgatggtggtggggatggcgacggcgacggtaagggcgagctgcgccgggctgcggaggccgatgacggcggggatggcgaccgcagagaggcggcggtggtggagaccgtggatcgggcgacggcggccggtgggaggagccgtggcgcatgggcgacgccagcagtgggaggccggtgtcacgcccagaaatttagcccaagtttccagactatttcgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggtttcagctccactccacaggcaaaactcaactggggtctgagccttggtcttctaacttcgtcttcagctcagaagcactacacttctgaaaaggggtaataatagcaagactgagtacaaccaccgtacccaacaagccacaccaacgatgcagacgtgcaaggggatacaaggaggggtttgtggctatttgcataaaggcggttgtaaaacattttattgagcaaaacagtaaaacggttgagtaattaaagtaatattaaatctccactgatcaacgctacaccacgttgaacaggcccaaccaacccacctgaactacagtgcattgggtcgatttattaagatgggactaatcacggtgaatctggtcgaccgcccataaccgcgggcacggctattcgaatagttttactctgatcagaggtgtacaactgtacccacaagacacagcctcccgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccttctcgtgcctaggtgaatccggaagccgcataggccgtcgcagggcccatccaaactccatcacgcccacccttgcctggatgcgttggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatattaaaaggtctaatactgtaattgtcctatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttatccttgcgaccgcgatcttccgaaacgacggattctacacgctggcacgcaaaacgaggaaaaactctaataaaaaccaaggaaatagtatataaaaagtaaacaaacatgtagagctcaattttagatgaattttgcaagttgaatggcccaatttggagttcgtatgaattagatatgaattttagaagttttgagccatttaaatgaattcttagaattaaactcgatttattgcgcaattattatttatttttccaaaggaaaagagggttgttgacgtcatcaaaggggaggggcggcgccggcaagcgggccccaccggtcagcggcacaagggcgtcggtccaccgtggaccgggaccaccgaggcggcccaccgccggtccacgggaaccgacggcccggatcggcccaaagccgatcgaacggccacgaggcggcgcggctggggcacggtgtcacaccctaaaaatcctaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattacatttaagaaataatttaaattgaaaaaggttttaaaagtcttcttttggctttgggccgaaagtcggcccaaaaccgctctctctctcctcggcccaagtcggcccagtccgccgcgcgcgcgcgcgtccgcccgctgacaggtggggcccacctgtcagggtcgtcgtctacctccagccgccgccgcccgaaaccctagtttcgcgccgccgccgttcctttccaaattcggtcgatcctttccttctccggccgaattgatagagggaaacaatctccgggatctcctctaccttttctcttttggaatcatcggctaattctttttggaaattgttggattcgagttcgaatcggattcgtctctttcctccgaaccctaaaccttccttctcgtcgccagccgccgtgggccttcgccgtcgcctccgagcccctttaaaaggttccccggtgtctcctctatccgccgccactctcgccttcgcctctcgtcgccggaagagttctagcgccgggcaacctagcgccgccgtcgccgccgtcgctccagccgtgcgccgccgccgtctcggtcgtcgtcatcgctcgggaaggccaccgtcgtgatcgccaagtcgccgccattctcgtccgctccttcgccgccgccgaagaccgccggagcaccgtcgccgccgtcaacccgaagtttgccgccgcttcctcctcgtcgccgtcgccgtccgttcctcttccgccgtcgctttggtcgccggtgagttcgccgtgccgtccgctacccgttggtgccctccgttcgtgccaaagcgccgccgttcgccggtgagcttgcgccgtccgagccgtccgagccgccgagccgccgccaccggtggtgatgtcatcgccgacgtcatcgtcgccctctcccgtgagccggtcgtggaccgatcgatctcggccgtccgttttggatcaagtcgatctcggccgtccgttcgcgtgaaccgccgccgtgcgcccggtccaccgaaaccctagcccgctgacgcaataaatccctttttccttttcaaaaataattcattattgcgtcataattcaattaaaatcaatataagtgttttaatccgattaaatcttcaaaaattcataactaattcatcttagctcggatttagttggttcaagtctgtaaatttttctaaaattgagatctacatattaaaaatatccacatgtaccgttcatgcttgtttatgtgctgttttggtgattttgctcttttctgcttagatttcgtcgtttccggagagtccgttttcgccggagaagagtttgaagagttccaaggccagcaaggcaagtcacacagatcccaaacaaccctttgagaatgttgatcccgtttaaagctattgtttctattcaactattgcatttattttcgaatgtcattgggtggaattaacctattcattgttatagcccttttgttcttgattactttattccttgataccttgggttattataacttgactagttgggctttatatattggttcagctagatattaggtataattgcttagccctgcttagaaacattagcacatcatcgggataacttatgactcactattatttaatgatggcttaatgatagttcacgatggtcaatcgtgattgattaattaattaatgtgccaactaaaaccagataatggtgggttgtgagcacatggttttgatggtcgtgcgcgtgacaattaagaaccggttcacgagtttcggttgtgaaacattaaccgtgccaaccacaagccagcgtgggcaacggctttatcctttgtatagcatggttcattgcggggcaccagactgagaagtgacggagataagcccacaggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtgtagcgttggattaatattgtttaatacttaactgttttattaaattctgaaatgtttgctaaatgctgcttttgcaaatgaaaccctattatgccatcctttattatcctgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctacgccgtttatttttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacacacgggcacggcacaaagccggcctagctgagccatggcgcggcggtggcgcggtctccggcgacggcgaccgacgggcggcgcgggagaggcggcacgcacgggagatcgacgcgacgcgacaagggggggtccgggcggcccaggcgagcggggcggcagcgcacggccaggtggacgccggcggcggccaccggcgcggcagcgcgcatgggagacagaggagggatgcaaggagggagaggaggggctcaccaaggacgcggcgacggagggagcggccgcggagggaggcggtggcgctccacggggcgaagacgacggcggcgattcagcggtctccaacgaaggtggaggagcggccggggtacgggggagcgcggcgaacgcagtagaggcggtggcgtggcttggtggtggctagggcggcggtggcgcgctgccggagtcggcaaagtggcggtggagctcgggttcacggtggaatcggtgcccgggtggtttattgcggaagcggagcggtggacgggatgcggcaaagcgcggcgaggccggcgatgcaagcggcgcggcacggggacggcggtagcggcggcagcggccggctggagtcggcggcttcggtggaaggaggtggtgcgcgtggcgacggtgcttcggaggcggggaggggaaatggagcggacgccggggtgtggcacgacgcggcgaagccgctggtggcggtcacgcggaacgacggtggtgggagcggctgtggtgaccggctggagggtcgtcggcgagcggcggcgggaggtgcgacggtggcggggtggttttcgtgcacgggagggctcgggagagaggggaaaatggagagggaggtgtggggaatgtttttataggggaggggaggcgggatcgagcccgagagaggtagaaaccggccggcaacgtgggaggagagagagatgcgggaggcggcgacgtggccggattttgcgggggaagagtggggggaaacggcgcggacgtgggcgacgaccgcgtccacgcacgcgcgggagagggagtcgcgcgggagaggcggcgacgtgggaggatttggcggccatggcggcggttggggatggagctggaggtaggagaagaagatgacaggtggggcctcgggtcccacctgtcggggagagagaggggaaaacgggcgagggaggtaaagcagacttgagagagagagagagccgtgcgggccgagggaggaggccggcccgagagggagagataaggggcacgcgggccgcgggagagaaaggagggattgggccgaaaaggggcccaaagagaggaaggaggatttttttttctttttattttaattgatgcaatgatttttgtgctattaaaactatttctcgagctccgaaaattcacggaaaattccggagagtacattagggcacaaagaatattacaaaatattcccggccaaagattttttttaaaggaaattttaatttcctctataatttcacttgattaaattgatttaacttttaatataatttctagaaatgcattattaattgatttttaatcccgaacgaaaatcggggtgttacagccggcgaggtgcacggtgaggtaactcagctatccagcatcgtgtggtgcggcagagtcagcgtcggcggggaggccaccggtggtttgacggtgctgcgggcatggtggtatctgtaacgatggcgagagcacggtgatggagggggcatcggcgtggcgtggagggtggcaaggcgatgacgggacggtttgatggcgaggatgtgggcaattagacaatgacggtttcggcggttgcactgctaaggggagtgctgtggttcttcgatgggccctattctggacattgtcctcttgcgatagcgcctttgccgacaaaagatggccacgtcgagcaggctagtgtggggagagaggagatccattgtcctctctcatcctctccccatccaacccaactgcatggatggagctggagcgcatcgggggggggggggaggtcatgccccttcttgacggccgaccaacagagaggcgtcgcccgtggtggccacgcgttgaaggttttcgaaaggtggttgcagcaggagtgtgacaggaaactttcttgggaggggtgaaataattatgggcgaaagctttgccttcggggcagcaacgatgatgcctatgggtgccgttttcctctagcgttgctgcataatctcgtttctcccagttactttcttctcgtttctcccggttactttcttcaagtgaaaatcatgtcctgactccctagagcaaaaggcagcggcgctttcggtgtccttcccttattggatgcatcacttcaaagatctttcgttcttgttttcgctctcatggcaggtgttgtcgtagacgcgtgacgtggttgttttttttcttgactatagtcttccaggactagacttgtatttttatcctactttatcaatacataaaactcgcactatcttgtgcgattagttttaaaaaaataagagctggacatttctatcttgccaaaaagacatttatttctggattgtttgatttactattttttggatggtttggatcttatgcaagcccaccatgttgctctggatccttgagggaaatattatgctaatttggctgattgtgccgccactaaaatgtccatatatgcataaaagaaatgcatggatcggcttcttatcaagcctgtagagaggaaaacaccttgtgcgtgtaagcaaggcgatatatacttagtattctgccagagaaaaacagttttaatggttgtccatgacttcacggacaaaagaagaatgttttcaactggaagatatatgtttctagactatcgaaaattgtaaaaaaataatttctataataattcttttgttcgtttggtcgggcaaggtgtgcacattggaatggacaacttgtaatgaactacgtacaaatgtagaatactcatgtgtactaggaaaaaagacaaatatattgtttcttcagtaaaggctagctgggcactggtggccattgtctttgctttctaaaattattttcttcatttcacgaggatttggaattgatgaacacatcggcctctttgtgtccgtaggcagagtattcttattaatctttcgctaatatatatgctagcacaaaaatgtccgtatgcattaaaaaaacccagcgttaattgcaagcccttagtgagttagttgatagctcactgaaattatactgtgagctagttcaacattctgcaattaatgtaatacaggacaattttaattgattagttatgacttatggggaattgatttttttattcggtcacgatatggagaattatactactactacaaccggccatcatgatacgaactggccatgtcgtgctggccgtaattcggtcacgtatcatgaaccagacatggccttctcatcagaccagccagcacgacatggtttacatgtaacaggaacgctatttagcgatcagccgccgcgcgagcgcggcgcggcacgtggcacgcgagacgggggcgggacgcgctgggataggggacacgtgtccccgtttcggtttttcttttttttttactttagttttcaccttttttggtttttcttttttttctttttttatacgtacgatataaagtttgtatatgtgtatgtaaagtttgtatgcatacgtatgcaaacttcgtatacgtgtatatatacgtatatacacaaagtttgtatacgtgatgtattttctagttttgtcaaatttttaatatgtagtacatgtgtataaagtttgtatacatcgtatgcaaatgttaatataccacacatataaactatgtatacatcgtatatgaactttgtatacgtgtatatatttttttatacatataaaaatatatttttatagtagcagtagcagtgtagcagtaagtactagtgtgtgctgtgcagacgactaaacgcacgcccatctgcgcattagcaggcccatatttgtaacttcagctggcacggaaaacgtgaaaaccgaactgaactggtacttagatatatccacacttaaataggacatcttattactcacatatagccactcttaaatgggacatctcataagaaaggatagagcttatatatggaacgaagatttagagcttgattcaacccgaacaataattaatgtacgcacgctgtcatgatgaaacaaattaagaataacttgacaaattttctcggggaggcacaaattttcaacaggcttttctattcttctaattagccatatcacctaataattacttgacccagtattaccttatatacattgctagcaaaccaattcaacctaggactcaactaaggtacctagatatcaagcatatggcatacacgtacacatgtcatatggggattctaagttaatctgacttccctaaagataaaagtttctctcacccatatacatgtgcatgtcatacatatgtatgcaccataaatatgcatctaaaataattaaacaataacattaactctaacatatataagatataattttgtagctggtgacttttttcattcgcatatatagtttacatgcctatatgtatgccttataaatctattaccagaaaataaacttttagatttttcatatatgacttcaaataaagataaactttatatcaaagtttgttctagatattcatagatcttacgactttttatttaacaaccatttgaaataaagttattcagagatccaaattattacaaaaagagtatactttagcataatgatttgccccaaaaagattgtagctttagatatggggtccactagacttctttattgtttcttcttttttatcattttctccttcagttggaccggagtttctactctctccttattttctcgacgacacttcctcaattttctatcgccactcctgtagccaatctagggtgcagcttgggggcagctagcccaaaagaccatgcaagcctccgatggagccgagcatgcaaaccacattaataaagagcatactatagtcttttctcgaccatgctaatatagctcaaccaagcaaaatctacactctttaaaatggttttacatttttagaggaggattgttaggagaaccgcctgccgcctgaaatattaacatagcacatgcaattttgtagtcagttcgcttgtgaaattcttttttagatgaccaaacaattatagaaaattcattttaagtttagttgatttgaaccaaagttctttcagtgatcctacaatattttcatatgtttgttcagttatgtcaagttgccttatataacttagcatcagagaaactaaaaactataacaaagaaaatattgtaagaatatttggttcatgtcaattggacttaaaactaattttatatgaattttcaaagtttggacttcctaacaaaccacatgcgagaattaccctatttacaaaaacatagatgtaaaagcttgtaacaaatacttgggcacacaaacaatctcaactgaaagaatattcaacaggtctcatcaagctctagaattgagactgaaaaactgaaagttatttctataaatagatttaacagcttataacggatattttagccactaaattatctaaaaaaagactttcaactataaaattgtagattttgttgagagctataacattcatatgaaagagttattacatttttctcttaaaaatatattgattgctccaaatttagtctagttccttaagacaaccacttgtgaaaatcaatttctacaaacagtttcatacacatacaaatcaatagaacataagccgaatcaatagaactacacatacaaatctcaccctattttcacaattccggtttttcatgtggttttacactatatatggccatctcaccactatcacaagagagttttcttatagtttgacaataaaacataagccgaagcatctgctcaaacagttatttatagtgctaaatttttctaaaacgttcatgttgccaccacacaaaatcaatttgtagcagaatatatgtatcattccaattgaaattaaacatgcatcattcgcactacggccttatagtacataacatgttttaataaggaaataaaaatatctatggggaatattgatctgtttagaacgaaacttcacttatttattctcatgagtcatgagatccgcagagaacatatatatcaaacaatacacataacaacgatgataaactgaaatatttttatacaaatacaaacaaacgtgctttattttcatgcttgcaccaatagcatgagacatgacatcccatttctgaagaattctcgctgttgtcccgtgtcatggctgataaagagcatttagaagcacacacaacatgcatcaatccacacattattttcatccccggtggtttgcattttcttgtccgcatcgtttgctggttgcattattcagcctggcctgttgtacactttggagtgatcaatgtatcatgaacctgaacaaacagtcaaaatttgttaacgttaatactgttatcagatgaaaatgtcgcatttaatacccatacagcatcgatgtagctagtattgaccctagttgcctatcgttctgtgagttctaaagtgcatacaactcgattgttgctatcactcaattcaaactgccaaatagtatactctttgtatatatataaaatagagtaaagtccatcaccggtccctaaacttggaccgctgtgtcatcccggtccctaaactcgcaaatcgaccgttcatgtcctcaaacttgttcgactgtatcatcccggtccctaaacatgcagttcactcgtttaggtcctccaacttgttcagttgtgccaccccggtccctaaacaggacggtctaaaaactttatatcaaaaaataattcataactttttcatgttaactctaatgaagacaaactttatattaaaattgtagcccttcgcgacctacaactttgtagttgaaaagttttttaactaaaactgtttagggtcccaaaatattgttgcatgtttatagattttgtaattttaattttaaaattacattttgggacaaaaaatgacttaaaataaaaaaaaattcaactataaagttgtagatcgcgtcgcggctacaagtttgatataaagtttatcttcattagagttcacatgaaaaagttatgaactatttttaaatataaagtatttagaccgtcctatttgacccagatgatattcaaatccaattttagagaccggggtgacatagctgaacaagttgcaggacctaaacgagtgatctgcaagtttagggaccgggatgacacagtcaaacaagtttgaggacctgaacggtcgatttacgagtgtagggaccggaatgacacaacgatataagtttagggacctgtgatagactttactcaatagattattcaagtttgtaatagttaatactcaattaaacatgtgctaatattttttcttgttttgtgtgtcacagaacattctggttggttatgcttttcaaaatggaacat

SEQ ID NO: 39409 - DNA, 2554 bp, Oryza sativa
aatgaatggattcatgaagaaatatacctgctggaccaagcatggagagcaagaggcgcatgatgtcgtagctgaagaagtattggatcaggatgtagagaacaccaccgtagcttgagaaggcatgttcgtaccttctcctttaggtggagagaccatagatttggacactcaatgtctatctacaatgttgcatgacattgaagatgcagaggacaacgacagagattttgagaagtttagtaagttggtggaagattgtcagatgccgttgtatgatggatgcaagtcgaagcatagcaagttgtcatgcgtgttggaactcatgaagcttaaggctaataatggctggtcggacaagagttttacagaacttcttgaggtgttaaaggatctgttgccagaggggaacaatttaccgcagacgacatatgaagcgaagcaagtattatgtccgttgggcctggaggtcagaagaattcatgcatgtccgaacgactgcattttgtattacaaggaatacgctaacttggatgtctgccctatctgtgaggcatcaagatacaaaagagcaaagagtgaattgtgaaggaagtaagtcaaagaggggaggcccagcaaaggtggtgtggtatcaagcgaggcacatcgcctactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtcaatcaggaactggtgagttcactacttaacctaactaatttccgttcgtataaagtacaagttcgtgtaaacgactattttcttttgtagttgggcttgattgctgaacaagcttcacaaagcgaggttgagtccgcgccgaggaggcgcgaagatgacatcctcacaaaggcgctcggaaccaaagaacatcctggccgaactcggggaattggtagcgatgtgccctggaagcatggactccctcagtacagttcccaatacaggaaatggaaagtctccaaggaagagagggacgctcgttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgcacaacacgacgcgagtccgtcacagcataggagtagttgtgcatccacagaggtgccggcccctggtctcccgatcgcaccactagctgcagtggatcacatcgaggtaattgttgttatccgatccatatgtaataaaagacatttacacgttccaatattaaattcaaactttcaccttatgcagggtgcagcacagtgtgtcatactagcgagagtccacccaacttttgctcctaaagtcgctgagggcatggctttcaagccctcggttacagacaaggtccacggcgcagacctgctagctaggtatgccaaggtgtccatcgatacagtaaaggacacctggtcaggctatccgctgcccgtgcccccaaatgatgaactcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagtggcgccggagccaaaaggggcaaggctgcgacgtcgatgccggtgagcaaagcggggaaggtcgtgagggcgccagcccaatttgagctaggcatgccattggtggaggacaatgtgttagccgtgatgggtattgcttgccgagagctacataagcaatacatggagctaagcaatgccaagcagaaaatgagagagtcatccatagttggacgtcgaccaccagccgttcctatcgtcgcctgcctatataactataggctttgatgacctcttcgaccttttcaggatccggaagttgaacactggtcttctaaaatgctactccttgtaagtgcataccttctatacttgtgatatgattggactatatctcctaattaaattagttctaatacataaatgttttatggttgtgttggatcgagagtcgtcgccttggtaatcaggttgggttccttgatccatccatggtgaacgaggttaatttacgacagagcttcactgaggtggttgactatgtcaaccggtgtttatgggcccatcaag

SEQ ID NO: 39410 - DNA, 4164 bp, Oryza sativa
gacggcctttatttaaagggccgtcagagatgagttacctgtgacgggtcctaactcgccctaggctagcggagaccaacacctctgacggccttctagtaacttgctcgtcagaggtgggtgtcacctgtgacggccggccacccgtcaaaggtgactggactcaccagtgaccactgatcactcaccatgcgcgaagccgtcaaagatgagggtttgggctcgtcacaggtgaccttggccagtgtagtgaacgtagtgcatgttctgtcaggaagagttcagtatttttaagaaatacaattgtgtaccacttgggaggaatcaccatggtgatgttatataaggaaaaaatgatggcgtatatattaattgatttttcattatttaaatgtaccgaagcacaaactagatcaaatttgtaaaacttcaaaagtaattattaataaatcaaaatgttgaaatggacactcgctaggtgttaatatgcaatttatttgattttggactttttccccctcttttccgcacagtccatgcactcatttatactgaaattttcaaaacataaaaatatgctctagcaagtcacgatgacatttaaaaaccaaggatgtttttcttataaatatatatagtggctgtcgacgggttgtacccatctatgggatttgtatagggtgggaaacactcgtactaatatatatgagagacaacgattaagtaggtggaagacaagtgatttatatatatatatatatatatatatatatatatatatatatatatatagccctaggaaatctagttgatgaaactattgtctagtttggtgccaaaattcaatcagcgaaaatgataaaatttgagtttaatttctagaactttttgcagccaaataatctgcagcaaaaataattgcagtgtttttagtataccaaggtcatgacgtcctctaggcacaacaaaattaacgccacaattggaacaccgtacgtagaacatcaaataaattgatcctcgctctgtgtgatgctctatctgcactgttccgatgccttgtcaacgtaacgctgcatccgtgcacgcacctatacttggctgcgttcgattctgtccgtcgggaactcattccctccgcatagaaaaaggatcggtttattaacacatgattaattaagtataagctatttttttaaaaaatagataaatatgtttttaagcaaattcatatataaatttttcgcaaaacacgcatcatttagtagtttgaaaaatgtacatgcgatatcaagttgggaaccaggagtgctgaagacagcctatatatagacagtatgagtacaccaccttagcgagcctttttaagttaacgctcacgttcacacacattctactgtttgcccgtgttattgcatcagagcaagtttaatagtatagccaactactaactccaattcatttatagccaatctaatagctcgtccatacaatagttatatactacactattaatacctagtctcacatgtcatacacacactgcgtcttgaagtccgtgctacaactggctacaaatctgtagcctactgctcttctctcttcttatttatccccttaaaatatatttgcagctggcttatagcctgctattgtacctgctctcatacccttccacaacctgtcatctgttgtggctttggttgattcgaacattactagctttcgtctatttctctagttttgtttaccaatatgtactagacacattttactggttgtttttgttactcacatgttcgggaatgttaactaagggacgggcataccactctggcaatgctatggtggctgccattgctggccggtggtgagatcaaccacacccctgacttccctggatcctttctccatcaactgcgatggcccatgccgggagtgcatggagatatgaaagacaatgaacaccaccgtgacgttaccgagctatatttgtttactcaactccaccattccttaaattttaggctggatccgccattggtccaaatgctctgttttttccgaacatagtgtcagtgcattcatgaagaggccggagatatattcttcatcctccacgatcttacaaaaatattagctgaacacaatcatgaatcatcaccattaggtgtccaccaaaacaaccacttcattttatctaaccggtgttttaatccaggtttatattcttttttctggccacaaattataatttagtttacttagaaataaatacaggtccataaatcaccaattctgtataaatattccagttttgtaaaattaataatgattttttttaaaaaacccatttatatttcaagaagctgagaaacattaccatcactactaaaatacctctaataaggggctggtcatacatgcttgctggttcatttaaaactagcacctattgaccgtttctcacttctcttgggtgaaaatatgacaacggttcttttgagcaactataggtgttgttctaaataaaagtcagccactatggtatttgtgttggttctttaaaaaaatggtacctataatatattaacaaaagaaacggcacctataatatattataagtcccgtttttaagaaccggcacctatatttatattataggtaacggtttttttaaaaatggcactaaaaaaccagccgaagccatccaagacgaccgaccttatttactcccttattcagtccttatccccatctcttattccgccccctccttctgatcccccctcctcctcctcgtccacatttgctcctgcctccccactcccacctgccccccctcccaaccgccgccacatgcacacctcctcaccaccacccctacctagcatctctgtctccccacctgtctctgttgcgtcccctcagcctcatcattgctgccttcctccttcctccctctcagcatctcctccacacagtggcgggccgacggctccttcgcgcagtggtgggtcagtggcttgccgacggcgcagtggctcgagatctagaccccgagcttaggacctatgtgatagagaagcggcgaggaggaggtctagccaggagcagtggcggcctcccgctcgcccctccctctcctctcatctcctgtgcgatttactttgtgatttccgcttcttgtataatctcccgcatgatttattttgtgatttttgattggattgtctcttgtcttgtgttttattttgggatgattttttgatgattctgattggattgggatataatttttgggtgagatttatgatgatttgggattcagtttttaactcaaaacatcggctcaaattgagccgatgcgttgagctaatctatttttttgccacacatgcacctcagaggtgctgattgtggtatcggcgtcaatggcctagagtcatatgggccacctgacggatgctgattggaaaaactggcacctatggaggattctcaactggcaccaaagtccttacctgtagtagtccatactgaaattttgattttttttttttacacttcatgacttaatactgtctgcttttgattttgcaattgttttcagattttttttatcaatgttatagtatgtgaaatggatttttctcctagtgagatttttataaattttaatgtctggatatttacagtgatactacaacagaaaaatatatggttggaagacttgtactatataattcgtggagtagttgcagttgcagctaggaaggtgcaacgcattcatgttatataccacctccggtttttacaccattgacttattgacaatcatttctcttcttaaaataacatataattacgatttatttcttgtcatttgtttgatcattaaatactttaatcatgatttgtactttcttatacattacttgactgcgtgaggtacagagtttgtgaggatacgtgaataagatctacgtgttgtcaccctcaaggtatatcaagtacgaacaattttttttttagaaaatgggataaacccggcctctacatccgatcggatgtacacatccaacaataaaacaagagttcttagactccaccttacaaaggttcacaaaccaacatcatgacacatcaacaccaacacaagag

SEQ ID NO: 39411 - DNA, 804 bp, Oryza sativa
ttagttttggagccattaaagactacatcatttctacaaagccaaaccgcccaacacagagtttctataccaacaaaaaattgatgtttaagcctaggttgaacaccattcagccaattacaaaaaagattagcaatgctagtaggcggatggattccaaaggttatagacacaacattccagattaatctaaccaaatgacaatcaataaaaagatgttgtatcgtttcattagaattatagaagcaacacttagtgctacctttccaccttctttttgcaagattatcttttgttagagtaacctcaatggaattctaagctcccaaaggaaatatttccttggaattactccgttaaacatgagagttctgtacatggagttgatggtaaatgtttcctttttattggctttccacacaaagacatcattttgttccgtaagttgagttgatataacttttgagaccaagttataccacgctgctaggttatcccctacaatagctcttctgaaagagacgtttaggggcaccttttccaacacttcggccaccattacattttttttcctaacttgattatacaacgaaggatacatcttatcaaaagaggaatcaccactccaacaatcctcccaaattctcaattgtgtgccattacctacttgaaaagcgccacaagaaagaaaagagttttcttaacctccatcagccctgcccaaaaatgagaatcccctggttgttttcctacaagtgtaattgttttcttagccacgtatgttttttctaagtagcttttgcc

SEQ ID NO: 39412 - DNA, 2258 bp, Oryza sativa
aaaagattctcgtagtatttagtaatgtacttttttaaatcttcatcacctttaattaaaccctcctcttgttctaactgaaaaattttagtcttcctatgcttgccatttgcaatcatatgatagtattttgtattccggtccccttcaattaaatgttttgttttttatctttggtgccatctaatttcctcctcccttaacagatgagctagtctatttttcaagtagttcttgagatctaactcctgcctagtcaatatttgcacctcggctttttaatctaactgatttgcttttgcacttagttcagccttctcttttctatatgtttcacttgtgctttttgcccaacctctcaagaactgtcttaatctatggatcttattttgctatctttccatcatcatagaacccttgttctcttttctccaaacttccgctactaactcatgaaagcctttcccttaacaactattcaagctcaaacttgaagaaagattgtttggtagcatgagtacgtacaaatagcatatatacttgcagaatgcaagattaaatggcaggagatgattggccatacgcaaacttttgttctttaagtatataatttgtttcacgaggacttggatctggcaaaccaattgaattgcatatctggacatcgatgtgctaatttggttttatttccacccatcaataatggctgtatatgcattaaatatttagatcagatagtacatggaatatgcccatgtagaggaagatactatgtacatgtgaactaaatacatattctgttcgctatcacaaattgatcagcccggacaattcagaatatgaaaatgtattcatgccaacttgaatatgtatattgattaaatataaggtaattcaaaactacaaaaatgcatgttcccataccgtcaaaacaaattttcgcatgcaattgggccgtctgcctgctcggaggtgtcagtaaaagtagctatttttacaagcagatggcacacccgtccatgaaattccacttttcacaagcggtaaattatgtcactgcactgctaaaagaaaaatcatgaaaaaaaaaactaaaacttgaaacccaaaacctgaaaccctagcggattcacccttccccgtcacggggctgcccggcggccgatcctgtcgtggtgccacccggcggcagatcccgttcgaagaggaggcggcggacagatccatgcaggaggggagttgagagagaagggatcctgttgtcgccgccaccgagccgctgccaccccgctcgaggttcttgccatcgcctaggtccccacctgtcgatccgcgtcacgaagctcgccgccgcctgcgcgctcccactcgagcccaccgctgcccgcacccgcccgctagcaggctgcaacttgggaggtgtagacaagggagagagaggaggtgagaaatgagagaggggagatgagagagataaagatgaggagaggattggggtgagagagaaggtgaggagataataattaggacttggaaaattttgaagatgcatgctgagaaggacgagagaacggtaggacttggaggcagacctcttaagtggctgtttgggataatgtattttcacatgcagccttgaaccgatccaacagagccatttttgcatgcagatgcagttacagccatcttcagcctggagagggtcttgtctatcaaaatcgatttatgtaatagtgatttaaaatggaattgcgacaaattagcatagcttagtaggcatgaaaaaactactaattggagaatttgtcacttttacagccaaaaaaagatgtagaacatattctatattcagtatcactaattattttttttagaattacacagtacaacgcacacacttacaacgcacgcgcactcacccctatgaacacacacatgcaaaccctacccctatgagtatcttcgaatactgggccggtaaatcctggagagattgacaaagtcaccataggcgcctcgctgtcgacgggtacgtcgcctaccactgaaagcacaatgccgttaaatcctagaaaattcgcttccatggggaggatctcaggtactactgaggctcttgtaaccaataggttacagaccctttcgccagtatcactaattatgactgctattttgttctcaaaaagaaggtgaaggacttgctactatattttttaagacaagcgtgatcaatcatcctttcttcccacataggcaag

SEQ ID NO: 39413 - DNA, 805 bp, Oryza sativa
ttagttgtgtaaggttgccaaccgatggtggaatctccccactcaaattgtttccatacaacaacagccggtggagactagatagctgaccaatatcaaaaggtatgttgcatgtgaaaatgttacctgccaactctagtacagttaatttgcgaaacctccctatccctgcaggtatggtcccaaatatttggtttcctccaagtccaatccatatgagctcttgcgagaggttgacaagtgtattcgggataaatccagaaagcctattgaattgaagatctagtgtcactagttcactacagttggtcaaggatgtgaggaaatccctgtcatttggtgtcttagcttcaagaatattattacctaggtttaatcttgtgattgtgccggagctccagatgttcggtggtattcgtccttgaaatttatttccatggagttgaagatattctagtttggaaatatttgacaaagagtctggtatcgggccttcaaattggttatagattgtgctcaagaaaactaagttaggcaacttggggccaatatccatcggcaaaaagcctgatagcatgttcaggccgatgtacataatttcaagggatgtaatattaaacagctctgggggaaacacaccttgtagcttatttcctaacaagctcaaagctaaaaggtttgttagcccagctatatttgatgggacatatccatggaagacattaccagcaacgtttaaatctgtcaaattagtcatattgccaatccaaggaggaattcgcccattgacatagttatcagcgat

SEQ ID NO: 39414 - DNA, 5656 bp, Oryza sativa
cagcgagctttggcaggttgccgatggaccatgggatctggccagacagggagttgacactcaagttgatggcacgcagtgcgacgcagctgccaaggtcatgggggatctcaccttgtaacctgttgtttgacagatcaagggcttggagataggtgaggttgctgagctgcggagagatggcaccgacaaggccaagatctcgcatgcgcaaggcagtgacgcggccggggtgggcatggctgctgcatgttacacccttccaatggcagaaaccaaacatggtctcattggagctccaagaagacatggctcccgatgggtcctcagtggcaagagatttgaaggatagaagtgcatagaggtcggtgctactactgatgggctggacagtagtagctttacccaaatgcagcatgtagattgtcgtgaaaacatgaggtaactggagtctttgggcgagttccatattaattggatactgatgcaggtggctttggccattcgactcaaggacacatgcaacttatatggatgccactaccatactgttgtgccatttactagattgttaatttctttatggaaatacctacccaagatgcacctgtgttatcctataattaatggcacatgtcaactttatcactataaggcctatttgtcaacctggctgcgtgctctagctttagattctcatatttgtcaaggtgaacaagtaacatcttcctacttgatagccgtactactcaagcgcagtcgatgcattcagattgtactagttatttctccacattgtacctgaaaattttgaattctagaaatataattgtcttggaaatttgaaaaccatcttggagttctccctggtgtttttcaggatttattggtgtttttgcactattagtgcatgaaaaacaattcaaaatacaccatgcttaaaggaaaaaaaagagagaagtatattgccgatcactagacttgctcttatgtgtcatccaggtctctgaattctcaaatacatttttaggtccccgatcttagcaaagtgtgttattctggtcccaaattaccacgaccctccaggatcctacgtggcgcttacgtggaatgccacatgggcgttgagtcattttctttatctctttttctccctgtttttcatctctcattctatcttgttcgtgtgaaaataaaaacataccaaaaaaagttggtgaacctagaggggaagaaagaaatgaaaagaaaattttggaccggaatgtccatgtcacaagtcaagtattgactgttccttttgttcttctcttgctatgcagcatttatgaaattggcaatgctagtactaaattttgggcccattcgatcacttccatacatccaacttctgctcatgtgttggcggctgttaaatgccgattctataccgccaacatctgcataaagtttagataataaaacattcaacatagtgataggtgcttaatctcacatgttccacaagtgttggtgtatagttgtatgcagatgataaaccctgaagttgggaggaaattcagactaaagtgaggaaaattatgtatccatacaaggaggggttgtgaacttcattgaaacaccagtggatcaacccaaaactccgcgaaatggatagaagaaggtctagggaattcaccgaccgaaggccaggccaggagggcccagcccaggttcggccgaaaccccctgatcaccgttgatcctggggtttggcgtggacgctcctgatgttctcccaatgacggttgcggggcagttcggagatttccccttcttacaaccgtcataactgccctataaaaggacctcacttcattcactctcacacacacttccaagcttgagctgaattataagaggttctattgtactatattgtatactagaataggaagagagtagagtagaaggagtcggatgaattccggagttgtcggtaatcttctcctatttcttttattctgtttattactctgaatttaatataatatttttcttgagtaatttaaatttatcttgtgagaattatctctttgttagttcctaaatggcatacgggattattgttcactataatcaactaaaatatagctattgctttggtgagttatcaacactaaagtagatattaattgcttaaacatggtgtttaggtaattattatccagtaattgctgcgtatcccacattacgtttgaggtgggtgtagaggtggtgacagccctcgagatcacttaagtcctccctgtccgggtacgtagtagagcgacatctgggaacagtgggttgccattgcctgaagtattgcgttaggattaaaattaagctttccctagacactgtttctcactagtgaatcatctctatcctagcctatcaattgcttggtgtccttggatgaaccggaggaagatctgaccacacacattcccttggattcgatacccttggaatactccgtaggggaagtgctacatcggtatatccgtgcgcttgcggattttatccgtaactgtatcaaataccaacaagcatttctggcgtcgttgccgaggaacggttgttgatcatttccgaacctagttcatcctcgtatcctttttcatttttgttattctaccttcacccctgctatcccagagaagtattcctgtcaaactcttctcgaccatggagcaacctctttttgagctgtctgctcctcggggcgaattctatgagccacctccttcatcggagcccatttatacaactggctatgaaattcgtcccgaactaattagtatggttagggaaaatccttttttggctttgatctagaaaatccctaccatcatctgtgagactttgaacaagtctgctcatgccttaagactcgtggcatgagacaagaaactgtgcggtggaaattgttctcattttctcttcaagagagagcaaagcaatggtacacctctaccgttggatgtgtaaacggtagctgggaaaagctgcgagacagattctatcttgccttcttcccagttacccgtattactgcccttcgagtagaaataaggagtctgcattgatcaaaaacgaatcaatcggtgcagcttggtccagattcactaatttagtccagtccggaccaaccctgtccttacccgagtatgtgcttctcccacatttccatacgagtttggataaggagtctgcattctatttggacataaccgctggaggatcattcatacacaaaatgccgtcacaaggaaaaacgattttggatcgcattctagaaaacacttccttcatgacgcagtccaatgaaccccagtcggaggcatccgtgtccaagatagaggaacctctaacgatcgagccacttgctgaaccatccacttttgctagctcggttgatgagaaggttcctgagcagccgtccgtcgagaatgaagaaattcagactctggatagtgccgcaattctgtttagggacggttttgacgaagaatacggcaataccataaactattttagtaagaggaaaccacccgttcccttgtcacctcccgatcctatggaactcgggttcctacgagaaactgtccgggagttgacatccataatgagcgatgaatggctaagggaggcagagctttcatccgaagtaattcggataaataccgctccctgaatcattccttgtcacctggaagggaacgacctcgtctctgagtccaactgtcggggccaacctcgtctctgagtcttttgcattcgcttatttaatcgacaaggcagtgaccccgacaaacaaattcttcaagcatccaaacggaaatatcatcgaaggatttgggattgtgcaagatgtgcctgtctgctttgaaaacagggaggcgatcttagatttccacgtctttgaaatccaagactttgatatcctaatcgggctgcccattgagcaacttatcatcaacacaccccgatttggtagcctcaaaataatactaggagagaatgaattctcaattccattctcgcgggcaaggatcaccttgaccgaccctctcccagaaattgagtcagtggaagaggttaccgcagttcctcctcatgagtctcccgaggcccttctggaagatgaggtccccccgatttcatcaaagaggaagcggatcccggcgagactctcgacctgccaatcatggaaccaccatctcgacctccgcttgagcttaaacctctacctccaggcctacgatatgccttcctacacaatgacagagaggctcctgtcataatcagtgacaagctctctgaagacgagactcaacgtcttctcaccgtgttagaaaagcatcgttctgttcttggctactcatttcaggaccttagggggatcaatcacgcgctttgcactcatcgtattcctattgaccccgagagtactccctctagggaacctcaacgacggctcaataatgcaatgcgagaagttgtaaagaaagaggtcttgaaactcctgcatgccaggattatctatcccgtaccatacagtgagtgggttagcccagtctaggttgtgcaaagaagggaggaatgacagtcgttgcaaatgctcaaaatgaactaattccgcaacgaaccgtaaccggatgaaggatgtgtatcgattacaagaaactcaacgaggcttaaaaaaaggatcatttcccgctacccttcattgatgaaatgttggaacggctggcaaatcattccttcttctgtttccttgatggatattccggatatcatcaaattcccatccatccggaggaccagagtaagactacgttcacatgtccgtaacccatcccaaattgctccaggccaagcacgcttaaccctggagttctttggagattgacttccggaaaagaagttgcaacttgttgatatgagtattctattaatcctattaagccctaggccgggatgttacaccctcacccccttaagagagatcgacgcccccgtcgatctaccctaggccaggaacgtcctctcttggccacgtccatgtgtccagtgccagcgcatgtgccatgctgtgtaaccactcccggtctacaccagacatgcgcaccatgcctgcgcaactgcgacacacgcgcccgtgaaaccgcgagagtcggctctgataccattttgtaacgtcccgccttcccccaggccgggcccgcttacatctgatagctttcataggtcatagactgccctcacagaccaacacatgtctcctggagttctttggagattgacttccggaaaagaagttgcaacttgttgatatgagtattctattaatcctattaagccctaggccgggatgttacagctctcctctacccgccgccaccctcgccttcgcctctcgtcgccggaagagccctagcgtcgtgcacccttgcgccgccgtcgctccagccgtgagccgccgtcgctctagccgtcgccgtcgctcgagaagaccgccgttgtgctcgccaagtcgtcgccgtcctcgtccgccgcttcgccaccgccgaagaccgccggagcatcgccgtcgccgtcgacccgaaggttgccagcgcttcctcct

SEQ ID NO: 39415 - DNA, 7933 bp, Oryza sativa
agccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctgaaactagttgttgaaactagaagatgttgatgtgggcaacttatggaggttaagtcaagtggatcgatgaataagaaggtgatggtcgatctgaagtgcccagatgtcaagatggaatgaagttggcatcctaccttagaacctatgccgccaaagtgtctttgaagaatagttagtagggtagaacgtttgttgtttgctttgtgtgtaggtatggttgcattcccgtcattggagtggttcaatgatgagtgtgtaattatactaggttgcttgcttaatcaacttaaacaatataatggtctacacacatcagatcagtgttaacctggttaaggtcttgtctttagtgtaacccttatcctcctatcttctctaatctgcaatagatggtgaacactcgcgccagtggaagtggaaacaataacaatgaagataacccaactcttgctcaagttctggctcaacagactcagttaatgaacatgatgatacagcagatgcagaaccagcttaaccaagggaacaacaatgctccaccgccgcagaacaagttagctgattttcttcgtgtgaggccacctaccttttctagcactaccaacccagtggaagcaggtgattggttgcacgctattgggaagaagttggaactgctccagtgcacggatcaggagaaagttgttttcgcttcacatcagttgcaaggacctgcatcagaatggtgggatcatttccgaatgaacagagcagaaggacaaccaatcacttgggcggacttcacggaagcattcaagaagacacacatacctacaggagttgtctctttgaagaagcgtgagttcagggcattgaagcaaaaggatcaaaccgtggcagagtatcttcatgagttcaatcgtctggcacgttatgctccagaagatgtgcgtactgacgaggaaaggcaggagaagttcttggaaggcttaaaggatgaactgtcagttacgttgatctctcatgactatgctgattttcagcagttggttgacaaagcaattcgacttgaagacaagaagaacaggatggataaccgtaaaaggaaaatgactgttttccaggaggcacaaggtagtagtcagagacagcgtatcaagccactccaaattggtgaacctttttctgctggtcaaggacagtcgcaacagttgaatatcggtggtgagatcaaaacagagactaatgaaagcaatgaagttaatatcgagcaagctaatcagccggtgccaattcagcaggatcagtctcaagagaataacagtagtggaagggagcagcaggtatgtttcaactgttacaagccaggccactttgcaagagagtgtccgaagccgaagcatcagcagccgcaaggtcaggtcaacaatattgtcgtcacaggagccaatgcagtgccagttgcgtcttcaagagttgcgtcttcaagtgttacaactcagccaccagtttcaaagaagcagtagttttctttaaagccttagaataattatcggagttatggaataagatagactgcagtttacctattccctttttctttctagccgttccgattctcgggacgagattctttgtaaggggggtagtttgtcacatcctgatttttgtttcaggatttataaattatttaataaattaataatataatttatattaagtgttctttaatttacaagtgaagttaaatgtgggaaataaaatttcctaaatataaagcatggatggatttaatttttattaaattctccatggttaattcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaacctctctctttccttttcttcctccccggccagtcggcccaagtcggcccagtccgccgagccgccgctctcctctctctctcagccgctgacaggtgggtcccacttgtctgggtcgtcgtcctcctcgcgccgccgccgccgcccgaaaccctagcgcaagccgccgccgtctccttccaaattcggccgatcctttccttctccggtgaaatcttttgaggggaaataatcttctcgatctcctcttccttttctcttatagaaactccggtcaattttctttggaaaccggtggattcgagtttgattcggattcgtttttccccaacctttccttctcgtcgccggcagccgtgggccttcgccgccgcctcctagcccctttaaaaggacccccgagctctcctctacccgccgccaccctcgccttcgcctctcgtcgccggaagagccctagcgtcgtgcacccttgcgccgccgtcgctccagccgtgagccgccgtcgctctagccgtcgccgtcgctcgggaagaccgccgttgtgctcgccaagtcgtcgccgtcctcgtccgccgcttcgccaccgccgaagaccgccggagcatcgccgtcgccgtcgacccgaaggttgccgccgcttcctcctcgtcgccgtcgtcgtccgttgttcttccgccgccgttttggtcaccgatgagttcgccttgtcgtccgcttcatcccggtgctttccgtttgtgccgtagagccgccgttcgccagcgagcgtgcgccgtccgagccgtccgagccgccgagccgccgctgccggaggtgacgtcatcgctgacgtcatcggagtcgtccgccgtgagccggtcgtggaccgtttgatctcagccgtccgttttggatagggttgatctcggccgtttgttcccgtgaaccgttgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaaatagatttaatcttgtaaaattcatttgaagtcagaatgaggccgttcaagactcataattcatctaaaattatgatctacatgtttgtttactttttatgtattgtttatttggtttttattagtctttttcttcgttttgtgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgatcttgattactttattccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcataataattatagatgttatacctggtaataattagcttagctcctggtttggagattagatctgttcagccgggtatggttgttcagaatggttgggcctgggcagcacgggtgtgctgttcagtgttgattaaaatttctgattaattactccaatgttttacttctcttaaatgttttgctaaatgctgcttttacaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacagacatgatcgaagatatcatggatgacttctcagtttatggaaagaatttcggtcattgtctgcagaatctaaacaaagtcttacaatgatgccaagaaaaggacctggtgcttaactgggaaaagtgccatttcatggtccgtgaagggatagttcttgggcatcgagtgtccaaacgaggaatcgaagttgatcgtgctaaaatcgatgtgatagatcaacttcctcctcccgtgaacatcaaaggaatccgtagcttcttgggacatgccggcttttatagaaggttcattaagaacttttctgcaattgccagacctctgaccaattgttagccaaggatgcgccctttgagtttgatgatgcgtgcctaaaatcttttgaaattctcaaaaaggcactcgtctctgctccaatcattcaacttcctgattggactctgcccttcgagatcatgtgtgatgcaagtgactttgctgttggtgcggtcttaggccaaaccaaagataaaaagcatcatgcaagctgttatgctagcaaaactctaaccggagcccagttgaattacgcaactactgaaaaagggctgctcgtggttgtttttgctatcgacaagtttaggaggagccaaggtgataatttatgctgatcatgctactttgaagtacctgctcactaagaaagatgctaaacctcgtctcttaagatggattttgctgctccaagaatttgacttagaaattaaagatgaaaagggagtagaaaattccgtagcagatcatttgtccaagctgcaaatcactaacatgtaggaacagccgatcaatgatttcttaagagatgacatgctgatgacggttcgcgattccaacctgtggtatgccaacatagtaaactacatggtatccaagtacgtaccaccaggggaaatcaatgaaaactgaagtatgaaagccgccgtcacatatgggatgagccatacctgtatcgggtctgctccgatggcttactacgaagatgtgtgccaactgaagaaggacttaagatcatagaacgatgccatgcctcaccctatggtggccattacggtgcattccgcacccaggccaagatttggcaaagtggcttcttctggaccaacgatgtacaaagacttaaaagaattcgtcagaagatgcacaagctgccaaaggcaaggaggaatcactgctcgccatgcaatgcccctcacatacaatttgtaagtcgagatattcgatgtttagggtatagacttcatgggacctttccctaagtctcgcaactgcgagtacattctggtggcagtcgactatgtctccaagtgggtagaggctatgtcgtgcagcgctgcggatgcaaggcatgccaagaagatgttcacagaaatcatcttcccaagatttggtacccccagaatggtcataagtgacggaggttctcatttcattgataaaaccttccgagacctcctacgagaaatgggagccaaacacaatgtggctactccttaccatccacagaccagtggacaagaagaaacatcaaacaaataaatcaagaatattctgcaaaagacggtcaataaaatgggaacaggatggaaggatagattgccggacgcactgagggcataccgtacagcatacaagacacccattggaatgtccccatatcagatagtctacgggaagccatgtcgactacccgtagaacttgagcacagagcatactaggacgtcaggaattggaacatggattttgaggaagcatgagaatggagaaaaatgcagattgctgaacttgaggagtggagagaaaaggcttaccacaacgcaaagatatataaagaaaggacgaagcgctggcatgacaaaagaataaagatcaagaaattcaaaccaggagacaaattacagttgttcaactccagagttaagcccttcggccacggaaaactgcgcagcaaatgggaaggaccgttcgacgtcatcgacacctcttcgcacggggcaacctgtcacaccccgaagttctttcccaagcctaaattggagttttaaatggtctcaagaaaatacctgtgtcaagcaagagtaaaccttaataaattaatgcaaataataatcggaattggcatgtggaatttttcttgagttttacatgccgaaatacgctaacaagatttttagtggaattttcagagctctcgatataattttaaccaattaaaattgagcacatgcaattttaatcccaggaaaaatcctttttccttctttttcctttttctttcttttcttttctttttttcctttgaatg

SEQ ID NO: 39416 - DNA, 722 bp, Oryza sativa
cttctgttggaaataaattctagcacaattgctttaaattcgttaccattatagtctaagctgtcacacaccgtgacaaccttaacaagtttccgatgttgtatcctcctcaaggcatcgcactcagcaaaaaagccctgtgtttgtcccttttggcgaagatcaagtactttcatggccaccgtagctgaattcacaccagaagttaaattccctttatatacatatccgaaacttccacggccgattaagttttccgaggacaaggaatctgttgcagcatataactcaacatatgatatcctaggatatttctttatgagaagcgatgtgatatgctcttcatgatcaatatcttttgggattgttcgttggtccttaatgaaatagaaagtcactagacatgcaaatatggtaaatcctccaacaacacaaatgatcaatataagctgcacttggtgctttgaatgactattatgagcaagagatgatgggcattctgaaatccaaagtataaagggcctccgcatagcatatcattactcgagagtgatacagcagtgggattacagaatattcctttatttggcacaagaccagagaggttgttcaaggaaaggtttaaatgcttaagaccttggaaattcccaagaaaatcagggatgggtcctgataagttgttgtttgatagatcccagtcttctagtcctctaagtgtactg

SEQ ID NO: 39417 - DNA, 1161 bp, Oryza sativa
acgagcaaagactaatacataccatgacttcaatgatgccactttgactagaatctgcagaaacttttaatggttcaaacaatcccatccactgctccttgggagcattaaagatcatattagttcctgacatgatccgaatggtacgctcatcaagcaagtacgacaaacactttgctttccattgcttccacaggataaacttgtcgatgatttgtgttttcctgtgttaataatagttttgagtgagttcaaactggagcctgctatggtctcaaaaaaaggacacagatatatatggattaacaattgtaacaatatagaaatttgggggattaagggattacatactgagcagttgctgaggtgcacaatgtacttcctgcactatcaaagctgtcctttttcatgctttttagaagtgtgttcagttctctctcagccaaagaaatacacgatcctgaatccagcttcttctgtagttctttaagtagaatctgtgaattacccgtaaacaaggattcttcacaaaattcatcagagctagtggaatgtccaacatcacgggcattcttggttcgcatcaaactaggtaaattcatatctaaaatcgattgcacatactcttggcacacattgcattcaccactagcagaaatgccatccatatccatctcaacaactgcttgaagtacagcacctaaattctccgcattcgttgttttcagaaaatgcttcacaaccaactctcttgccatcgcaagtgtttttgatcggatatcctcaataccctgcatgacacagggtagaacatcactacatgcaaaatcagaatggatgcagccaagaagcatcttttcagaagcaccttggggaaattcgggcttgaagcgagttgaacgagtgcagcatcgagctcacttgcagactcatcgtactgaccatcgtcacgcaggttcttgaaaacctgaacacaatgcaggaacatgtgttaacatttcagttcttcacaacaacagaaattcttcatgtggtcagtgtctgtccattaaagtaggaaaacccccctcctaagcagcattgagaacgatgaacttccaatctacacggccttcccccgagatgctgagagaatcatggcgtcggagggggcacgacgca

SEQ ID NO: 39418 - DNA, 7549 bp, Oryza sativa
ctggcattggttgcttctggggatggttggtgcatgtaatagctggtaggtttaatatttacattacagaggagtggtccttgtggtcccatttacaaaataaaatggagataatttttaagtagtaacagatcattacgtttagtggttataaaaaaattggatactttagcagattaagtacttctctagaaccataaccccacccaccaagatacacacaacaaactaaacttcttagcccccaagaggatcatagactcttagtttcagacctttgtttcatctttcatttcattctgggaataggctggtaagtagcttcacaaagttcaattaaccatttagatttagcaacacagaattcaaatcaaattactcatttctgtaatcttttgtctgatttctctctaagattttcttttttgttgttctgtttccttctatccttcagtgtgtttctttgggaatcactgtaataggcgggacttgttctattcaagtctttaatgcattcattttctttgtttctgtttgagcagtggtttaattctgcaaaattatgttccattcatgcctcaatcgtgcccctccccgcccctctttttttttgcttcttcaaatatacttctctttaccctctattcactcttcacatcagtatattttggtccaattacaattttctttgctaagatgtatagcagcatacttgatgttcacccttctaagtgctcaccaaatcactatttgggagtcatagaaatatatctagctgttgggttacgaattgttgtaagacaaatctttgctctatgtggaaaaaaaacacttttaatatctgaacaagaccagggaaaacttatttcgttttcaagtttgatgtaatagacttctgcatttggctgatgatatgaccagagctccactttaacagattgaagtgaatcatcttaggggtacatgaaacaggcctacatcaactatgaatcagcttcgcaatggaaaagttccccaatatctttcgccagctataactgtagtaccagaactctctgaagttacatttcctagtttttcagagcatagaccatcctatatcgaaagggagcagtgtggtagttctatcaactcatttgatgcttctactccaatgtgtatgttagcttccaactttacatcagatctttatatcaacaaaagtgaatcacctaacggcaagctttcttctgaatcatatgctattgatacctctggatgtgattcttccttgccgccaacacagtcattatacaagggtaatccaagttctttaaggatggtttatcctaaagtatctgaacagaatagttggagtcaagaaccactgcctggaccatttgtttgtccaactagtgttgatttcttcgatcaacaagatatgactatttttgaccaacaaatacaagataacattgcagcaagtcctagcaccaaccttgcaaagcaaaatgagtggttctcatctggcacttccttgcagtatttggaaagttcggtgtctgctggttctgtgctgaaggtatctgatttgacccttttggatggtgcactaactatttcatgatttcttatcctctctcacagcctgtacggcaatttagaccagctcttcattggtctacttaaaattttagataacatttcccctcatttccaggctgttgatgcgacaagtacaacaccttcaaattatttgcattgtcatgcacagagaaatacatcaaatcctcccaacttcaatgaaatttgttctggtaatatcgcttcttcaaacattgctccaaccaaaccaaggatgcgatggacacctgagctccatgagcggtttgttgatgctgttaacaagcttggtggaagtgaaagttggtccctgatcctctgtttttcttatcatattttcatcttgaacttttacggaacagtgctgttttcacaagaagaaacaagtacaagtctctgttttcctagatctattttcatttctgtttacttttctcttgcagaagcaactccaaaagctgtccagaaagttatgaaggttgacggcttaactatataccatgtaaaaagccatctacaggtctgcatttgttgcttctgaattttcaatgctttttatacgactcttcttgatttttcctgatggccatgggttattcttgtgcagaagtatcgcacagttcatcatcgacctcaactatctgatggtcggtgtgtttcgatgtttcaattttggtttaatttcaccataacaagatacgtggtgcactatgccggtcattgtactaaattagaatgttgcagtgaccgtactatgttgttgatgctattagagtttatatattgatctttaagagactgaattttatcatgcgctgtgcctatttaaatttgaagtaaatttgaacgatctggagctttacacaattttctttatttttttctcataggtgaatctgcgaaaagtggccaaacggatgaagtttcttctcagcccttgaagtgagatgatttttatgtgatatatatctctgagtcctagaaattttataaatatcatgtgttggcctagatgagtagtggagcataatatcacatctatgctccgacctggatgaatttgcattttcttcctaacttatctctggatgaatttaagttcaaatatatgtcgtgtgccagtgttttctaaagtcttgactgtgtacctactacagaggcatggaaaccacctgtgaaggattaagggtccagattggcttgcagaaacaacttcacgaacaacttgaggtgcccttattctttcaataataagatacttgatttttgttttgaactgcaaaagggaatgaacacgccagattttgtgcgtttgactaatgtatagggtcccttgtattttcctctccacagatccaaagaaagctgcagctgcaagtagaagaacacagcaagtacctcgccatgataatcgagaagcagagcgagagcctaagacaactgggagcattaccaagatctctagatgcacccactcaggttttggataacagggaaacgtgcgagggacaaacaggagatgctgattcagcagagcaaaaacctgagaaatgaatgcataatctggaaatttcagaagagacgccttatgctgaatcattggctgcaggaagtgagaatcagggccaattttattcagacatgatttgctcattggctgtagaagatgagaatcatattcatatcccaaatactgggagtatgagctgtccacttgatctgaaactgcgttgctgttccttcggtacacaagttttcgttcagggagatccaaagctgctgcttttttgtgaaaaagtatgactatgctgtagtgtaaccagtgtcagattgtagttgtagttcaggaacaaactcacaataagtcagtgccaggcatggttagcttatccatctctcgatggtgtacacttgtaacatagcacgagtacctttttagaagttccagactaaagacaccactcatttacatgtaaatgctgcatacaaaaccatatcatttcccccaatttattttgtgtcttcatgttattattgttacagcaggatacagtgagcaaaacacaagatgcaatacgtggtgatatatccattatccatacgagtggagtgatttatttcagtgccagaagctacaagcagaagcagtgctgtaactgctgatgccattagtgcactgcttgctagcttcatggagcaagcagaaactacagccaaacggggctagccattgcccgcttcttcagctcctggcacgctgcggcggcgccggccaacatcctcggcgccgcggtggcgtagaggttgccgcgcagcccctgctggatcagatcatcggcaaaactatcgaacagtaagctaaaataggcaaaacgatcgaacagtatgctaaaatagctattaggctctgtttagatctcctggcaaaattattcaccctgtcacattgaatgtttggacacatgtatagagtattaaatataaacgaaaaaataattaattacacagattgcgtgtaaattgtgagacaaatcttttaaacctaattgctccatgatttgacaatgtgttgctatagtaaacatttgctaatgacgaattaattaggcttaataaattcgtctcgcagtttacaggcggattctataatttgttttgttattagtctacgtttaatatttcaaatgtgtgtccgtatatccgatgtgacacgccaaaactttacacctttttgatctaaacacagccttagcagggttggaaatttcagaccaaaatttcggtcccctccgatacgatattaatttggccgaaatttttaaattttttcatgaatttgggtaatatttattcaaattcaactaaattttgttcaaaattttggaaatttcggaccgaaatttcgggatttcggtgatcccgatcaaaaaccttcaaccgatagagttaaccctgagccttagtacttagtgactaaataaagcttccattatagctaccttggtgatgagggtgaggtccggagagttcgcgccgccgttgacggtctccgccgccggctgccgcgcctcctccacgacgacgatctccgccgccttgggctccacagccgctgcccgcgcgcgcgcgccgtcgtcgctgaggccggcgtaggggagcgaggtgtggcacgcggcgcagtcgctctgcatgaacaccttgcgccctcgctgcactctgcatacatatgctcacaaaaagctccaccagattagcgccccgaaatgcggtggccaacggccggaagcgagaacgaactcgccggcgtccacgcggtgctcacccgtcgttcggccacgggtaggccgggcaggcggcggcgccgccgtcgccggaagtcgcagccattgattccgacgagagagctgcagcaagcaagctagctacctggtcgagtgggcgcgtgtgatcgactgtgaagcagcgcagcggaccgacgcctctctctgcagataacgaggagctccgattatggatggcgtcgtgctgacgtggatggtagcggatccacgggccacggccagctatgcgaatgcgacatggtatggtggcaaagccgttttctcccttgcaaagcgtattagagccaccagaaatgctattcggtgcacgcgcgctagaaacacgagtagagctcaccctaaccatttatatcgcatcgcatcgtctcctcctttcgtttgtttatgttattgaaagagcatctatgtttttttaaatagaaattgattatattttcggtctctgccggtagccacacggccagaaagtctaagtaaacagaaaggaatttaaaaatgacagccgacgaactagacgactgataggcggcgatgtatccatatgagcggagtaattaattttatttgagctccaatggaggaagctactgctacaagagatcatcgatcgatggggacattatttgcagaagcagcgctcaactgctgattatgcaggctgcattattcagagttgagatctagtcagatcgaagaaactagagccagacggggctagccagtgcccgcttcttcagctcctggcacgccgcggcggcatcggccagcatcctcgccgcctcgctggcgccgccgccggagtagaggttattgcctcgcaggccctgcacacgggatcagacataatttggcaaaacgaacagcaattgaaggtaactagctaatgccttaatgcgtgtgtgcttgattaattacctttgcaatgaaggtgaggtccggcgccgggtagtacgcgccgccgcggagtgtcgccgctgccgccaccggctgatgagcctcctccacgacgacgatctccgccaccttgggctcccacgccgagtcgtcgtcgctgatgaggccggcgttggaggagaacatgccgtggcacgccgtgcagtcgctctgcatgaacaccttgcgcccgcgctgggctctgctcacatcacatcagaaaattagctccaccgggttaattaattagcgcgcgcgacgtgggtaatttcatgcaaaattaatgtgatcaagcgaaagcaatcgacatgcattcatgctctcacccgtcgctcggccatgggtaggcagggcaggcggcggcggcggcggcggcggcgtcgccggcggtcgcggccattaattccgacgcgagctaggtaggcagcttggtcgagctagcaagctcccgatctacctgcaatggctatagcttggtctagttgatctgtgaacagcctggctctgaagatctcgaggaacacgttgcctcgtttatggcgcacagattctcgttcacgtggggctgaagtggaagcttcggccgtggagacggcggtatctcatccttcgggtatagttccaatttgggcctcagcattgtggcccaaataaaaatagacctagataagcctggcccaaaacacatgtagtcgtcggccatcttcttgctactactttcggcccgaagtatcccgctctttttttttacgatccggcctatggtaaatttacgtgtgacatgggcggcccaaaggggggccatcaaatcaactagtcaagtcagcttagaaaaccagctgcgccaaccgcggaaattagggagtgtttttttatgtacgtgtaaatttttagcatattacatcaagtattatatagggcgtcgtatagggtgttcgagcactaattaaaaaactactatttccgtcctagaatatagcaacctagcataggatgacacccatcctaggacgatgtatttggatatgccttatgtttacataatccgtaagaaaatcgagagacaaatttattaagtctaattaatttattattagcaaatatttattatagcaccacattgttaaatcatggagcaattagatttaaaagattcgtctcgtaaattagttgtaatttgtacaattagtttttttcgtggctggggtgcagtggggctcaccggcgactagagccagacgactcgatcatcagatgatgagatacaggaggaggaggagaaaccgcgcgcagggagtccaccgtacgtacaatgggcgccgcagggatcggagacgcggtcccgcggcgcccgcagcagaaacgcgcattcgccgccggcagccgtgctcgcctaccacccacccacctacccacgccgcagttatgttgctgcgcgcattcacgtgcagtcacttgcagccaggagcaggactcgtccggcgcactacccgccgtgggctctcacgctgcacggctgtaccggacggacggccagtgagagcagtagagcacgacctggattcgacgtttcgatcgccatgaacagtctcagcattgcaacatcgctcactcaactctcaactccatcagcactaggagaccaccaatggcgtcgttcgtatgcaccagct

SEQ ID NO: 39419 - DNA, 32176 bp, Oryza sativa
cccccccccccccccccccgggtgctcgatcgaggcttccgcgcagctctatgttctaataactgcccttggcctgaatctgaatttactctggacgcgaacccgagcaatatcgcatcgccaacaaggaaatctgtcagtaattagcttcagaggcaatcagacctgcctgcgccatcctcttcgatcttcttcgtctagctagcttcatcgagcctacaaccagtaactgctactgtgtggtacgtaaggttgagttatttgggggagggagggagtaggcgtgatgtagctagctgatgttaattataatcgacagtgcataagccgatgtgtactgctaataggctgtgtttagttcacgtcaaaattaaaagtttggttgaaattagaacaatgtgacggaaaaattgaaagtttatgtctgtagaaaagtttttatatgatgaaaaagttgaaagtttgaagaaatattttagaactaaatacggcgtgtgtgtatatagagagagaggaatgtactgctatattcattttgcaaactgcagctagctactccatcttcaacggccagcatcagtttgcatcgagagagaaaattagcagtagcatcaaataatatcgtttcagttcgtcgcaattaagctagctagccatttaaggagttagctcgatcgtcggcgtcgaagagggaccaagattaggcgatcgattccatttgagtatctgactcatcggctgaatcataggagagcaaggctaataatacagtcgatctgttggctataaaatttttttgtagttttctcttagcctatctatataagagcatgtaaactataaaccagctataaacatattttaaagagataaatgaagagagataagagtagcgggctgcagatctgtagctagctacagcacggactctaagacgtaatgtgtatatgacaggtgggaccaggtattaatagtatagtaagcaactattgtatgaattggctattacattggctatagatgatttggagttagtagtgggctatactattaaacttgctctaatagttagctctttacgattagtacagggcccacttgtttctctcacagagtttcttggttcttgtgtccaagccggctgtaagtttacagcccacttctcctctctctctctcctttcttctcttctccacctcagcatttagtcggcttatagcctaccattatactttgctctgagtactcgtactaagttcgcgtgtaaatgccactgactgcacgagagaaactgtgcatatcctgcgcttacacagtgtactacggcctaggcatgatctagatgatgaatgcatgggagtaatttacagagtttatacactattgcattgcaacttgcgaaaaacgcagtgctacactcttgagaattaatgctggctatccgcagctagtgatgatctgtgagcaattagcatccaattaaacaaaggatatgtcaccgagagccaagtgatgcattgatctgatttctcagtggcagactggcagttggttgttgtaatttccctcaaacaagttggtacgttgtagtaacagagtggtatacagtgctactatacattcagaagttgatcgatcttaataggcgttgtaacgctactatacattcagaagttgatcgatcgttactgacgggaggtgagtaggtaaaggcattattagcaagaactgcatcggaatataatgcatctaggaatacttttgtgtgtggggggtgggtgtctgaaattaaggagaactatgtgcaagagcgtgtatacactatacattagtccaccctttcctggattataacgagatatgtagagctagctgagctgcatattttcagcttttagcggcagcaactgttgctacctcagttctgtggtgactggtatgatttttcacttgcaaaggcaaagccaaacgaattgaagcaagtaatagtattacgcatgcagtttatagcgtgcttagtagtaacagatcgatgatcattcgaacgatgtgtttctttcaacgtatgctttaatttgggccgttagaccaggaaaggaaggtagcaggcatgcagctggtctggtgacccacattttgcactgctccttgaatgtgtgcacgcaaaagggtcacaaaaatatcctcccagcctcccaggggcatataaattaccacgacaaagttgaaatggattttaaactctccagcgcatgcatctgtcttcatttcctacgttcggtctgaataagaagatattcttttcaaaaaatagattactactacttcctctgttcccatttacacagctgactgcagcattatttaccatcacagttttaactctgaacagtattttttttttactaaattgctcgattatgattaaaaaaattgtatcattttattaacttatcttgcatgtactttaataatacagtgcatgttgcatttgcaatgtgtattaataaaaaaaatgttagtggccaaagtctgaaagtgagcactcattgatgcaaaaagtgggaacaaagggagacatataagattaaatgggaccaacataaagaagaagaaaaaaaagaaagtagcctgatttcattcctctatattttaatcgaatttgactgtgccttactttcttttttgagaatatatggcacaatctcactctttccggtcatgaataagtgatgttttgggacttgttttattactatgttactatattatactaactctatattttaatatatgacgctgttggttttttatccaacgtttaaccattcgtcttattcaaaaaatttatgtaattatcatttattttattatatgacttgattcgtcattaatgttctttaagaatgacataaaaatttttatatttacataaaagttttgaataaaacgaatggtcaaacgttggtcgaaaagtcaacgacgttatacattaaaatacggagggagtatatatttgttttgaaaattttctttacgattaaatgtaaaacgcacatgcacacaactactactcccacgcggccacgcgcccgcctactcgtgagcacggatacaactcgggaatttcatgttaatggtttggagatacaatctgtgtatgcgtaaacatgtgtgttgaggccagctggtacgaatcgttattctttagggtttcatcttcatatataccttttgtaagtcactgttcggcgttataacctcaccttaatatagtgaagatattttgctggctagtgcccttggtttttttctcttctgttttaggtgggttttccacgttaaatctcatatctttgtgattgatctagtggtttttatcgtttatttgcttatcgtttcttaagaacgtgcgtgtgctcaagattattcaaactcttaaatggtttttcgcttttattatgaacttacaattatcgatatgttttagctatcaaaaatgggagagaaaagtgtctacgtactagtcacacaaatacggcaaacggatttgttggtggagcaatggtcctaggcatggatgctcgcaatcaagtctgctggcaggaggcagagagagcaactctcagccacaggtaggagtagctctcatcgctagcagacacgtacagaaaagcactgtaattccagctcgaattccccttcaatgcgctcaagatgtgtaccggccgtccgcagaatagaccggagcatgcatgctgtagctttcaacatcccaaccaccttcgacctactacgactgctatgtacacccgaccactacgtacaaatatactccctacttccctaaatatttgacgtcgttaatttttttaaaaatatttgaccgttcgtcttattcaaaaacttttgtgaaatgtgtaaaactatatgtataaataaaagtatatttaacaataaatcaaatgataggaaaagaattaacaattacttacattttttgaataagacaaacggtcaaagatttttaaaaaagtcaacggcgttaaacattttgagatggaggtagtattagttagcatcaaaaagggaacgtcgtggtctctcagggtacatcgatttgccctttcaatacgataaccatgcatgttgttatcgcctcatccgtgagtatgggactactcctaacggctaatacaaacctagggtgtgtttggttcacgatcatatatggatgagatatgctcatccatattttgttgaatatagtgatttaatattttttttttcatttggtttgtacgcatatgatgattcaactttttgtttgggtggaacaatgtagcatggataggagaagccaaaatttagtaggacccatttattatatatactctctatgtttcatgtgataagatgtttgacttttttcgtagacaaattttgttaagtttgataaagtttatagaaaaatatagcaacatctaaaatattaaattagttttattaaatctaacattgaatatattttgataatatgttttagataatattaaattagttaagagttctcttctgcagtcatctaaaaagagttcttctacaggtaattaatttggtctatagttctatatacgcatgtaggcaatatgggagaacaaaatggcaatgtataacaatatatgagaatagaatataaaacacttaatttttatttttatcttcatctccggaggattcaaacaccacctaactgatactgttatagtaagagattttagatggacccgcatgcggactcctattttaagctcatgattttctaaaaaataaaatatccaatcaaaatatcaaccagcgtcgctgggttggacgacaggagtaaaagctagctatcgtcttttgatccggccctgatcaatggatttccactctctcagctcggcctatataaagctaacgagtacactccactcccacagccatctcctctctactgtcaatctcaagtgcgtgcccggtatcagctcgaccggtctcgcacctgcaaccaaaccacacacagctagctatcatggcctctaagccagggcctctcactcagtggccgtggcataaccttggaaactacaaggtactaaattatgttttatcgtcatcatcagatttgatttgatgccatacgttgtttgtaagctgattgcaacaatgtgagtaattaacgactgttgcgtacgtggaaatctacagtacgcgctggtggcgccgtcggcggcgtacagcacgtacaggttcgtgacggcgagcagcgcggcggagcgagacctcctcaacttcatggtgttccccatgctgctcctccgtctgctctacggccagctctggatcaccgtctcccgccaccagactgcccggagcaagcacaagatcgtcaacaagagcctcgacttcgaacaaatcgacagggaaagaaactggtaattaatcgatcaaattgagtgtacgtctaagggactgtttagtcggtgaaatgaaaatttcgggtgttacatcttttgagattttgcttcagtctagcgaaaagtaccttaaggtaacggtatatcacagtactaaatcgtttttgttcgttgaatcaaactggacaggatggacaatattagatccaatcatcagaaacgacacctcgagatacttttcgttagactagagcatatctctaagttttttgggttttcatatttacatatatggatgcagggatgaccagataatcctgacggcgctggtgttctacttggtgagcgcgacgatgccgcaggcgcaggtggcaccgtggtggagcacaaaggggatggtggtgacggcggtgctgcacgcggggccagtggagttcctctactactggctgcacagggcgctgcaccaccactggctgtacgcgcggtaccactcgcaccaccacgcctccatcgtcactgagcccatcacctccgtcatccaccccttcgccgaggaggtcgtctacttcgtcctcctcgccatccccatcctcagcaccgtcgccaccggcaccgtctctgtcgtcacggccaacggctacctcgtctacatcgacttcatgaactacctcggccactgcaacttcgagctcgtccccaagtgcctcttccacgtcttcccccctctcaaatatctcctctacaccccatcgtacgtataaatttacctgtttaaaaatataccattacaatttaacgggattgctatttagcgcaatgttggttattttagtacacctttttttctttctgaaaactttcattcaaaaaacttatattggagaacttttacatgaaaatactttatatgaaaaagtgtacagtgagaaatatgagtaataattaattatactaattaactgctaatagagatcattaattagtgtatgtatgtatgtaggtttcattcgttgcaccacacgcagttcaggacgaactactcgctgttcatgccggtgtacgactacatctacgggacgacggacaagtcaagcgacgagctgtacgagaggacgctgcaggggagggacgaggcggcgtggcggccggacgtggtgcacctcacgcacctcaccacgccggagtccgtcttccacaaccgcctcggcttcgccgccgtcgcgtccaacccgcttggcgccgcagcctccggccacctcctccgtgccgcctccgccgtcgcctcccctctcctctccctcttcgcctccaccttcaggtcggaggccaaccgcctcgacaagctcaacatcgagacctgggtcatcccaaggttcacctcccacgtacgtaattttgactaatttttaaatacaaaatatactcatacaaaatctccatttctttaagtatttttttctcgtacaaaatatacgtatagtttggaatgtttgtttttgtgtatgaggaaatagtgaattaattgcgtgcattgatggaatcgcagtatacgtcgaagagtgatgggtacaaggtcagccgtttgatagagaaagcggtgtcagacgcagaagcaagtggcgcgagagtcctcacgctcggcctcctcaaccaggtaaatgcattcgctgacccacctgacagatccaattcattgcatgccttctcactgttcgccggctttaatgtaacagtaccagcagtaggtgcaacttcgtagcatcactctttcctctctgcactagctccccaagtagttacatgggaccgaattcacctaccaagatttacaaaatttattaggctgtgtttagattcaaacttccaactttttccatcacattaacctgtcgtatatatataatttttcagtcatattgtaccaattttaactcaaactttcaactttagaaagaactaaacacagccttactagcatcagacagtataagaatttttttttcatgtttctcaaaatatatctggacatcagttgaaaacgtgcataaatgcttatacaccattttggaatggatggagtaataaatttcagcagccagaggttcatatgacagtggcactttttacttcaagaaaaaggaacagtgtttagcaaatgttcgccccataaatctgctttggtcctgcacgggtatatgtcaggcgatgctaattaaatcgatccaattgtacgtgcaggggtacgatctgaacaggaacggggagttatatgtcgtcaggaagccaagcctgaagacgaagatcgtcgatggaacaagcctcgctgttgctgccgttctcaacatgatccctcagggcaccaaagatgtgctcctcctgggaaacgcgaacaagatctctctcgttcttaccctgtccctctgcaagcgggagatccaggtataataccaaaatgacagtactcgaccagttaatattcttaacagtatcgatcacggtgattaaaaaggttactggctgtaactaatttcgaacaaaaaaacaggtgaggatggtaaataaggagctgtatgaatgcctgaagcagcagctgcagcctgaaatgcaggagcatctggttttgtcatgcagttacagcagcaaggtaattgaaaattggctctgtttggatccgaagggctattaaatagcccttcaggattttgctatttaagagtattaaacgtagattactgacaaaactcattccataactcctaggctattttgcgagacgaatctaacgagatatattaatccatgatttgctacagtaatgctacagtaatcagccgctaattatggattaatatatatcattagattcgtctcacaaaataggctaagggttatagaatcggttttgtcgataatctacgtttaataatcctaaatagcaagatttcagagcgctatttaatagtccgaaggatccaaacagggtcattgtgggtaactggacgttgtggcgtggatgaaataaatcgaaactgcgtgcgtatgcaggtgtggctcgtgggcgacggggtgacggatgaggagcagatgaaagcccagaaaggatcccatttcgtgccgtactcgcagttccctcccaacaaggcccgcaacgactgcgtctaccactgcaccccggctctactcgtccctgaatccttcgaaaaccttcacgtttgcgaggtactccctctgtaccacttacttcgtccgtctcagaatatagttatctttagctatgaatctgaacacatatgcacgcagaattggttgccgaggagggtgatgagcgcgtggcgggcggcggggatcgttcacgcgctggagaagtgggacgggcacgagtgcggcggcagggtcaccggcgtgcagaaggcgtggagcgcggcgctggcacggggattccggccatacgacgaccaccaccaccccggcatcacccatgatggccgtggcgggctgtgaccggccggtggccggatcgaagcaacctggcctgattgtgtgatcttgtgtgtgcttcttcgctcggttgatatataggagtatctccgtgtgtgttatgatggggccagattaatatccagctataaaatcccaagctgtattgttaattctctgccggtgtcataatctattgtttgagcataacttaaatttgagcatgattaatttggagatactctctgtttcccacttgctactgtaatgagtactttcctacagttttatcgctacgattgtacttgtagcggggtagcggctgattatcgatgtatatatccaccattcatcgtcacaagcacggttgattatagagcttctagctccattcaagagaagcggtccttttcctaatatccggcgaagcttccttaagatgtggctgatgtggttgaatctagtcgagatgatctcaacctctcttgcaaggaggccccttttgggtatggtcgctggttttctttgcagttcacaatgtttattctctctttcattagtggtttggatctaaccgtttttcttgcaatggttgttgttgggttgatcttgcgaaagaaatttggcgaaaatcttcggtggtgtggccgaggatcaaattgtttgctagtgcctcaaccttcgtatacgagaggtcccttcagggttcatgaataggctctacctgttgcagctcgccttgttttaagccccgccaaaatcaagatcaaagcatttattatcagcgtcgtaggcaaacaaaggagaatgacccgattacctttttattctctttgtagattttttctgcagaatgttgatctaaagtataacttgcctattctagatgggcttctgtgcaaaactggatataccctactgaattatgctcgacgcactactgcaactcatgtatcttgttcttctccctctgttgtaaaatgaattctgttctgaatttgaatctgaacatacgctatttgtttaaaatctaaaaccttaatgtttaaatcatgctcagtgctcaatcctatcaatttcattgtataatatgacttatatagagagagaaaaagaaatatcgttaggaagtatggtgatccgttttcaatagttaatgtgtaaaatgaaccaataaaatattttaaaggagtaaaatgaatcttttttttaagaaaaaaaaatggaaccgatagacagacagcgtctcggcctcgactcccgttcctcccgttcctcccttcggtcggagttgaacgacacgacctccaccttagggaggggagcacacgcggccgatttccgaccgtccgtttgcaagagatctgacctgtcccgtgcgacacggacggtccagatcgatccacgacctcccccttggaagcacgcgctggacacatccagctcctacctctcctgaatcgctcgtcagatcgcgtcagttcttcgcgatgcctcggcggcggctccggcgcggggacctcgcctgttcggtggcggtggcggtggcggtggcggcggtggcggtggcggccgtgggggcggtgggcggaggcgatggcggcgcggatttcgactaccggaagctctcggggataataatccccgggttcgcgtcgacgcagctgcgcgcgtggtctgtgctggattgcccctactcgcccttcgacttcaaccccctcgactccgtctggctcgacaccgccaaggtcagaaccacccctcgttccgtactgtcctcctgatattcagaaagctacttttgctagtaactgttgttgttctggataatatatgtgcttttgttcttttattaggattcgttggtctgttcttgtgaggcattgatggattaaagtaattttgcaatggcccatcaggcagatgcgtgtgtgcgactgcacatctgcttgatttgagtgaccatctagttataggttttggaagtgtttttaggactaaatcggttgtgtgtactacgtaaccatgctaaaactagtgacacgttcagttagaagaggtttgtcattacttcactggaaaagggatatttgttaattgtgtgatggttgggactgtttcctgtaaggcgtcatacggcttaattgggtgaggttgttacagaagcattcaatctgtgcaatgaacaggctgtaacgattatatttgttacatgtagggggtcatatttaagtattatctttcattttcatacttgcgacttaatcgggttcatggtgcagctcttatctgctgtcaattgctggctcaaatgcatgctgctcgacccttacaaccagacggatcatccagagtgcaagtcaaggcctgacagtggtctttctgcaattacagagttagaccctggttatataactggtaaattatatgcctcgcttaattctccttggtattgattggattattgaattttgagtacaaatatgctgcacgattcatcagcaatgtgatagattgtgatttatgcttcaactcccatgcaatggaaaaaaaaaaccatcgatggcaagtgagagtgataaaatttgacatcaagcttttgtgagttaataatggatattgccatgagaataatagcattagctaggttacattgcaaattcatgttcatcggtaagctgtagaattccccatctcgttcctcaaagaataaaaaaatgattagccataaaaaaaatctttcttactaatttggttttattggccaagttttcaggtcctctttcttcagtgtggaaagaatgggtcaaatggtgtgtagaatttggtattgaagctaatgccattatcgcggttccatacgattggaggctgcccccttcgatgcttgaggagagggatctgtacttccataaattaaagtttgtaacacttcacttcatatcacatagcaatcaatttactcactgcccattggctttcgatagtatttgatgttattactaataattggtgtaaaaacacttctaaattgtatcaaccagaatatactcactttgtttaccttccataccctcaaaaaatcacgcataactaagtagtactagtatcagaaatacaaaggtttggttgcctttggtgtgcatgcaagctgaaattgataattttttttgcgggggaaattgataagcttttacttgcttcttttcatttttttatgacatccttttcacttgaattaaaagttgttttcttcaagtttatacaatacttgataatgacacggcgatatgtcggaaattcattgttgcatgcggaaagatagtattttggtgctcatagtccttttaactgcaggttaacttttgaaactgcattgaaacttcgaggagggccttctttagtgtttgctcattccatgggtaataatgtgtttcgctactttctggaatggttgaaactagaaatcgctcccaagcattacatccgatggcttgacgaacatatacatgcatactttgcagttggtatgtaaaccagaaggaatttaattcatcaccatcgttatttgttagtgtcatgccatttttccttgctttcaggtgcacctcttcttggttctactgaagcagttaaagctgctctttctggagcaacatttggtcttccagtcagcgaggtcagcctttatgaattatatatttttcaataatgtgtcctctgccctcaggaggctatatttctgatatttatacatttttcctccaacattgttagtgttgaatttaagtatgttgttggttgtccaatactgaatagtttttatttcctttttggattcactaggttttgtggtgattcttttgccccttgttctttgtccctgccctttctgagagtactgttctggtaacctctcagcccttctacacgtgcaagggaaccttttagtactgttggagtcttggagacaacaatgccttacttctcatagccgattcgcacggccaggttgtgtgccacaaccatgctagttttagagtcagttagggaggttgttttggtgcatgtataaattctctaccttcgagtgatacacatgtgttgaatctgtacttagctatatattgccaaaattgttacattatatgccatcttataattatattgtctcttatgcatctaaaattgcttttattgttttcagggaacagcacgattgatgtttaatgcatttggttcatctttatggctcatgcccttctcagaatattgcaaagctgataatatatactggaagcatttctttgagggaaagggaggttgccaccacagacagcaatgtgatgaaatggaatataagtctgaatactcaggatggcccacaaaccttgtcagcatcgaggttcctacagttcgaggttctttgttgaaatttcttcccagctttaatctatgattaagattttgcttccactgagcaggtctaccttttcttttctttcattttctgttttcctctggcagatacggaagcatacccatccattatggatacaactgagaacataacatccagcatggagtgtggaaagccaactcttttgtcattttctgctagggaggtttcagatggtactctgtttaaaaccataaaggattgggaccctcagagcatagggcttatccatcagcttgagaagtgagtttgcaattttgtatgcgccagtgctgctactttgtaaattgtaattctcagtttcacatacatatttatcttcaaagtaaaccaccaacttacatgtttttatatgcttatggaagtaaatatgtgtgattttgattaaattgtatctaatacccccacattttgatctttgttgatctcaggtactaccagggtgatccagttcttaatcccctcacaccctgggagagacccccaataaagaatgtgttctgcatatatgggcttgattcaaagactgaggtatgattgggatttttctttgattgttaaagtttctactttagcctgctttgaaccacattaccattcaccgatttatggccttttttgttaagcaggtaggctattattttgcaccgagtggaaaaccatatccagataactggataataactgatattatttatgaatttgaagggtctctactatcaaggcaggtatcatgcatcttgtgttggaaagtctcgtgtccaattctttcaaattatccattatctgtctttatgtatgtctgcttctagtgtagtttcctggaacagtatttttttttgctttaatatgaaaagatatttgtagttcgcagactcatttttcatggctaatttgattgaatgaagatcctagtaagttgcactggtttctaatggtaattaccacagataatagcttttcgtgcatttgttttctcgaaaaatactgacctttgaacctttggcttttgatgagttcaattctggtttggacaactgtttatctggccacatttttatgtcttttgttttagaataaaatagtaacacaatttattctttccagatcaggtaattctgttactggaaagcccaacaattccagcggagacggaacggtatgttctactgtagtatctttataggtcaattcaatgtcttgagttgaacaaacaagactttgtggcaggtatcctacaattctctctcatggtgcaagaactggcttgggccaaaagtgaacataactagggctccgcaggtattttaccatgtgcctagtgatatgatcctcagcagaggagtttgaggcctgtttattaatttgttttgttgtggctaatagaattattgactgtttccttgtagcatatcacaatgttaatgtgcctttcctgctttgtacatcctactgtttttgcaggcagaacatgatggatctgatttacaaacaaagatgaatgtcgaccaccatgtaggccagggcatactcccaaacatgacgaggactccacatgtgaagtacataacctactttgaagatgctgagagcattccgggatggagaacagccgtctgggagcttgataaaggtgggtgcaaatcttttagttgttttttctccatttttttcatatttatgtcgtaatgtttgtccttatgccagctttatgcatttctttgctacaagggaataagaaatccatgtagaagtttatgcttagaatatacatatatttacagtgattcaggcggagtacttgtgcgtgtgcccacatactccagatttaacatgcaaccccctctaaagtttaatcattcctttgctatacaacactcattttgaaaattattattttaacagcaaatcacaggaacattgttaggatgccagtactgatgcgtgagttgtggcttgaaatgtggcatgacatgcaccctgatgcgaaatcaaaatttgtgacgaaaggtgtgctcagtttcaactcctattaccagatatatgaatccccctgcatctgatttgactttcaaagccactaacagaggtgcatgaacagctttccgaggtccattgagaaatgacgattgtcactgggactatgcaaaagctcgatgtggctttccagaacactgtgaatacaggtctgcaactcatctttcattccctttttcttgctattatcctttttcattaacattgaattttatggtgaccatatgccaggtacacttttggtgatgtccatctaggaatgagttgcaagctgaaaaattcgtcgactaacctcctgcaacaatatctctgaagtatgtgcccttcaatttaatgacgtttggtgttttacggtattctaaggctctaacttgtactgctgtattgtggtgcagaattcttttggatcatttttatggttatgatattattcagttggactgaaccaaggacaaaaaaagggtccagtcagaaacaggtgagcatgtattgttgctcttatagtcatcatgattatcatcttggctagtagttgatatattctgttttctttttctctttttgaagataagctgatggatactgattgaagctatacattgtttttaatctgatttatttttgggctgaagatggagattacgatatttttaggactgtatagtttgtgtttctaacagatccatagtggatgtcagttgtagaagtatctttccaatattgtgaaggccccatgaccatgaaccgcaaagatgtatatatattacgagtaaatgttaatgtttggacaaataaagttctcttgattcacggtctggggaaagtctaccaatgctgattaaaagaaaacttcttacctgatttcgtttccccttaaagatgcatactgctctcctatactgatgcatggcgattcattggtgacatgcctgcctgagtgatcgataaacttcactacgtactcacggttgttatggattttaaatcagtgaacttcagtgcatggggtaaactatattttcttttcctcttcacgatttacaccgtttatttcgataaaaatcatttaacagttgcttttttggagcgcatgtgttccctcttccctgagaggctgagattgtttttaagtagccggagaagagtggagtatatctgtttggctaagttgtgtgaatgtaggaagcagggtttgttcataccaaaattaacattaacaaattttgataattctaaaatttggcaaaattcgataatgggcttgatcggttgtgctggctgctgcagctctttggtttggattggggctgactggctgcagctgctgcaaccagcacttccgatcagggccaatgctaaattttggtaagatagaagtatatggatgttgtttatagtttgttatcataccaaatatccatatatatatatatatatatatatatatatatatatatatatatatatatatatatatatatatatatatatatatatacataccgttgtgtgaagaagttttcagaaaatcaccgaattttgacatggtaagatattgtggagtatttgagatgtgtttagattgcttcacaatcctaaagtttggtgtggttgaaaatggtagtaaactgaaccgcctctaagtgagcaatcttagggcctcatcttttcatttattcttatgcttatcaaccaaaatttgatttttttaaccttaaatttgaaactgattttgaggtttgtttttatcgaaatttattttctagcctttatttttagatcactaagaacacgtatataaaagttttattcgcaaattacttttcgtttgcaaatatgtcgtttcgcttattccgcgaatatgatggctccctcactactcacataaattctgcttgcaaagcttatttctaatatacattttagaagaaaaacaaaacagaagtgggataaaacggcttaaaaaaattccgcatgtctgcagaagtccagagagagccagagacgagaggacgccatcatgcattcatgctgatgctagaacaaattcgaaagtcgtataaaaaaagcacgtttattcggaagtcgaagctgcctcaaacactcgaggacccagctgccagctgagccggacgcaaccgattcccaaccaaccacgcgtccggtacccgagccactccccttctagaagattcccgtcactccgcgacgcgcttggaattttcaacgaaagcggcctcgcacctgcctccatccgtcgccacgtcaccccctatcccccgatcggacggccacgaaaacccgcacgcctccgtttccgtctcccttctccccacccggaggagcacacggctccagaagcttcctccattaattctttttgattactcatataatcaccttgttatttctttatatttctccctcgtctcgcccgcctccgttccgcctttggtccagatccacgcgtgttgcggacttgcggttgcttttgttcgtcttctcccggagattcggcgtgttcgtgctgcgaaatccgaactacttctgctgctaagatttctgccgcgtgctaatggcggaggtaaggctcgtcggtcccctacctgaactcgtcctcttcattggctgctgctcctgtaacaatcgctaatggcggagagggatttgggtgttgatggtgtggcaggaagggtacaaggttgttcttaacgtgtacgacctcagcaacggcctcgcgcggcagctctccacctccttcctcggcaagccaatcgaggccatctggtgagtgaatcagatctggcggcttaatctggtggatttttggatttgggtttgggctaaattaaatcggatttgatttgttgggtaggcatacgggcgtggtggtgtacgggaacgagtacttcttcggcggcgggatccagtcgctggcggcggggaggacgccgtacgggcggccggtgcgggtggtggagatgggcgagacgcacatcccgcgggaggtgttcgaggactacctccgcgacatctcgccgcggtacacggcggagacgtaccggctgctcagccacaactgcaacaacttcagcaacgaggtggcgcaattcctcgtcggcgccggcatccccgactacatcctcaacctccccgccgaggtcatgtccagccccatgggccccctcatcatgcccatgattcagaacctcgagtccacgctccggaccaacgccgcgccgcaggccacgcagttcgtcccctcgtccgtgccgccgccgccgccgccgcagaacaagcccggcgagggctcgtcttcctcgaagcaagaagacaaggcggccaaagcgaagcagggctcggcggctgacccgctcggcggcgcgagggggaaggtgcaggaggaggtgatgcgggagttcgcggcgatcatggcgagcgggacgctgcgggcgagcgaggcggcggcgctggcgatgcggcgggtcatggagcggcacggcaacgccaccatgcagcagagctagacgagagagacacacacaccaccatacattcgacgcgatgatgcgtgtcgcaatcgcaattaccgagtttttacggagtagttaacttctttatgaatgagaaggtgatttctgtagcgtattgattgtttgttactgtgtgtgaacctggactgttctgcttaaattcgataatctttctcttgtctactatccgatggatggataacgataacccattctccattattgaatagacaaagcatgtttgtggtgtctggtgatcagactgttaactgtgatactactattgtcgatttcattcatcgagtcttttgtttgtcgatgtttagggccttgtagccaacataatcaatttttgcgatgtcaaatttttgataatctgataatattgctaagttttgatatgatttcttatgtatttatagtgtgtttgggaccttttttagcatcggctgcggctgaagcagctcaaagtggctgcaatttgcacaatttgcagcaattttgctcattttggtcacaatttgcagcaattttgctcattttggtcagaagtgtaaaaagaaatcatattcttacgatccatcatcctacaatccaagaaaataagtggttaacacatacaacgaaggacatagctatttatttgaattatttaaaaggacgcgactacaccgagagtgctagctagatagtgctaaaaagagacaccattctttccaaaaaaaaaaagctactacactcaatatctatatattttttccttcttagagaagtttctcttaaattacttatccgatttataatccgattacgccgttgtgttcattgcaattaaatctttacaacaagatctcacatgattatattttgatgaaaaatcacaaattacttttatgatatatgtataaattacttttagatttcactaagttacttcttaaactataaaagtaagttcagtaagtctaaaagtaatttatatatactgtagaagtaacttacaacaaaacgaaggtaactttggcatgtcatttgaagtaaatccgttgtagagataaaaacatgactctatctagaaattaaattaatcagcacaaattatggaattaactaaaaagtcatatttttatccctacaacgaatttacttctaatgtcgtgacaaagttacttccgttttgttttaagttacttttaaaatatatgtaaattacttttggacttttattgaatttacttttatatgtctaagaagtaatttagtcaaatctaaaagtaacttatgtatataataaaagtaatttacaaatataaatattttttcatcgtaacataatcatgtaagatcttgttgtgaagatttaattgtaacgaacacaatgttgtaatcggattatagatcgaataagtaatttgagaggaaactttatttgaataggaaaaagatacccacgtgaactttatttgaaaggaaaaagacacctatgtggatggatatcatgacgacgtgcacagttagatggctctgagatgcgtcgcgctatagagctaaaccgagagcgctctcgaaatagatttcgcgtatttaaaagcatgcatgccataataacctcatcactctctggtcataatttgaattattttaaagcatgcatgccataagaacctcatcactctctggtcataagggaggaacaaccaaagatgatatatatgcatatagttagcctcattggtggttatataacatgagcttcagggtaaggaaatcatctcaactccacaccaattacgctcaatagaaacagtgctaatgctaagagtaagaccattgcggtggctctgctcctcgccacccttgtggcggtggttgcggttgaaggagccactgtaggggaggatttctttcgacctttttgtgcaaaggattgtaagaagaaggaacaaaaggaccccattgacaacaagcattgtatagacatctgcatcatcttaaacaagcaacttcttgggcctctgagggagaaaaaaaatcccactatggaaaaattcagcgttgtgtgcaatgaagggcgtagcaaagaatttaaggaggatcctgccaccaacaacaagcattgtgtagacatttgcatcattttaaacaagcaacttcttgggcctctgagggagaaaaaaaatcccactatggaaaaattcagcgttgtgtgcaatgaagggcgtagcaaagaatttaaggaggatcctgccaccaacaagaagtgtgtagacagctgcatcggctaaggaaatcaatggattcttagcgaaaggtgacgcttccggtgttcctgcgcgtgcatgattttgtagagttgcacatctgttccgtcatccatggtcgagtgacaatccccattaatggttctcacccattgtcatgttgttccttttgcgtcttcagttgtttcactatttggtgtttataaattctatgtgattgatctgatatgttgttcttcccaatgttaccggatgcattagttatctttaattgattaaataaatctagttgttctttggcttttaacactcattaatctacggtttcatattccacattgtgtacatgtaatgttaatatatagatatagtaagaacacagaaaagagggtggcgatacgcagagagtagttgtattgatcgagggataatttataatgatcctaggtgtacatatttatatccattggtaaatactagtcccgatcggacacgatataagtttcgtaaagataacaaaaaagatacaagtcctgatcggacactaaacacacttttctaaaatcaaaaggaaactaactaactctgtctagttaatagatagattgccacgccgcatcttcttcgaactcgacatcttttggataagctttctttaattgattatttttctaactgaatccgttgagaatccagctgttggcgactagtaattctcatcagccaatttcaggactctaaaactgatactgactctaggctgacgacgacttcgaggcttatcaaattttagcgttaacaaataccccatcatattttaggttggtttattttaagacgaatgaagtattttgaaatttgtatgctaaattatagctgtctaaacttttaaattttatttagaatgaaaaaaaataatttattcaaatattatcaatgtaatggcataactaaatttatggatttgtagagatatgaatacccagctaaaaaaaatcttaaatccagagttgtgccaaaagagggatttattagcaacaacctgataatcaaaatttgaactttagtttcttcggtattgacttttaaactactttgcattacatatataaattttacccataaattatttattatttatatttcttttcactcgtcatctccacacgtttgcatcagttcacacagccacacgttgtgacgcagccaaggcaacctcagaggaacccaagtgtcagagacatcgtcactgtgtaaaatcaccacctcaccctctgacctctgtctttcacaaatcccctcacacacagcagcggatccgggatgcaatggcttagcgccacgtcagcgagtccctataccggattggtcacttcccctgtttggtgtttggcacggggtagcgcaaggaccatggtaatccggacctaatcaagtgctccaatccccgcgcctccgaccctacacctccggctccgaacctgatggatggatgttagagaaagtttaatagtacagcccactactagcttcaattcatttatagccaatctaatagctaatttatataatagttgcttactatgggcctgttcagctgcaatgtgcagcagctgcaacacagtggtgctgctgcagctgcttacacaaagcactgttccggccgactgcaccacagccatatgagtgcagtcgaacatgccctatactattaatatatggtcccacccgttatacacacattgcgtcttgaagtccgtgctgtagctggctacatgtctgtagcccgctgctcttctctctcaacttttatctcattaaaatatgtttacagctggctatagactgccattgcacctgctcttatagcaaggctaataatatagccgacttattggctataaggttttttttagtctgctcttagcccacacatataataattagctatttacaattaatatatggttggtttggtttgtggcctaaataagccttaccaaattttgtcaatgccaaaatttggcaaattttggcatgactaattttggtaaggcaaagttgtatttggattgaagccaaaacagcctaagttcactattgaaatggcttattttcttagacatgccaaaatttggcttcaaaccaaatagacactaaacactattgaaattgccaaatattggtaagcctaatttaggcctcaaactaaaccagcccatagggcccacttgtctctctcacataatttcttggtttttgtgtccaaaccggctgtaagtttacagcccacttctcctctctctctcctctcttctctcctccacctcagcatttagctgacttacagccttctattatacttgctctcagagcagctataatagcaagctataagccagctataaatacatttcaagaagataaaaaggagagagaatagcagcgggctacagatccgtagccagctatatacatcacgggctctaagatacatgtgtgtatgataagtgagaccaagtattaactgtgtactatatgttataagtattttctctgtcccacaatacttatctttctaggttgtttaacacaaattaaggtttgagaagtaaagactatattgccccttatttgaatagaagcacgagagtggtgaggatagaatgggtaaaaaattgaattggaggtgattgatgtgacaagtaatactaacaagtgacaagtattgtgggacaaaatttgaactccaaagcgacaactattttgaggcggatggagtaactattttataaattggctattaaatagactattaagttagtatatgagttttttttaaagagatttcttatacagctctttttgtatttccaaaagcgatcaaacttacaaatcaactcatacacaaatgacgtaccaaagtgctgacaaaaatatattcaatttttataataatagagatagagaagagatagagatagagatagagatacagaaatccatattatagtatgatatcacgaattagagtgaaagtcatggattgtttgaatgctagtatttgagagtagtagccgatagcacggagaatcccacattagaatgatctagtatacggcgatgcttattctaggttatacttattggttataccttttaaattagtttttaaactttggtagtctatgaacatatggttttttagtcacatatgttaaaggatagagtcatgcctttaagatacaaacacttcaaaagtaccttcgtcgcaaaaaaagttttttaatctagctttagctattagttattagtgttagattggctttatggctttaaaagaactatttaaaactaggaaactttgagtttgtagctaataaggctaaaataaacttccataaagtgatagattgaatatggcaatatttatagtagcaaaagaaaggcgtgatcatatgtttcatggaaagatatataatgttttccggaacctataaatactactcctgtatattatggacattttccttctaatcttagctggtaacgggggtctcatagatgattcgtaggcaacatttaacgagaataattaagggtgtgaaccgcagataaccaaacttgtttcaattaaaaaaaacaactaaaagttgttaaatacaacatccatcctaaaatatagcaacatatatagttcatagctaaaaactgcatatattttaaggcagaaaacgcaatactataatgtaagcataactttggccatattaagatatgactaacattgaagttcattaatccattgtcgagccattaaagtcatagttctctccgtccaaaaataataaatgcatccatgtaattcaaatttgaactacacgtctactacaattattttggaatggaggaagtactccctccatctacttttgatagtcatatttcatcttggcacacagatcaagaataagtaattctacttatcatctatttaaacatgctactaatatttcctcgtagacaagtgattcattagtatttacatttctcgatgcccatacagccaatcttgtgtggaagaatggagagtcacacattaaatttgagaaagtcattaagatgataggttgttggattgaaatatgcctattaaaaataaaattttcagatttaaaaatacgcctatcaaaactagatggagggagtagtatttagaagttgttcggattgataccatttcgaaccataccagtaaagttgccaaacatgtgtatctatttagtttttttaccaaactctagtaaatacaaaagaaatcctgtcaaaacttggtaatattgctaaattgctaaaatttttgtaaggtttattttagctacaatctaaacagacctttagatataaaccagtgcgagatataggggttattcatattataatggtaagttggcaatattaccaaaaatttgatatgatttcttatatatttatcaaagtttagaaaaaaactaaatgcatatatatttttgacaactttataaaaaaataatatgatttaaaatgatatcaatctgaacacccatgtaaacgggtgcgaatgataattggcacattattgtccatgaaccattgcgcaaaaatgcgtgcggccgtctgccatccgaaccttcccgaaccgggttcaccactgtaagaaccaagccgcactcaaaacccacgtacaccccatgccttgcctcatctggctccctctcttcctctccctccctccctcccttcgctcgctttctctctcctccccttccctttcctccccttccatctctctctctctttctctcatctcctcctcgcttcttctcaagcaaagctagcggcgagctcggagtagcggcgcgctctctcgtacgccaaccgcccggctcctcctcctcctccccttcgggaccccgtgcccgagctcgccgccgccgatcgggcattggatccttccaccaccggtgttcgttcgtagcggattttatttttgcggggtttctcggcatcccctgagtcgcgggatcgcgcccaatcggtaatgtgggctctgatcccttcgtttcacgcgaatttggggctcgattcgttgctgatttctgccgcgtttggttctggtcggtttaatctgtttttgcttgcagatggcgcagagcaactgggaagcagataagatgtaagctactacttggatgcgttttttgggtgactgtttttgttgtttggggttaattccttccttcccgtgctggttgtgcaggcttgatgtgtatatctatgactatctgctgaagaggaacttgcagtcgacggccaaggctttcatggcggagggaaaggtcgccgctgatccagtcggtaatcatctcatatccgctgcttctctagttgctgccccttttgtttttttgccgggtttttctctcgtttcaatctccaaagtaagtttgtggttacggtgatttgaggttttatgtggagtgtcagagttttgagattaaccagggcgaattctgggtttcgaactggaaggggagggccttctagtgctaaaatgatgaaggaaatttgaattttattttattcagggagtaattttcagccaaattagaacagagaactcggaaaattggaagaggtttgcagattttggggcaaaatttaggtatggaagctgaggataggcagagattcaagctaaaataggaggatattttgaaatttgttgatagtaacttggagaggctcgtttatttatttatttatttatcctgagatggcagacttgaggctacttgtgtacatggtataatttccactgtatgtattctgctagctatgtaaatcgacctattgttatcaagtggatgagaggatggcgtgattgtgttgatcgcttttttcatgctctcaagcatgctgggttttgaggaaggtggcaattatttgtttttgccgtgcattgtgtaactatttctatttttgcagtgatttcatttgttgagattatttagttgaattgaagcataatcaattcgatatcctgaatgcaatgttacattgactgataatggtagcatttgtagtggataagtacatgggtgctatatatggatttgcagtacatgcaaaggagaaggcgggaagctacattgcttatttggttgcggttgtgttcatatatctagcacaatgtatcttgacatttatagccactaatgaaccattaatgtggaattgaactaaacttagtatattcagtgcaaaaccgtgctgttgcaatttgtgtgttgtggggcctgtctagattcgtagtactaagatatgtctaatccggctttaggttgctatattttgggacgaagggagttcctttatagttctgcgtatcgcagtaggtactattagtgataccagcaaactggactggaacacattgtcaaacacaggaattgaactaaacttggtaaatggaatgcaaaactgtggcattgccctttttaactttgaaatgaatttcttccttgctaaaacctgtcatatgagaaacggctaattggtaaccttctgtctttgtgggcattatccgagtgataacgtgtcatgtctcatccttccataatgtttgactctaattggttttcccgtcctaaatggttcttcagctcttctatgtggatgacatattgcgaccgctaagatccctaacactttgagaaatgataccatcacttttaagtcccaaatcaacttcttgattactgaaacctggcaagttagaaaggggtaggtcgacggtgtataagcgaggcagccctgtgggcggaaattctaaacgctgaagatagaactgtagtttccttgtggaaaggaattttctcttcccctctacgaattctaaatcttatgtaattctctgtgtaaaccttctaaatgtttgcaatgacaaaattcaggtggggaagctctccccctggtgatttagtcaaaaaaaagaaagaaaggggtaggtgagtttttttgccttgctgggcagagtatatctccaaagattccaaatacccttccttacagaagatctttaacgttaatgcaaaaataactagacgtatatccactccaagaagttctgcatgtggtttcctggtagagacccttccttttacctgttcaagaatcatgattgtaaattcttctcatgcagcaattgatgctcctggagggtttctctttgagtggtggtctgttttttgggatatatttattgcaagaacaaatgagaagcattctgaggttgcagcggcatacctagaggtatcctgggaattttttaagtcgccatgcatctattactcttgatctgatccacgtgtatttctgtcggaaacataggcacagcaaatcaaagcgagagagcaccaacagcagatgcagatgcagcagttgcaactaatacaacacagacatgctcaactgcagcgaactaatgcaagtcatccttcacttaatggtccaataaacaccctaaattctgatggcattctggggcattcaacagctagtgttttggctgccaagatgtatgaagagcgcttgaagcaccctcaatccttggactctgagggatcacagcttcttgatgctagtaggatggctcttctcaagtcagctgcaacaaatcatgcagggtgattctcttttagtttttgataagcttttatataagagagagatgggagaaattgaattttgatatgttactggcatgatcactaatcatatatcttaatctcataggcaattagttcccggaactcccggaaatgtgtctacaacgctgcaacaaatccagtctaggaatcaacaaactatggtgagttgttgcttcttgtgctcatcttgtgtcattttgtttgctccattaaaatgtaaaagtaaaaagatagatgttctttccaacaggatataaaaagtgaaggtaatatgggtgttgcccaaagatctttgcccatggacccatcatccttatatggacagggtattattcagccaaaacctggattgggcggtgcaggttagtcctttcctatgtatattgtgaggtcacttttgttgctaaagtgaaactgcaataatgtggagttacttgccttctctaacaacaatcgatttactagtctgtcattcttgtaataacagtaacatctaaggttgcgaatagtaaatataaattgccaaaacaaatggatattaaacaagtactgaattaattattatgctgtttctggttggcttttgtggtgaatattgcatggatatatttctagtctaaaaagcaaatgttgttgttctcaatgtagaaaaccatcctgttctcgttttgtttgttctgattttttggatgtcctttttgtttgtcaattgttgaaatttcttcttctgctgttaacaggactaaaccaaggagtaagcggtctaccattgaaagggtggccattaactgtaagttcatttatctattgtcccctttcttcatgtttttattactatctaatcaccaattaatgccagtgctgccatcctacagggaattgaccaattgcgaccaaatttaggtgctcaaatgcagaagccatttctttcaacacagtcacagtttcaacttatgtcaccacagcagcagcaacaattcttagcacaggcccaagcacaaggcaatcttagcaactcaagtaactatggggatttggatccccggagatatacagcactaaccaggggtggcttgaatggtaaggatggacagcctgctggaactgatgggtgtattagttccccaatgcaatccagttcacccaaagttaggtcagaccaagagtatctcataaaggttggtttatttttggaagcgcacttctgtttgtgttttcattgtctctagtgttcaaccatctgactgtacctgcaagttattcaggtacaacagacatcttcccagcaaccgcaggaacagcagcagcagcagagccagcaacaacagcagcagcaaagccagcaacagcaaatgcaacaggtactgacaattcgcccaggcttaacctctggatttgttttcttttcttgaaagttagcagatgtgtgcatatattgctgcaaacttcaaactttaaatctgctcaacaaaacatcactttgtgcctctacaattgcacttttgcaagcaaattaagcatagtagtttattatgagtgagttagatgtactgattgttcatagctgaataaaaaaaatgatgtttgaggctccgttgggcactgcattggcttttctcaattggatcgaaggagttagttagaggtgtttaaattagagacgtgaaagaaaatgttactgggatcagcaaagattctcctaaccgactagatccctaagcacaggaatagcaaccacaaactaactataaagcccaaagactattttctgttggcgatgtcctgcagctttctgattcttttctatagatcttgtgaattatagtttagttagatgtattgtgtgtaataggaatcatattgttaatcttggggtgataagactagattttgtgttgatcattcgctgcagcctttgtattgttttctatgatttttttggtcaatgggtttctttaaaaacaattccaagggtaagatcgcgtaaaggcaatattgaggacagcagaatgactgggatataaaattggtatgccagattattgtagttacacacatccaatattaattacagtttcatggctttttttttttgtgaacatgcaatagctttgcatgtcaatatattagacgaagattaatacaactgtggtgcgcctcaatggctactggggtggcagggagaggagctagggaaatacactaacaacaaaggagaactaaactaagagctgaactccaaagcagaaggtaggcaaggaaaacaaaacgggctaagctatgtgctgaacaaagctcccacagggttagcggtcgctgccacccactgtcatcctatttgctatggatgacgtcttttttttttctttttacctgtctactaaaagtcgacagattttgctcctgttttctctttggcatatacaagagaccaatttgtcatacaacctacatatctatttatctactatattattaaaacaaccttgaaataaggcaccaagtccgttgtaggggctagaaattcccacattaatcggagaaaaagaaaagaagagtccaaatagaaatacaatttaaaaatagctgaaattcggaattaaaaataagtaatattgaaagaagaatccatataataacccaataagagattaatcaaaattcggaataaaaataaaataaaatgcgaaattagaaaagaaagaagagtccaagtaggaatacaatttaaaaataacagaaattcggaattaaaaataaggaatattgaaagaagagtccatataagaacccaatacgagattaattaaaattctgaataaaaataaaattaatcctaaattagaaaaaaaaaagaagagttcatgtagggatacaatttgaaaataactaaaattcgaaattaaaaataaacaatattgaaataagagtccatataagaaaccaatactatattaattaaaattgaaaataaaaaatcaaataaaatccaaaattggaaaaaaaaagagagttcaagtaggaatacaattttgaaacaattgaatttggaaataaaaaaataataaatattaaaagaatagtctatatagaacacaatacgagattaattaaaattcgaaataaaaaataaaataaattcagaaaatagaaatagaaaaataatagctcaactagaatacaatttataaataat

SEQ ID NO: 39420 - DNA, 3805 bp, Oryza sativa
agtggtagatcgagtaagcaaataaaaaggtgtcaaaggagtaagaggtagcgactgatgtgacttttaagaactatgaaattattagaatcacgggaatgatagttttaaataaaatcatgtgtaaaaatagattattttaaattgatgctagttgcgcaattgcgcgggttgcccaactagttttttgaaagtagaacaccatcacataaatttggatgctttaatacacgtttctatatttttaggagctacatgtgaatttttcaggggatacatatgaaacggtcacagggaaaactaatttaagttttgaaccatggctaactggctgcgtgtatgttttccaaattttcattttgcttattttcacatacttatcccttaccatatatccatttttttgttctacaattattattatttatctccagagcaatagaaaaagaaagcaacctacatcttcaggagcagcaaatagtactggaacagggaatacagttggcccttcaaccaattctccaccatctactccatccacgcataccccaggagatggacttgggatgcctggcaatatgcgccacgtcccgaaaaatttagtgatgtatggtgctgacggaacaggactagcatcctcttcaaaccaaatggttacaggcttacaacttttctcatttcattcaagatgtttagttggatgtatgtaacgattatttgtgtcagatgataagcatcgtattttctgtacttaacaggatgatctcgagccatttggtgatgttggctctttggaagataatgttgaatcattcttagccaatgatgatggagatgcaagggatatttttgctgcacttaaaagaagtcctgcagagcctaacccagcggcttcaaaaggtaataccctgatgttttccgtattctgtaaacatgaaataacacaccttttggtttttaggttttaccttcaatgaggttaattgtttgcgcacgaacaatagcaaagttgtctgttgccatttttcttcagatggcaagatattggctagcgctggacatgaaaagaaggtatcagtaaatggacttcattttacactgctggtttttgtgggtttagtatggtaacttgtttgttgtctcttaggctgtactttggaacatggacaccttccagagccagtatacatcagaagaacacagcctcataattactgatgtccgtttccggcctaattcttcccagctggcaacatcatcctttgatagaactattaagctgtggaatgctgcagatgtaagttatgtttttgtatatgtatatgaaagtggcataggagattattcttcctggagcaatggtacccacaattagtgacatgcactttcttttaatgcactggtcattgcaataaaattttcacaaatataccatatcactaatatctgacagcacaaagtatatatttgtggtcacgattattagttggcattgagagttgagtatgtccaacctattaatctgaagttccgtatatgtacttgcatttaattttattatgaaaattgttgttttgcagcctggattctgtttgcatacgtttgttgggcataatgtccaagtcacatctttagattttcatccaaagaagacggaccttttgtgctcttgtgatggcaatggtgaaatccggtactggaatctgacccagcttagctgcatgcgtgccatgaaggtttgccatcttctttttgtttgcttaagacgttttcggcaccttttgtcttatgaagaattcatggtttgtatggtctaggttcatccatctgattctgtttttgttggacagggaggtactgcccaagttcgattccaacctaacactggacagtttctcgcagctgctgcggagactatggttgccatttttgatgttgaaacgcacagcaaaaaatacacactacaggttctgttcttgaaaatcaataacacatctatgattcagcactgtttgttgtgtaacccgcagtggatgttttcagttatttttgtcttttcctgtagctgaactagctttttcttaatggaaaggggaggagctattgctcttctgttttttttttaaaaaaataaaaaatctatgattcaaaacatgcacatctttatttccatgttttgtagtatacctcttgtttcagaaggggtgggaacctgttgtttatccttttttgcctgtgatcttgtatctgaagtctttattatcacagggccataacacagatgtgcaatcagtgtgttgggacagcagtggggagtaccttgcctctgtcagtcaggacttggttaaggtctggtcaatatcatcaggagagtgcattcatgaggttagctccaatggaaacaagttccactcttgtgtgttccacccaagctatgccaatctccttgttattggaggctaccaggtaactactgattttctttcagtttagccatatgtatgtaaaatttaccctttttttccctgaaagatagggagagacatgtttctaacaatcaattttagacatgattccttttttttttcatcttgcaacatcccatggtcatttttaacaacgctgctggtttaccaacgccacaaaaaactatcctagtgccagacctgccagtgacgcaatttcttgccatatcccacgttatgcagtggcatttcattttttggcattgagttctccgccacaagaactgtggcatggctctcatcagaatgctgtaatatccaagccaaggcatagtctgatatttggtttggaatctgagaatcgttacttctgatgaacactctgtaccttgtttgctgtaaatttctcatggacactgtaacaatgcagtccctggagctatggaacatggtaaagaaccagagcatgacgatacaagcccatgaaggtctaattgcggccttggcgcaatcgccagtgaacgggacggtggcttctgcgagccacgacaactctgtcaagttgtggaagtaacaacaataacgtacctagagataagaatagctgttccaggtaattgatactggatttcttcagcctaggctagtcatagaatggaggtgagtttgatgtactggttgagttgtgttactatctcagaggcaaataaggaagagtaggagccgggcgattgtcgcggttgagctgttcagtgcgtattgcagtgagtttgtgggaggggctgtttctttttttttttttttttttaccttgatgatagatgttgatgtagcacaaaaggaagataaggaacgaaggcctaaagttggctctctgtttcatgttgttaatgttctagtatgagatgtaaaatgtaacaatattcggtgttttaatgggaactcgctgcaatttgtccggcggttgatagatgatatataagcccccgagtcttgagattatgttgtacagtgatgttaacaacaagggactatcgcaggcagttgtaagtttctgcaggcagctatgtacgctgatgtttaacagtctgtacgtttgttctgtaaagtccagcagatagtgtgacggatgatcgttatcagaacgcttccatgtgcattcaatccgactctatttttagcagacgtgtgaaagacagcctgtgtgatggacagcaagggaaacaattgaagaagcaaatcttggcatttaagcagatgtcaggagcgttgatgccgctagcatgcggctaaatataatatcagtatgtatacaaggcagactaagaaggcaggagcaa

SEQ ID NO: 39421 - DNA, 1268 bp, Oryza sativa
atacgtacacatgcatcatcgtgtactgtactaaattcacaatacacaaggaataagtaggcaatctaatactctctctgtttcaaaatgtttgacaccattgactttttaagtacgtgtttgaccattcgtcttattcaaaaaatttaagtaattatttattcttttcatatcatttgattcattgttaaatatactttcatatacacatatagttttacatattttataaatttttttaataagacgaacggttaaacacgtgctgaaaagtcaacggtgtcaaacattttgaaacggagggagtatatactatctctgtcacaccaaccgtataaggcataacaagacttgacatgatatccaaactaatctttaaattttaatttcttcgtatacgacaatatacgaaatcataacaataagaaagtatattcaaatgctaaaaaatactccctctgtttcacaatataagtcattctagcatttctcacattcatattgatgttaatgaatctagacatatatatctatctagattcattaatatcaatatgaatatggaaaatactaaaatgacttacattgtgaaacggaggaagtaatatttttgtcaaataaaatttaatttatattagattagtggtcagctaaatattttaagaaccgaatcttaaaatatgtacatatctctgcttaaaaaaatatgtacatatcgtgcattatggggcggagagggtaccgctcattttaatttttttttctcgtggcatagcctgtgccggcgtcacgatcatggccaggccagccagtagtttgattttaaccgaataatgtcgaggacaacccgtgcgattcaattcaaccataattatcgcgcttgcatttgcattggcagagatttggctgattttattattgccgcatgtatcgtgaaaacggtcggaatcggtagcattccttcgaaaacgatgctcgatcgaccggtaattaaccatatttatcatttaaactattcaatatcaacattaatatggtacagaaagaaattagaaaaaataaaatttaaaaaatagtcaaaaaaacgttatgatcggaactcggaaacgatactccttgaaggaaacggcgcccggtcgatcggaatctccctgaccgttttcaccccccaccccccctccccccaaatcgatctgctactgaatgtacgtgtacgccgaaatttccattccttttttgcctttttattagctagctgtccacgttca

SEQ ID NO: 39422 - DNA, 1668 bp, Oryza sativa
tatatatatatatatatatatatatatatatatatatatatatatatatatatatatatatatatatatatatatatatatatatatatatgacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacactccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatataaaagctttattgtacacccctcccttagaataattattctacaccccctccactcaactcccccaatccggcccagcccaccccacgcgcgtgcctccctcttcagcccccacgcgcgtctctccctctttttttccttctcttcctccgcgcgccgatctctctcgatctctccctcccttctttttttttctcttctccctccctgccgatctctcttgatctctccctcccctcctcccgatctctccctcccttctccttttttctctttaaattggtaaattcaagactagaacacatgatctcatggtataacaaactctcctaaccaattcaccctataacactatgtgatttgggatcattgtttgctttctctatatatctgttcagattttatgaacataaacctgttatgtttactgtaggaatcataccttgttactgtgattcggtagtaatattatcgcagaagtgcagtaacacgatacattactgtgaaatttataggtcgttactgtgaaatttataggtcgttactgcattttttcaataacattatgatgaaattgcagtaacagagagcatatgatagtaacggtactactacagtaccacaacttgtgcatagcaaaagttttaaatctcaatcttgtgcaaaatacaagtgctaaaaaagtgcatgtgcatggtcacaagttaacacaagtgctaaagtaattctctttacccatacaaagatacatacatagtagcaagcttagtacaagtaaacttttataattataatctttaaacaataatatctcttacatcgcatattattttttagaatcgttttcaccataatgctttaaaacgatgttacagcgagacaatagtcatgttactacacaatgatcgagacaaaaatgcttttataacattgttactgtagaaagtagtcgtgctactgcacaatgatcgtcgcgttactatatcgttccagcgagacgagaactttaaaaaagtaaatctcaatatttagagagtaatatctctcacgttatatagtatttttctaatccgtttacaccatgatgttcgtaaaaaagtgtttaacaaaactagatccatcatgactatttttcga

SEQ ID NO: 39423 - DNA, 6098 bp, Oryza sativa
atatatatatatatatatatatatgaaaatcgctagtctataatagtagctgatattgatcgacgcaatatcatgactagctacgaaaaattacgttctctttgttctaaaccattggaagaacgtcattaatttacgaccgaagagcagggatagatatccatggatgaacagaggaactcttttgatcctttgaatggatttcacctcgtttgatcaaacaccatctaactagttactccatattaaaaatatatattttaatgaacagtctaccaattacttcagcttgcgcattcaaaacacacacacacaaaaaaaaatttgaaacaccattacttagcttagctgtgtatgcatgtaccatgtaccatagttgtccttgttacctggcaaaagtccttgcagagtgccattgttattgcacaccaactcaaagcagcaagagagccatgcatattaatggaccatcatatataaaatcccagaaagaaaatcaatagatacaagctgctggggtaagctgtagtacacatgcatgcagatacagtaccacttcaatgtccttttaaaaagatatgttttttttaaaaagagagacaattttctcaaatttcttgtatacatttaaaatcttcctgtaaaagtggaaggccacatgcatgcatgcacatccaaataccagatcctcttcctttttcttttggaggttacacaaagtacacacttgctgttacttgtcatatatatgtacaccctgagcagtattccttctttctgctgcagtgtgccatatacatatatgcatgcatgtggcctaaacatgtacaggtaagttaatacatatccacaggcaaaaatatataccaaagggataagagatacacaaaaaaacgaaattgtaataacacataaaaccacaaaaaaataccgtataaacaccgtacatacagtcccttacacacagcctgtgtgacgattgttttcaagttttaacagttgagtcaattctgactgtagtttcttaattttgacggcttaattaactaagaaaccacagtcagaactgctatatgtattatacggattcatggtagtaataataaattgagtataaattaatcagtactaccagtaatagtaataattaattaaaagaagggaaatgcgcctccctgaccctggctgggaaggtcgttgacccagccgaacttctccatgtaagggttgaccaagttcgccggcgggtagtcgtggatgcaatcttcccaggcgccggcgtcggcgaggtccttggtcaccacccagtagctgctgttgcacttgaaccccgacccgaaggtcaccatgagcacccggtcgccggcgttgagccgccgcttcgcctccatgtaggacagcacgtaccagaggctgctcgccgacgtgttcccccaccggtgcaacgccatcctcgccggctccacgtcgtagctgtccagcccgaggctcttcctcaccgcctcgatcaccgccgtcccgccggggtggagacagaagtggtcgacgccggtcttgaagttgatcttggcggcggcgccggcggcggccttgcggcggagaagcttgcggaggaggaggcgggcggcgaagcgggcgagctcgccggcggggaggatgcgcggcgccaggcgctggaggttctcggtgaaggcgcgcacggcggccttcgggagcgccttgctgaggctgaccccgaggcggccgtcggcgtcctcgcggtgcacggcggcggcgtgggcgtcgtcgtgggcgccgatgtgcgcgcgcacgaggcagcggagctccatcttggcgcgcgaccggaacgccgggtcgttggtgagcagcgcggcggcgccgccgcaccggaagaggcagttgcccagcatcatggacttgtcggtccccgtgtaccagttgggggcgcacgactcggaggtgaggacgagtgccatggtgcgcgggcgcgtgagcatgacgttgcgggcgaggtcgacggagacgagcccggcgctgcaccccatcccggagaggttgtacgccatgacgtcgtcccgcaacccgaaccgcctgacgaccctgtcggcgagcgacggcgagggcgagaaggagccgacgttgatgacgagcaggtcgacgtcgcgcggcgagacggcggccctggcgaggacggcggcgacggcgtcgtcgaagaagtcgtccatctcgtcgagggcgtcgcgcagggtggggcagtcctcgcgggcgtcgaggacgttgcggggggagtaggtgtgctcgccgatgccggagttgacgatgaccttgaggaggaagcggtactcggggaggccgaggcgcttgttgcgctcgatgatggcgccggcgagctccgtcgtgaccttgcggtcgtcggagggcttgtggcacgcgtagtcgaggaggtagcaggtcgcccgccgccgccgcgccgccgcctgccacgccacccacgccgccgcgtgcgccagcagcagcagcgtcaccagcggcagcaaatccattacgtactactgataccgtgatactccacgtacgtgcaattgtggaagaaaatgcgttggatcgtggtggtgtgtggcggggggtggaggaggtatatatagagtggtcagtggtggggttggggttggcacgcgagaggcgcgacacaacggctacgtattcttctggggggcggacggggagttttggagaaaaaagcgcgtgacgatgcatggatggatgggcgcggatctgtacgggcggtgacccctggatttctcatgtgttttgctctctggtcgatctggtcgtatggcggccaacgcccaaccagattggtcgctcgctgcagcctgcaggcaggcgcaggcagccaatagttacgatagaaggctataagacgaactgcaaacatattttaaaaatataaataaagagagagaagagagcgagctatagatttatagccagctgtagcacggattaccagacacaatgtgtgtatgacaggtgggaccaggtattaatagtgtagtatataactattgtatgaatgagctattagattgactatagatgaattagagctaatagttagctatactagagtattaaacttgctctcacggagtattagccattgttcgagaatcgagaggacattattggagaaaattgataaagatgcaaaactagctgaaccattaacttaggattaatctagtattagttattttaaacttggaaaataaattaatatattttttaaaacatatttttttaaaataaaatcatactccactatttaactgttcgagaaactttcacgttaaaaacgaaagggactgactatacatttgtcgacaaattttctcttaaaactttatcaaatataaatataatataattatattataattacactgtaaatttatttttttttcactcaatctacttctgcccatcacagcctaattatttaagttttttgcctttttgtcgtagttaagctgcatgccccgtgcgagccgtgcacagatcgaaatgaaccgaagtacacacctctgctccatctccgtccgtccgtaatccaaacggcaccaatccggccgcagatttctacaccttgatgattgatacgacgctaatgatttctatattcccagttttcaccttcaacttttaccggacacacacgtgacgtacctgacgtacctgatcgatgtacttgtgcttaatttttctgcttttcaccgtgcactcacctgctgactgatgcacacagctcacacgagattagagagacgactttcccgctaactctacgttcactcatatttaaattttttccaaagttaaattttagaaaattaaacactaaattagttttattgtatctaacattaaatatattttgataattcatttgttttatattgaaactattattattatattttataaatttgataaaagattgactaagaaaaaaaaattcaaaacgactctatggaacggtgggagtatgacactgttgctctcaattatatatatgctctctttgtccctaaattaacatacagtacgttaattaacaccgctcatgctagctagctagctagttgcgcttcttcaatggatcaacgggacaacaattctacgtgcgcatgcatatatattggcagaacttaattgatctctggctggttatcacgctactatatgtttgggtatcggtagtttttttggtaccggtttaaaaaccgttacttctttttcacagccctgatgaggacattaatttctttcttggcactaatgagggagctcactagtgtctgaaataaaattgcaagagtaagaaaaaaaaaacaacgtctcaatcaatcggttttgaattcattaagtcaatgcttagagcggccccaagagaagactcacatacatatgccaggaatagatcaagaattcttcaacagaacaataatttcaatatcaaacagattaatactccctccattttttaatagatgacgccgttgacttttaaacatatgtttaaccattcgtcttattcaaaaattttatacaaatgtataagatataaatcatgcttaaaatactttgagtgataaaacaactcacaccatgataaattttaattacgtaaattttttgaataagacgaataatcaaacacaagataaaaagtcaacggcgtcatctatttaaaaaaaacggaggtaggaacaattcatccaacacgttatattgcagttgacgtttccgtacgttcctcttgctgtgagctgatctccgcacaagtacacaacgataccggcttcaccacatgcaggctcgccgggttttactgttgccactccactccacagcagtttaccatcgtgccctccttttccccttctcctttcaaacgcagggtcgtcgtggctccaaagctccttccattggatccgagcagatggagctcaggagccaccggatctactggcccctatatatgttagagatgaaatggagaggcgtgcgagtgcgaatgagaggtaggtacgaatgttataaaagttagtcgatatagtggaaagacgactaaccctcccgatcgcttcagtcattgatgacccaagacatgccagatgacgacacaggaacacatgatatttgttaacgaggttcagccgaatcctacatccccggggctctgattatgggcgctcctccccaaccaatatagctcctagccgctacgagtccatggctacgccgccatcctctccctgcgtgtctatgctacattgtagtcgccattcttacattgtggtgcccccctctctatttaagagagatgacgggttacagagtccgactctaactccaccccctaacacctattacaactccaagtccaactgtaactaaataggactagtatattcgacacctattctaacaacgaagacaaaagggagaggctggtgtccatcggtgaaagaataaggttgtttagagaggagatggaaatagtgatcgaggagacaactgaaccagcttaaagatctttcatcgatcgagagagcaagggggctggtctttttggctaaccggtagatgtggtgttccgtggaccgtgcatgatgtatttttgtcaagaccgtatgtaagctggatatatctgtgtttatgtatatatgtacatatatttagcaggcacgcacgtagtaaaaatgaactaattaagacctgcatatatatacgtatgcacgtacacaacgcggtcagatattgatggcacttgacagtaagtaggtggagataacattgaattaattggaaagtaataaggcatgtgcacgactattaacaacgtgggcttacggcgagctccctgtacatatatacacgcacaatgcatgttacctgctgcgatctcccacgtctggctagtactgtattactgtattcctttcaaaatttatcacttgggtacgtgtaggaacagatgagctagctagctactccctccatcccataatattgcaacctagaatgggatg

SEQ ID NO: 39424 - DNA, 873 bp, Oryza sativa
ttaggcgatatatatatatatatatatatatcgatattgacgatgtcaccacgaactctcgttatcgatgggtgtgttccctatcgctgaaagaataattagtcgtaaatattgtaaatgtaagcatccatgctaaatttataacttgaacatttgtggacaaatccatcacaacaaaactagcatgttgaatcaccctcacttcacggctcacaaaatttattttttttgaacgactcgcacgagacgatgcgaagttctattgatagagcaggaaaaaattacaagattacaaccctggagggtcgtaaccaggaaaaggaaaaaaaaccacctcccacacaccgacagcgccaacacacaacccgggagaaggctagcaccggaccggccgccgctaagcgtgaccgaccgccgctagaccaacaaaggaacacagataagatcgccctctctgcgaatccttggctgacgcaccgatgctccaccacctctccagctctgtcgacatgcgggacccctacaccggcggcctccgccggccagtctttgtgcgccgaaaaccgcaccacacccaccggcaactcctcctcgcaccgaggtcgcctcctccaccgccggccgcgcctctcgcgccaaaccgattaagttcaatgaacagaggtggagaatgaaatacctcagtactcatcatcaccttacaaaactgacaacaacggaagctagctaattaattcccacttctaaaagaatgtaaaagctgaataaaaagtgtggaaacatccagatcgaaacagcgctgcagctaggtttctggtcatctcacttaacagctgggtttctggttgcaggacctccatctcatgcaaaatt

SEQ ID NO: 39425 - DNA, 8234 bp, Oryza sativa
cgagaacagtagtcgtccttaattaatttgtctgcagctgagctggttgaaatcgattgtctaaacaagataggataaacgactagttaacttctactagtagctactacttgtagtcttgtctgcattgtacgtgtttttagccaatcgatcacacatctagctagttagatagtcatgtacgttactgcttcaactgcttgtcatacaggagtattcatgaaattcatcagtgctgatgatcaatctgcagtgcattgttcagaatattggatttaggagaaaaaagacatactcctatatatgcatgcgtggttggaaattattaatagtggcgtcgaaatgaagggaacgaactagctagacaacctctacgacgactcatgatgacaacgtagatgtagtcatatctagatcatcattaatccatgcatggacattatttctctgaactaataaatcatgcatgattaagaagttaggatgaattaatccaggccggcaagaggctgcaggttggccgtgagttccctacttccctagcttagttccacatgtacctgaaagctttgcttctgcaggtaggcaagctatcagctgttgtgctttaagttgcctcacgaggaaaagcaagcctttttaggccaatataatttgctcatgcgcatttgctccgccaaccatactgttggtagcgagcaagaacaacatgcatgttcaattatatatattgatgttaaattgttcatcgatcgtttcatctctgtacgatccgtcggtgatcgacgcatggatggccgttgtgctttttgcagtttttgcatggtacttcactgctttgcatcacgcatggcatatgcatcacatcggcaactatctatagtacatatatattggacgatatatctcgtcaattaattattgctccctattccgtatttctagctataaatctgaacacatatttatatagattcatagctattaattattatattttgagacgaaggtaggactaatttgctggatcggtcgttaggcgttaggcctggcatacatgcatatacatcgatcattgatcaatgcctgcattgatgatcgatgagatcgatcgaagcatatggccatatgggagatgtgatggactgtacaacgaagaagctgcagtagcaaaattttcagtggatctcgtgggagatcgccgaacttttctggtcggtcgagctaatagatcgaaatatgtataggaaatgagtgcagatctctagctagtttgcaattttcagacgagttatgaaattagttttttcattcgtgtctgaaaactttttccgacatccgatcaaacgtctaatgtgacacctaaaaattttcttttcgcgaactaaatacgcccgatcagcatcctcaccaacctgctgcttgtttattaatggctactagtagtactgtaggactagacgtactgcaggctggcgtgcaagcttaattcactaattatctcttgatactcattccgtcctaaaatataagtattttttattactctgacatagtcttcgagatacactttgaccaacaatatctataaaatagataagatgttttaaataaaaagagttacatattatgatagattgtttaataataaatctagtaacatcaattttacatgattgatattttttttgttattaatagataaagtttaaaatatttgacttgtcactatgctaaaaattcctatattttaaggcagatggagtatataattttcgtcatgtatgtaggcatctgcttcatggaggaattttatttgaacacgcatagctaccgagtactacctctgtttcaggttacaagactttttagcattatctacattcatataaatattaatgaatctagacacacatatatgtctatattcattaatatatatatatgaatgtaggcaatactgaaaagtcttatataatataaaacggaggaagtagctagagtagtatattgaacacgcatattattgatcgatcgtctttttctataaaaaaagagagatgaaaatccggcctgtagatagcttaaggcggtttcccgctaaaaagttacttctacatccgatctaaaaatatgtacctaaattaattcatattcagatatatattttggggtgacaatagctagtacaaaagttcagcattcaagctgtacatcacacaacgtgatggtgaaagagctaaacccaatagtaagaccacattgtttagatgcaaaaataccatgcatgcatgcaggccttcttctgtggttaattatacattatatactggcatctctatgcactggtataatttagattcctcataatcaacatgtaaaacaatctctctttttcccctcatcaattaacctagaaacgtacgtagctttttcgcgttttatatgttgttttaacaatatatagtgtattacattattggcaaacgagagtacacaataacgactgagaaaaaaaccgtggaacaataattgacaggtcactgtcaactgtgttgaccagcaaaatgggtagtaagacctcctgattaagttttgctacagtcagtatatataaaaaaagcttagctattcatccttgcatacgtaactaattaattgccctgtactcgatccagggggcaacgactgtgatatgtacataatctccattgcatgctatattaattattagttttatctccatgaatgcagtgtttgtatattaattttttttggaggaaatatttacatgttaacaatgttgttcctatctatcagcagtgtggcatttacatattatactgtctaaagttcagtttttctttttgcgatggtccaaagtccaaatttgctagaactggaacactcaattattgcttgtcaaacaaagtggtcacagggactaaaattataccacatgctaaagtcaaggcaatttaatactttccttttcatgcatggcttaatttattagttatctaccaactaaaacaacgatctaaaccatgcataatatatcgtggctaaaacgttcatatatctccagctgactctgtttgactttacgttttcatagctgatgatgcgtcccccatatatatatatatatatatatatatatatatatatattaaggacacgtttccttctctagagtgaattagatcaaattaagattttcagtgagttgcttatatacgcgcacatacgaattcaaaaaaaaaaaatctactgttcctgttaggcatgttccaagcacgtttttgagaatttttagtaaactttgcttgtatgcgactgtcttgatgatttcttttactcctagggaccaaaaatgcatggttagttgcggctaccaagagttccagaaacagaattaaatgtgctacccaaccattgttaacttgaccttttttcgttgacctcatatattcatgcctaacgcgtacgactatcttagcttgctcagtgtactcaatttgacaatttgagtgtcttgacaactctttacttgtacgctaggtcagccagatcagcttgaggagcattcattcgttaatgcagtagggccgggacaatctaattcctactcttatctctctcgatcggatctcgtctactgctagcttaatcaagtatacagtacagttagagtcgggaagacgtcgtctcctaacttatataactagagcaaatacaatagtgaactaataatctgcttacatcacattttaacatacatagtagagagagagaaagagcggagagagaaaagcgaacgactatattatcgtcggctcatgcgctcgctctgacgcagccctgtgcaagggatgaggtagctgtgaacagccaataaaaaaacagaactttatgttgggtaaagcaacactatagacggttactgtatttagcgtggtttaattagctgttagatgacgtgttaattttttagccctcacggttgactgtactattaaacttgctctataggcagccacactagttctttttaataagagtaatttggaaccatgccattataattttttaaagtttgagatatgccatcgatatctcaatgacatgtaagacccacatgagtcaatgacatgtgggtcaggatggcatatctcaaattttgtaaaattataatggcatggttacaatttttccttttaatttaataatgggttaaaaaaacccagcctccacgagccaagccactacggctgtgtttagttcagcgcaaagtttggattttggttaaaattggagatgatgtgactgaaaagttacaggttgatgtgattgaaaaggactgaagtttgaatccaaactttggatctaaacacagcctactttaaaaaaaatctaattctaaagatatatctaaacatgtatcttgttcggatacgtttttagaattggatttttttttaatgaggagagtagttaccatgaactaattacaggcacagtacacattttcagtaaaaggaggtcagagtccggatacatctcccgtggaagtttcagcgaagttgagattccaagatgcatctcccatggcacattcaaggttcagaaagatccatacggctttgcattgctgccagattcagtggcaatgagcggcagttgcacgggtaaagcgaggagacgcacaggctggtgtagctgcttgaccggagctgcggcgtaaacgcgtatggaagttagtgagcagcgtgcagggcgtacagagtaggcacacgggagccgtggtgagagagagagctccttacgattacgagacaggcattcactcatgacagcctcgccacaaacgagaaccatatgaaagatatagcaaatcttgagtgggcaggtaggattcaaggcagcacagtagtattcgtaaatgcgcgaggcaccaggcagagattgaagacaccaattggcacgacaagatgatacccttcttgcaaaatctgctgtgcatttggtgtccggtcagggaccatatgctattgccgtctcagggaaaaggaccattgctacattgctgttgcacacctcatactcatactcatcatacctggtgccgatgcccaccggaacacacaatccggcggcggacaaagatctcatctcctgtcccaaacctgtatgttctcaacttggcaattacaatttacagtgagcaatggatgatattcagagagtttgtctgcaggcagaacgaatgatgtcccgcccgcttatttggatcagaaaaacgcagaagttttactctctgtacaggctgatatgcagaaaccttatttcaatcaagtatacattgtctcctttttaccgttccaggtagaatccctaacgtgaaattaccagatgcaaaccagagtacactttgccacaaaatataaatcaaaacgggtatatatgtttctttatccaaaattactcatcttgcctacaagtttgtctttggcttggatgatgggctcacgcgcctggtcaaggtccgcattgtcacaaactcttcagcagcagacgggtgaataccaacctgcaaagccaatggataatattagaaactcgagtgccaaatgatattaacaactggtttattgttgtgtccacgtacagtgctgtcaaaggtcgccttggtggctccacacttcagcgctacagccataccctgcaattggtggaaagtcaggtgcaaaatactagtgaagactggaaaatgccacgatttttttgtgtgtgaaataaacacacaaactttgcttacctggataatctctggtgcatctggtccacacattgatgcaccaagtactttatcagtctctgaatcaaccaccagtttcatgacggtcttctcctgccgtctaaaaaaagtgagccgagtcaggaaacttcaccagaacaggaactataaagaatgacgacactgataggctccattactagaatgtttatggtccatgagaccatgacaagtgaaaataatgaaatacccagaaccttcaagtgataaagcactcaggagtcaggtgtaactatgacgtaacagatgatcttgcaataaacatgatacttacttggatatgctgttcttcattgggttgaagctggaagtgtaaacaagaacatcgctcttggcttcctccaaagcctgctgttcactcaagcccactactgatagtggtgggatgctaattcaacaaaaaaagaaaccatgttatgagtgacacgatgattgtggaaaagcagataatctaaagaaagcagcagcagccataaatgcactgaataatagattggtagaagcactggcaaaagcaaaaatcactagtgaaggatccttagatcttgtctattgaaatgactaattttttttctatctagattctagtccatgttttgttaatgtagaatttaattgttgcttacttcctaatgtaccctaaactacataggcatcaattagaattaagaaacatccagcataacaaccgcacacaagtttcatgctgctcagtcaaacctggaagaatagaaaagttaccctatatcacgtcatgctactctctttcactgctaagatctaagcaaataaacattcgaagtgcagacaagaaaaccaaaccacagtgtgcctcaccgaaagtgtcaaaagcaaagagttgtgaagtatatatgtggccatcttgtagatgctacttgtttcagttaaaaacaaaaactggagataacagagaacaatcaaggtttattggcttacgagaaaacagcacaaggtacatctctgtaatcaggtttagttggctggccaccaaacacagttttctgcaattaaagattaaagtaaagttgctggttacacagaaacaaagaaatttgaacacacccaatttacaaggggattatgagtcactgtagtcacttacagaaaagcaggtagcctccatcagtgcaacaggtgttaaatttatccggttcgttacatcacccacagcccatatatttgggactgatgtacgagaataatcatcaacctaaaaatagaacattgaataaacaacacaaattacttgtagtctcaaagaatatcatacaaagataatggccaattaaatgcctaagatggtctcacataggttcacgcgtaagttttctccaaggaaatacgagaagtaaatttcagatgaacaaatatgtcttcagcaagctaacagcctaacaggtaagggttcaattaataaggcaagaaaatcaacctttatagctccaatattatcaacttcaacaccagcagcttccaagttcaacctctgggagtttggtgtgcgacctgcacgcaattaaataccaggcatagcaacaatattaaagtttccttcaaagaaaagaaaatcaggataaatgccacattccaaatatagtgtgaaaagtagaatgtctcatattgagcatctcaattcccaacaacaagagataaaaaaaaatgttgtgaggatgacattgatcaatttcaaacatgcatatggtgcttgaccatgtgaaatatcagaagatacatgattttttttcatccagcacagaacagtcatcaagagagatgtattcaaagaaattattaaagtgacagagaacataactttcagcattgaactatcctaaatacctgtagcaaacagaacaacatctgcaatgatctcctctcctttgtcagtgacaacttttatgccatcggctgttttactcaactggtttacataaaaaagaaacagatcaaaacctatcgtgaaaacagaacacatgggaatcaaaatgcactttaggatgtcagcttaactcacctcagatagatttgtccctggatgtaatctgattccccttccctcaaggttacttgcaacaaccgtcctcatctcatcatcgaaacctctgcaattagtcaattcgccattaatcatggtggatagaaccgtaatcaatagcttgaaattttggctaataaaaatgacattggcattctttctccatatcattattcagttgttcagatagcatggtccaggcttcgcaatcgcatcgttttatctgataactagtttcatcatccatgttttcattgtaggttgatgatattgcaaaaaaaatgttcagaaaataaattgcatcaatgtacaaaacga

SEQ ID NO: 39426 - DNA, 9664 bp, Oryza sativa
gttggcaaaaaattaagattgtcaaaataggacagtaactaaagtggcacatgactgagccctgaaaacaagaccaaaagcttcagttagactagaaaaccatgctatcaactctagccacattatgacataaaaactgcaactacagaagctacattgatgttcttttttctgatactgagcagtaaattgttttggtgtacaattttaaatatctggaggtcacagtgcagataacagattataataaataccttagaggaagctcttttcgataaaacaagtctacgtgcgcacccatccctttccatatagaagcaaattcaacagcaatatatctgcaatatagccaccacatgaacaaatgcaagtctgagatagttggaatgacataacaatatatagtacataaatgcaccctagagtgtagacatacccgccaccaaggattacagcacgttttggtagctcctccaaacttaaggcctcatctgaagtaatagctaactcctgcaagcgggttcttatcagtgtcagccaaaataatacaccaaaggacatttaaaaaaaaactaaagggaaaagaaaatcagtgatgtaaccagcacatatatatggctaagtataatttgttggattaaagataatgctttgtccctcttgaactggctcaaaggaagtcttgtaatgtcaaatccacaccaactgtgtcatggctggacgttatggtatagtatatcagcggcggcgtaatagagataagtcagatttggcaagtgcttcagcagttggaaagtcctaataagctccttatcagagtttcatagttttgttataagagtcctagtagtatcaggttaatagtttgtatccgtttcccttatctagaggcacctcagtatataaaggtagcctagtactccctccattccaaaatataaggcacaaccaccttcaatcacctcatagtttagattaatctaataaatgtaatacatgcacccaataaaattagagatcttgatagtggagaatttaaataataatattttagtggagaatatgtgttagttaatggcatgcatgcatgtatgccttatattatggaacagctttaaaaagtagttgtgccttatattatggaatagagggagtattgtattttgggtcaagtaataagaaatatctaaaggggattaaccctaaaagttcagccatatcaaactggctatcacaaataattattgatgtgcaacagtatcacaacaaatacagaagatggcatggaaatcagcatcacgaggtcaatccaaaggtttcaggcacaaaagttggggaatataaagaagttgtcaaacaagtaacaatgctattaactacttgccagacataagaaacaagtttgcaaaggctggcagagaattttgttaccttcccaggaatgttgacacgttgagctcggctaccagttgctatcaatatgtgctttgctgtatatctttgctttgaaccatctggctttgtgacttcaactgtatgagcatcaaccaaactgcctgccccttcaatcattgtcacaccagaattgccaagaatcctctggtatactccatttagtctaacaatttcttgagtctgcagagaacggtttttacaatattgggttgtaagcatttataacgagcaaataataatgcaggaacgttctcccaaccaaggttgcggctctgaccttattttccagcagccttttccagttgaagttaatgtccccattgatttcccacccaaaattctttgcatcctgcaatcatacaacagtagcaattccaataagcaccccagaatgacacttcagtacatgtactcacaaagatgcaagcaagctaaatgaaatagtttgtataaaaagatgataacaagctctcaaatggataggttattggatttcaagtcagtacgcagaatgatgaactgttgatcaaggatggaggctgtaaggcttagcaaattttgcaaaaattgagtaaaggaacataattcagcaagccacagcacattgaacctaaacacaatgcttccaacttgtttttcaaacaagtaatagttggctccataagttagtaagatcagttacctcaaattctccgcggaaagatgaaccatacaccagtatctttttaggcacacaaccacgtatcacacacctagcacaacatgtacaataatgagcatgcgggttttaggatgcagcaacatctcacattctcacccaggggatgaggagagttggtttaaatcataatcaagcattcaacgacagaaatgtaaacgcagacaagtaatcggcagatgcttacgtcccaccatgccctccttgccaatccgagctgatgggatggaacgggagctcgcaaatcgcaacctgaaccgcgccacacaccgaatcaaatcacacgaaaaaaaataaaaatccaacacgtttcctcgcaaaaatggggagcgggggagaggagaaaagtcaaaccttagccccgaaggacgcggaggtgcgagagccccggacgccgccgctcccggcgccgatcacgaacaggtcgtagtcgtagctcccgccgtcggtgacggccacctccacctcctcgtccttgagcatcttcctagccatggatcctcaacaccacacgaaaaaccctaacgcgcacacgcacaacagagagaaacagagcccctcctgagattgacaacaacttgcaatccaaatccgatgaactttagcgcgaggaatcacttgatgagacgcgattgccgccccgcgacgcgcgtggagcccaaaatccaccgctaaaaacaaccaaaaaaaaaggaaaggagaagagagagaagtgagcaccgtaccttggggttgggttgatttgccggcggcttaagcgagcgaattggttggatctgtttcttgtgtcggattttaaaggggggctttggtttgtggatacgtggtcgttggagttcctacgccgccatgtcctggcagcatctgaggcggcttttacacggccacgttggcacgcacgcaggtgcttagagcttatttgatacaactccagcttgagatttagttttttttagactaaagcttagtcaaacagtttcagtttcaaagtacagttgaatgagacgcttttataaaataaactggagaagtagaactggatttggactgcttcacaactttactccaaacctaacttctgaagctaaatttaggagttaaaactttacctaatagaccattaattagttagttaatttttaaaaaatgttaagttaaatcatctgactaagttctttttataaaaaaagaatcatctgaccataatatgcttacatcagccgtgacaattcggggatccactgtggatgcagtgctcctaaaattctgcaggcagctgctgacgagatggaacttaacagctactccaaattacggaatactgtaaagaacttattattaccaaaaaaaataaattaggtgctcagtttttatcttggcacttgtacatgttgattacaacagggagaatgcagggtttgttctaccagagattggctttgtttcatgttcagttaatcgggatagcttctactgcagcagattccatttcagaaaagcaaaaggagactttcagtgattcggtctgtggtgtaaaagccatgttcgtgccgtgtgtttgtttccagatgcgaacttgcattcgatgaatctggacgggacagaaatgccttcaaacgtggaacgtggacgcgcgtggcgagcaagatggagcttagcagaagtcgacatctttggataagtagctttcgattttcgaactgtcaagagccaaagaaggccacgtatactgtttagttcttgtgaactttctgtacatgtgaaatacaccgataaaacggaagtaagccagtaacctttctttacacatggaagacaacagataacattaaagaatttaactgaaccttttaaaacaatcaaagaaccaagctctgtctgtccctttccggtctttcagagaggtgacaacaattaaactctgtcgacgaagtcatgcagttgagcccccttcatccttttgtgttttttattatcaattttattttcttgttattgccaatcctaacacaaggggtggtggcgcagttggctagcgcgtaggtctcatagctatttgagttatcctgaggtcgagagttcgagcctctctcaccccaatttcttttttctcttggcctatatcattttttttaacagccgttatcatttattttatatttttctgttaccaaagtacggagttattctcttggcctatatcatttttttaacagccgttatcaattaaccaaatgcacaatgactctgattttttttaacagccgttatcatttattttatatttttctgttaccaaagtacggagtgagtggtaagccaaatggacaatatgctttctttccaagtggacaagaataggctgtacggatttactactaaaattttcgttcttgcgtcaaaaaaccttgagaatgcgtggactgggaaacaccatcgtctcgccagggtagaaagaataggatatgcaagtttacacagattttccgcgatgttacagaagcagtggctccaagcctccaagcaccgaactgacaaattagttaatgttcagataaatataaccaaaatactccgcagccgcaaggattttcaactgaacaagatttaaaatggcaaccgcttcttttaattatattttgcaaaccaaatgtaggctattatcaagcatcgcactatggtattttcttctcggcagaaagttcagtttgcccgcaagaaaaaagaaacacacctgtagttttgcacagcattggcaacaaaagccaaaaccacaaacaaaaaaaatggcgcattatgagtcttatttaattacacgcgccttgatcttagaagttcatcagccagatttcttaagtctgatctcaatgccctgcacaataagacctctcttccaattgcctcccttggtctccatcaggctgaagcacacctctccatcttcaccttcctcgttgatgaactcacccatctccagctccatccactcgtcagtccttttctgagggaccgttacaccttcatcaagaactagacgacggtctcttctcctggcccttcgtcgcagcaatggaccaatactcataggccagtaattctcaggcacctcctcatcttcgctgtcatagctttggacacaaacaatttttgttgatcccctacctcccaggctgactgatgcctcctggaatggagcatccagcccatagaactcatcagctatcttaaacaccatgtatgcggcataagttgagtttggggagagcatcttgctgtgtatcctgccacggatttccaaccagcacacatctatgagttcagcaccttctgcaaacctgtcgtgatttgtgaacaatgggttaaaacttgtaacaaagagaaatgaacaaacattaagttgcagaggagcattcagcaccagaaccaaaatcccataacttctgtacagaaccctgctatacacccgacttgtttgtttgactgatgtacaactgaacggcggaacagaccagtgcgtgacagcgtgaggcagcagtacgggttggtcctacggagatcgacgttttgcactcccgtacattacggttgtccaagaatcggataagctggttgtgtgtatagcattttccttttgtttattaaccaagccgttcatcagtactaccgcgtataccatttgcacgactataatgaaggcacacaacaggtcaattatgtaaagtgcctgccattctataatctattgttgcaaataccatgcactttactactttgctcttgaaaagtaaatgaagaaagacacttcaatccatgctcagagagaacactttactactttggccgctttcgttatcatcgaatttgcataagaatctgcccttgttctgggggtaataatattcggaactacacttcaccacaaatacatattctagttgattcatcatactattatgtagtatagtctattctcccatcagaccacataatgcaatctattctcccatcagaccggataataccattgcaagttgcaacgagattgcaagtccatcactcaacgcacaggcattgcctcattggatcaaaatttccacatgaattggaaagatcagcacggtttaagttcaggaaacggacctagagtcggtgagaggaatccagcgccagtagtgcggtgtatcgccccagataatcaccaacgatctggccgagagcatgtagcacttggccccagtctccctgtccaaccacatactctgcacccaaaaaaaaacacaaatattagatcgccgatgaatcgagagaactgagatcaaccatgcttcgattaatccgtcaaccgattttgttggattggggattttcataaaatagaacgcaccatgagccggtctgataggaggtaggggccatcggagaggcggaggaagagctccttcttggaagccggcgcgggggagagctcgccgtcggcgagatcggggagattgcgcggcaggaagctagcccagacggcgtcggagtcggcggcggcgcggaacgccggggagacggcggcggcgtggcaggcgtcccgcggcgaggcgcgtgagatcgcggcggagaggagctcctccggcaaccgcgcgatctcgcagaggccctccccctcctcctccattgatccctccgtcctcgaatccggcttgatggcgaaggaaaaaaaaaacagagaaggaaaatatcgtcggagagtgtgtgtgagtgcgcggtggttgaaaataaaactagaaaagcttaactacgaagcagaagcacatgcgggtggatagggtcatagggatagcgatgcgtttcaggagaatcagaccaaaaggaagattacttttgttttctgtactgtggggcttacatgtcatactaacgcggagtttagttccaaacttttccttcaaacttccaattttttcatcacatccaaactttcctacacacataaacttttaacttttttcgtcacaccatttcaatttgaaccaaacttccaattttagcgtgtactaaacacaccctaagagcaagtttaatagtatagccaactgatggttccaaatcatctttaggtaatctgatagtacattcataaaatagttatctataaaaatatactacatcattaatatccgatcccacctctcatacatatataataatgtcttaaagtccgtgtagcagctggctacaaatctgtagcccgctttcttatatttcttctcgatatatggttatagctggcttagagcaggtacaatagcaggctataaaccagctataaacatattttaaagagataaatgaagggagagaagagcagtgggctacagatagtacggactccaagacgtaatgtgtgtatgataggtggggccagatattaatagtatagtaaacaactattgtatgagttattactttggctatagatgatttagagctaatagtgtgatatactatgctcttatagctattgcacctgctctatgcatactcggatgctcccatccttgcggtgctctctcgatggtgtccaactgttccaccgcgggttgacccggcgcttgtggtgtgtccatcagtcaggtgtcgtctcccgtgtcgtcgtgtatcattagcgcgatcgtccaattcaactatgacaacgtcatatgttctattctattattacatgggaatcttgcgattatgttactattgaatatagattttgcacaaataccacgctgtatatattaattaatctatctaaacgtcatgggaatgcttgagagttagagcgccacgttagcaaacattttacaaaaacgtccccaagtttacagttaatcatgcattgctcccagctgccatccaccgcgaaccgtcttatcacactccacgtagaaatgctatcctaaacaaaatggtctttggatttgtcttcttctaatattctttcctctaacagacaccgcactcatgacttcggggaataaacgaaacgatatatttacaaacaaaaaataatctatgaataaaattttatacacgtgtttttagtgatttagtagcaaaggcttaaaaaataaacttcaataaaaaaaaccccaaaatcaactttaaatttaagataaaaaaaattcaaattttatctgctaaacataaacataccgggcacaggcacactagccccaacatgccgacctgaccgttctccttgaggccttgttcggttgcttgggaattaatccccaagggatcctatccagggagggattgagtgaatccctcctatctcactcaaaccctgtggggttcgaatccctgcccgtttctaatccctgtcatataaaccctgccttcgtttagcacagggaaatataaagcagcagctgtacgttcccaagcaagcaatgaaacaatatgcattctcccagatcaaatccataggacgcagtaaaaaaaacattgttttagcacagggaaaacacacatgcatgccgtacgttcacaaatgcatacatgaaagtgtcacaaagtaataaaaatggttacagttcagttgttttttttagaataaatagaagtagccagctaagagctaaactacaaattgaatgcaagtgtttaagcttagcactaatgccaccatgagcttcagtcacccagctgcagtgttcccatctctgaaaaaaaatggagcaacattggatcaattccaaaaagaaatacaccatatatgttctttcctgtcaaccaaatatcaaattgaacaaatgcagagtacagattacataagagcaaacaagtaaagcaaagagccacactaatatccaaactaaggctgatgcactacatggaatgctaacagtctgatagaaccaaagatgaaaagagacctaaaagttcaggaactaggaagctaacaaaaaaatctaacaattcagccttgacaacatagtaataatgaagtacataactagagccacacggtaccttaaaaaacattcttttatcaggagcaaagcagatgcttcaaagtaaataaaattgcactgctatactgcttaagtttagctttttcagatgctaaaagtagtatcagttcagacttgagtgagctcatcagctcaagaaaataaaaaaaaggtgagtagcccataatgtaaatcctggtttatagccctaaacaacatgcatgtaactaacaacagagagtcacacaggacagagtgaagcccatcttactcgcctagcagaccaaaaaagatttatatggaagagaagcggtacctttcaagccatctcacttcttaaccaactcaaggcagattctgatcctcatcacaagcactcacaaaaatctctctgttctctgcattcttgaagacggtatatgctttgaccttttctgcctttctcacatccatcgaattcagaacagatatgcacctcttgattgaaaaatcatta

SEQ ID NO: 39427 - DNA, 8524 bp, Oryza sativa
  unsure (1)..(8524): unsure at all n locations
ccattctgacccctatactcaggagtgttgtgctcatgcaataactcaacaagaatcttctctagggctgggttccaagaggctcttgttttttctacacaagataagaattgatgtataatctacatttaataatttcaaacatgaatttcacatgttctataattgcatacctattggagaacctccatgcttttttgtaggacgacctttcggagagttcttcttttgtgcagctttcgctaaaagcatggtcaaccttggagaacctcttccaagcatattaactgagaaaggatgcataacacaatattcataacaaaagcattgtagcaaatgtatgtcacatgcaaccaccatagttcatttataacataatatttgtaatatgtcgtagttattcagctcacaaaacataaaaaaaaaatcaaatatactacttattacaacccactaattcctatgctgtcgatagtcattccacatttgatgtgctatcgtgtccctcaaaagattcccttgattagtgctttgatcattgccttcatcaccatctggcaggtcaacataattgcttggatggatattatgtggttggttatttaaccattgctcatccccattcagtgatcgaataatattatggaacactgcagcagccactggtatcttcacttggttcttgattttgtggaaagttgcaactttgagaatagagaagcgcttttttacaacccccaaagtcctttcaacatgattcctcaataccgcatggcgatggttaaataactctttgtagttttgaggtttacgccgacctgccccatactcctttagatgatacctgatttagatatggtgcaaggaaagaattggtgttggcatatccaccatcaaccaaatagaactttccagggggtacttggaagcctttgtttactgcagaggtaagaaccctggcatctgtagccgacccctcccacccagtagacatgaaagtaatcttcagatcaaaatcacaagctatcatcacattttggctaagagtatttttcctatttctaaatggagctgctttgtcagatgatatagatatgggtatatgggtgccgtcaattgcaccaaggcaattctgcagcaaaaaaaaaccacatatgattttctaaaaatgtaaaacaacatattaataaggatataagtgtttaggtaagaaccttgaaatagggataaaatctaggatctttttctattttccaatgaacttcattaggatttggaggcttcagaaaccgcttcgagagcgaagggacaactgagttgaagaaatgctttacgtgacgatgaaagctatccccactgtgcccaaatttctcttgcaaatcctcaaatgaagcattgtgactaagcatgtataagaagaatgccaacttctcttcaactttaatcctagtatcatcgaccaacttttcagttctaaggtaattggccaaagatataaatatttccggctccatcctgaatgctacccggcaattttttacatgcccttcaagcaactcccgaacacgctcctcgcctgttatctttgatgtatggcgtcgcttcttttcccttgctccactagaactcaacaaatgtagtgcagggaaaataaacaacatcatatcatcgtcctcctcttccctcctctttctagcgcggtctcttgctctcatatccatagtagtactatagatagagcacaaattatttacaattttgcacttagcacagcaacaaaagatctagaaagataatcacaaaagaatcactaaactatgggaattaatcttaagaagtccaagttatgaagcatatttaaaaattgatgggaaaaatgaaaagaacaataaggatctttttttcttaaagagtgcacagtgcaacaataattgaaggaggaggttggtcttctccaactctaatgggtgcacgtgcaatctacaaaacaagcacaacttatacacatcactgacaactcaaattcagaactagaactagagttacataaaacccagaactagtgctagctagcatcaaagtaggagctgctgtttttcaatcaaatagaaggatctcatcatcaaatacattataacatgggtacagaattaatcacccaatcagctcatttaacactagacatattagtgcttgaatagctatgataaacatgttttatacaagtatcatgttgaggaaaacaaatatgttagtctaatgagactaaaagctactgttgttagtttaaaataaatcagtttaagtatacattactgtatatactgcagcaatttgttgctagtttgtttgtgaaacaatgacgatagaattagtttacaattcagaaatgttaaactaattacagagtacctccatagctctacaatcctcaaaatcaggacacccaacccttgtaatttccaaacagaaatataaccaacaaccacaagttgggactccggaagcaccaagaactgagtacttcactgtaaaaacttgtatagtcaattttacaagacatgctcaggcaagcatcacagcatcagtcacactaagcaaaactaatcaaggcaagcatgtttccatagccaccgtacagctctcgctctcaccatctgctgcctcaaagccaccgtgaatcaagaactcaaatcaagaaccagagttgggcggtgcggtggcggcggcaaatcaagaactcatccccacccaaccaagaaaaaaagctccacgcccaaatcaagaactcaccagatcgagcaggatacgaggaggaggacgacgaatcgctaagcgctcactcaccagaaagctacacggcgagaagagagatggcggcgacgacaggaaagggagaagagaagaaaaccctaaccctagctttgcaagaggagggaagaaggggaaaggcagcgtgctcactggagacaaggtggcggccggaggagagagccgtgtcgtcgccgtcgccgtcgccgtcgcctccgggtcgcaccgcgcgctgccccctccgtcacgtcttcgttgcgccgccgcctccactcgaggaaattttccacgctccaggagtagatgattttttcccgggcctagagaagagggaaaccccgtggtgggccgggctaaaattcacggcagggcttaaccgaacgcacaatttcgcatgggccgggattttttcctcgccggggtgatccatggggattgggccccgatcccggccgggaacaacccaaccgaacaaggcctgaagccgccaatcaaccacgcgatgttgtctacatggttgcccagggcagcaataccaccatgcttaaggatgcggttaaggaggtcacgggttattttgttggtttgacagtgtacattccggaggaaggaagaagaggagcccaaagggcaatgtccgaaatagtatttcaacataaaaacgctggttgagagtgatattttatcgaatcttttttacagtgtggtatttaaacaaagcctagctagcataacccaatattcctcattgtacagacatttcagtttatccacaagagcatcaatattagcaaaagcaaatgctataaaaatacgcatcatcacaaatcttaggccctatttgattcagcttaggattattataatctagattattagtagtaagctgaaacaaacagatagattagcatgatagattattataatctgtaagccagattatcataatctaataagctcctctaaaggagcttttttcagattattgggtggctaaagacccactacccctggatacttgataaaaattacccacccataccatcaaccgaacaaacagataggcctctcctctctcttggcgagcgcgcgaactcggctcctcctctcccagtcttgcgcgcatccggcctcctaatctcccggtcgcgccgcctttcccaatctgcggcgtcgcctcctcccctggtcatgcactcatgcgtgtgtgagcaacctcctccaccccctgccgcgccgccgcgttccccactgcggtgccccgtctcgcgagcaacctcctccaccctcgaccgcaccaccgcgttccccactaaggcacctcgtcttcttccccgaaccgcgccgccgccgtttaggcatccaaaaaggccaagggcattatagactttagcctttcaaacccaataatccgtgcctccaataatccagataaacaaataactcacagcttattttatgttaacttattataattcagcttatagtaatctggcttaataatctaaattataataatcctaaactgaaacaaacatgaccttatttaagtactccaagacgcttgttgatcctagaagctcatctgccagatctcttcatcctaatctcgattcccagcacaataagacctctcatccggttaggtccttcactcatcaatctcatgtacaccgctccatcctcaccatcctcgttgaagaactcacccagctccacctccatccagccgtcagctcttctctcagggtaccttcctgtgaaggcaacctcgcgtctcgattcattctctccgatgctgaccgtcgcatcgtgtggtgaagtgtccagctcgtacaacccatcggctatcttgaacaccatgaacgcagcgtaagtcgagtttggggtcagcaccatgctgtctatcttgctacggatttccatccggggaggagcatccatgaattcaacggcttctgcgaacctgtcgtgaacaaaggggtttgaaacttgtaaggaaatcatgagaaatcgaaagtaaccatcacttgaaccatcgaattatcaattatgcaattgccgattggagaattatgatgaacgtaaaggcactggacaacacgataaccagtcgtgtgatcctaagaaacggacctcgagtcggcgagggggatccagcgccggtaatccgacgtctcgctgcacttaattaccaacgttctggccgagagtacatagcacttggccccggtctccctgtcgaaccagatgccctgtgaatgagagagcagcagttttgaacacgagaagagatcatcaaggaagcagtgctcttagtcttaagtaatcagtaattagtttagtacgcaccctgagcctgtctggcaggagggggacatttccatcggagccggagaggcggaggaagagcgccttgttggaaggcggcggcggggagagctcaccgtcggcgaggtcagggacatcccgcggcaggaagcgggaccagacgtcgtcggagtcggcggcggcgcggaaggccggggagacggcggaggcgcggcaggcgtcgcgcgggcgcggcgccgcgcgggagatcaccgcggagaggagctccaccggcaggcgcgcgatctcgcagcacgacggccccattggcaattcggcaaatgacaaggagacaagaaaaaatacagctggggaatgtgagaataataccaccggtgagcatgccggaaggtcggtcgagttccacttccgcccatggttttgcagtccaacatgttgtagtatatgtgtagagccgtagactagtagtagaaaattcgaagcagaagtcactcctcacttgacaaatcaagcaagtggcagtatctgatcacacatctctgttctttttcacttggttattactcggacatagttcaaaattgctactccgtcaagatatcttaggcctaatctcgatgccctgaataacaaggcctccattggacagccatctgcctgccttgggcttcacgaggctgaagcatacctcaccctggttgttaccctcttggttgtagaactcacccagctccagctccatccaaccatcagccctttcctgagggagaatcacactcccatcctgaggcacctcaatctcgccttcgtagtagtagtcattgcggttggagctgtccaagcaaacttggcgagtggattggcgtcccccgacgccgacggttgcaacccacacagaagccaacccacatgaatcttcagctaccacgaacacaatgtaagcagcataatttgagtttccggagagcatcttgcaaggtatcttgccgcagacctccacacggtatccttttaagaactcaacaacttctgagaacctggagtaaacacgtggttaatactatttgtaagttgtaacaaatcattagaattgaatacatacaagtaggaaaaaaataggacacgggaagtcaggaacaaatttccatggaactttcgagtcaccaagcttttgtacacagttttgccttagctccataccgtgggggcaagagatatacatatatttttatttttaagactagcaacagatataactcttttttcaatattgacaagagatatatagttcaagaactccattgggatcaacaagatacaagaaagctattttttcggtacttcttgttactctgtttacaaaatcagagttggtctttgctcttcagaaaaaaagaaataaagaaacgctcaattaaaatcctaggagccatcagaggagcagctactgtatagcagaatatcactttccaaacaaaaacaacttgaagtttggtcttagcctttcgatataatcagaatctcttcaataaagtttgtgtatgtacggaaatatcacgtgtaatttctcttaacaagttcttatgcatatttttgaaaacaacaacaactgtgatttcacatttctattctgaaagcaatttcatctatcatcacaacacatactccaccaaagttacaatatggcaatttcatgtaccacagaaagcacaagagtataaatgctttgcaaattttgcgaaatggaaaacttcgcagaggaaaggaaggggcatatagttcaacaacctggagctgccggtgagagagatccagcgccagctatgcgttaagttcacaatctgcagcgccctggccgacagcatgtagcacttaaaaccagtctccctgtccaaccacatactctgtgtacagaagcacacatcaccttattagaccgatcgatcaagaaacatacaaaaaaggcatgcaaagaagcatttttcatttggggagctagggccgtactgtgagcccgtctgagaggaaaatctcctccatgcacgattgcaacgttgtcaatgttgagcaggagggtttctcatgggagcaagcaagagagttcaggggtggacttttcttaggtctaatctcaataccctgcacaacaaggccactcttccagtggcctccttttgtctccatgaaactgatgcacacctcaccatcgtcaccttcctcattatacaactcacccagcttcagctccatccaaccgtcagcccttttctgagggttctctatatcctctgcaagaacaactgcacgtggttctattctcttgagccttcattgaacgacactaacttggcgggctgttatgcttcctccgatgctgacagatgcctcctggaatgggaaatccagcccataggatctatcagctatcttgtagacaaggtatgcagcataatttgtgttttgtgacagcttcttgcccggtaacttgccacggatttccaaccagcaaacagataagagctcagcaccttctttgaaccttttgcataattattcatgacaaagtaagagatgagttaatacaaacaattaagccatacagaaccaacttcaaattccataactcttgccatcaaacaagattctatgaactgcttcagtgtagcataataatggcatttaggcatgaaacatgtagcttatcgaactcaatttgttgtatgaacaaactgatttatgttccatgtgtagcttggatgtgttctatgtactgatccctcctcacttcttcatcaatagaatgatatgcagttctcctgcatattctctaaaatatcgcgccgcaagagcaacattatttaggtgaagtgacatcgatctatatgtttaatttatgcatcctacgtgctcaagttgcaagtaaaggggggggggggggggtgcacatgtgtataaactctgatttccaaataaaaaggacttgaccattggattcgatctggtgatacaaccaaagctgctaggaaatttgtttatgcttgttctgtaatatagtatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaatt

SEQ ID NO: 39428 - DNA, 14007 bp, Oryza sativa
  unsure (1)..(14007): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaatctttgcaatttcgattccttcaggaaaaaggccaccgctgcgtgaaacataacaatgttgagatttccataaaacgaggtgtaacacagtcctgtttctgcaagtccgaacctgttattccgcagatccaacacaaaagacttcacattgttctcccttaatttctgaagtgcttccttaacagatcctgggagaagacaatcaattaatatgatcagcaggacataacatctggaaatatatggtgttttataaaggcattagaaccactcaaagtcactaacctgcggcgttttggttgaaagttgtcaatttaatgtaaccaacctttgaattgtcttttgcacctggaatctcacacatcctcgaccttaccggatttaaagtgacagtttgtcgcctatgataaatcaaacaatgcaatgaccaatgaagtaaaagtaactgtttgctttcaagatctacaaggggatcatgggaaggaacttacttcagaacaacatgcctggtattggacccactacgaatatccaaatccactgagcttccttcaggacccctagcaaagatgtaagggaataacttactcaagtagcactggaatgcaaaaaaaaaaaaaaaaagaaaaaaaagagaaggaaaatctaagacagacaacttcgcacttcagatgcagttcagacactgatcatgatagttagtagttggtcttactgtaagcgttgtgctgcatcatatatatccatatcttccgtgcttctgttgtcaattgccaatattacatctccaggaagaataccagaattttctgcaggacctcctggggttgctgacataacagaaagccctgaaggagatccatttagcgccattgggtagctaattgataaacctacacctgtgagtgttccttgcgagccagacttccttcaaaaaagataatggtatgaattaaaaagcggtttatgacacacagctatgatttctctgacaatcaaagactgagtttcatacccgcaaactcttgaatttctcgggttccaagaaacgagtgaatgggtcatccaatgttgaaagcattttctttattgcagcatctgaaatgcagttgtgctcaagtaaactgactgaacggcatcaaaattcaaacaagttctcatttctcacatatttatgacatatttaagttagattttctgatctctgaaattagttttaacctaaagtgctacctactccctagcccatttagatgctggacccctccagccttggcccacctaactcgaccagcctagtgtctgtcagaactcaacaccatataatatgtaaacttggagccttatagaaaaaagcctctggaagaactctttatatcctcactgacaggcgcactttgaatcattacttaataactgttcgacatgtttatactttttccacaaaataaaatgatctatgatgtatcagaagtaccctaaagcttcagcttggcacataaaagtaatttttgtcacagagattattgaagggcaatagaaaatgttaaccaagaaagagaaagaaaagcattaaaaaaatcatacatgtttcttcccgtgtattcattggttcattgcggagagcattttcacggtatctaaaccaactctgcccattgaaagatttgtcgtaatatgcacgatcaactgcacgccaagcctccagaaaaagcaaattttcctccgtgagtgccaatgcttggatatccaacaacaaattttagacacaagtgtcagtagaagtaggacatagagcaagaatgaaagctacatattgaaccaaagctgagaactcacatgaaggtgctgtataggtggctgcagatacagacatgacgagcaccatccccaaaaccacacggccaaagccaattgacaggaagggcttggctgccttgtagcctcgagcaagattaccacccaggctggtgagcagggaaggatagcttgacagtattctctttattgcccgcggcaatgcggagataggatgtccagtagttaaaccaccactggacctcctcgttgccttacagcagaggctcatgtgagcacgcagatgacgacgaggttcccatatcgagacaattgccacctaaagttcaggaacgaaaaaagaatggcttaaattgctgatgactggtacaatgaataaacataaacagaagcaaaaggtgcagagcttataggttgattggggagtgaagcagaagcacatcatatccatctgaagcaagcaaatagttgatgattatatatgacattagttgattaatttgtctgaagcgtcttgtatttgtgactagaggtagtactaattaggagccacttatggaagaatcgcctattgctccatgaatcactcactgaaaatgactgcaacctaacgagatatgcatctagatggcataatttgaccagcagcaattgcaggctgcaacctccacacacccgctcatactacaagctaggtaatcaatcaaaaaacagcggaagcacgaaacaaccagttccttcccacgtcgcacactcgcacccatccacataaaaacactacacggatcggcaattccgcgtccaaatgtttacgaacaaaaagaaaaaaaaaagtagcagcggccatagcaggagcgacagagatggaggatgggcgagagcgagcagttaccgcgtgcaggcgtacgagaggagcgccccgacggcttgcggccggcgacggcgaggcggcggcggcggaagcggggacgaagagtgggcgggagcacgtcgccatcgatctccccttctccgcacccgatgagctctcctctccaatggcgatgaagcaaactggaggcctccgtttttctcccggctcacaagtcgactagaaattgtaaaatcaaattaaaattcttttttggaaaattttgagaaattttggggctgagagatgaatggataatggccgcggagttggcctcccttccacgtggcctgcacttttttcggctgagtggatgtgtggttagccacgcaactttccctggatcgaaagcgatgggccgttggattgggccccagcgcgaagcggacggcgatcgcggaccgcgtgggctttttgccttcctgggctttctgcccacgtgtccggcccaattaatttcgtgaacctttgataccctctcttctctccttctggagaagcaaaccctcgcgccgccgccgctctctcccacccgccgccgccgccgccatggacgccggcgagacctccacctcggactcgctggtacttgccacgggcgccgcgcagggaccaaagaggaagccgccccgaagcgcttcgtccacacgcccatcccgccctccatcctctccgacccaaccctcgccgctgccgccaccggcctcctcccggcggcgtacaacttcgagctccccaagacggcgcaccgcatccgctcctccggcgcccgccgcaccgcgctgcagcttccggagggtttgctcctcttctccctcccgctttcccacctcctcgcgcccttcctcgagccggacccctccaacgacgtcctcatcctcgccgatcccacctacggcgcgtgctgcctcgccgaccgccccgccaaggcgctcgccgccgacgtgctcgtccactacggccattcctgcctcgtccccgtcacctcctccctcctccccgtgctctacgtcttcgtcgagatccgtgtcgacgcccaacgcctcgccgacgctgtccgcgccgccttcccggaccccgccgatgcgccccgcctcgccatcgccggcaccgtgcagttcatttcggcagttcacgcagcgcgtgagatcctcagtcacgatggttaccagggcatcgtcgtgccacaggcaaagccgctgtccgccggcgaggttcttgggtgcacagcacctgccctgaaaaggtccgagggggtcggagcggtggtgttcgtcgcagacgggagattccacctcgaggcattcatgattgccaatcccggggtcaaggcctaccgctttgatccattcctgggtgtgcttgtgctggaggagtatgaccatgtcgggatgaagcaagcgaggaaggaggcggtgctggcagcaaggaaggccaagagttggggagttatactaggcacccttgggcggcagggaagcgtaaaagttctcgacagggtggtggagcatttggaggagaaagggctggaacacacagtagtgctcatgtcggagctgtccccggcaaggatggagctgtttggggattcggtggatgcgtgggtgcagattgcatgcccacgtttgtcgattgactggggtgaaggattcaagaagccaatgctgacgacattcgagtttgatgttgcactgggctatgttcctggatggtgggagaaggggagtagggaatgtggcagtggagatgccaccggttgttgttcaggatcaggaacttccacagattgtggttgcagcaatggtggttgtgctgacaaggactttgggggggagtacccaatggattactactctcaggatggaggtgattggaacagctgctacatgaagaagaagccctctactggagagagaaagctgcgagttcggattggtaattactcaaattcatagtagtttacatgtggcctttttgtctgtcctttttcccctgtatactggggcgaaatgcttgtgtaactcttacattctgaatttttcaatattaccggcatatctatatgttttgtcaatcattttaaatcaacaaggaaatccttgttatgttagtgggtgttataattctctgcttaattgcaacatggtgattttttttttcaatgtgaaatgtccttagcataaaggcagaatcaattcttttttttttcagaactattatagaacttcaggatatattctttgatgaccaagattggagtgattttttttttatgatagagcataccttaatgcaagaaagttatctattgaatttgttaatttattgcacttggtaatttactatagactagagagataagaaaggactattagttaagctctgaataatacacctgaactatgtggatttggacatagtgagcatctttcttgtgacaatcggtagtgcaagagttatccactggtggctatctactgtgtttgtaaactcctgccatcatggtcaatgtgtatggtttggtcaaaatcgcactcgtcagttaatttgattgatactccatagcaactattgcatgttaatgtgctattcaccttttttttttgctgccatttgttagattttgacgtgatttatgcttaccattatgtgagcaggcagcaaagttcaagttgaggataagcaacaaagctaatatcgttgaaacgagatatcaagagcagcttcatgtttcttcagaagttttgacaccagagttgaatagtatttttgatcttagcactgccgttacgagtgctgtgatatctgtatctgtacacagatgtaaactactcgatcctgcgccacactgtaatgctgtgatgttgtcttcccataaaggtgaaatgattctaagtttatggagcacaattttgcattctcgattttgcctactgaatcttgattatcttattgtcggctctactgttttagataaatcctaggatttgaacttgagatataaaagggaacaacgtccatggctctactaggcgtacataatcatgtaatgtgaatcgtctagacgtcaacctttggctagtgttgttgtgctgttcttcctcggtcctaacatttgaatctggacactatagagctccatcgtttggccggtatatttgtaaacaaaaaataatttgttaataaattttttatatacatgttcttagcgatttaaaagcaaagactgaaaaataaacttcgtgtggccgataagcataagcacaaactctaaatttaaggttgaaaatttaaattgtaagcgaaaaactgatgtgtacaaaaatatgacggtgggagtaggtctaatggtaatagtgcagaacttctactttagaaaacatgacaaagaggcgcttattcaacaaaatcacggcaatgttctaacagcaatcatccccaaagatccaaacagcacatatattattatagcagagtggtgtcacagttcaaagtgcttctaagcgaaacgagcagaataattcaatttccaaggctggtagatctggattacaatttggcgtgacatagctcagaagcacagccaaaagcagatgaaccatcatcggttcatttatcagttgccagaacacaccgcaggcagccaccttcatgcagcaggtcaaacgccttgttgatgtcagtcaggttcatgctgtgagtaacgtactcgtccaccttgatttcctgtgcggattacatgagaattctggtcagatgaatcactacagattgacgaaacttctgcaggtttagagtttagacagtgatgatttgttaccttgttcaagtacttctcaacgagccatggaacttggcttcggctcttgaaaccgccgaaagctgttcccttccagacacggccagtgacgagctggaatggtcgtgtagagatttcttgcccagaagcagctacaccaacgatgacagaggttccccagccctacagtaatacccacagaaatttaacagttgaaagcgaaaatattttactttgtgatgggtggaaaacagtatgattgatctataaatggaaatataaaaacagatacgctgtatttcaaataaaagcagtttatccaaatgacaatgcaacacagttaagatatgattcagatcaaatgtcattaattcatttagaaatagacattaccgcaccaaatgattcaactcaatttattaattcttttgaagtttgtcattaatttgtaccaggcgacaaaattcacaaagatgtccgaataaaagctgcagccgtagcttaccttgtggcagcactccaatgcagacctcataacagaaacatttccaatgcattcaaagctgtagtccacaccaccgtctgtaaggtcaactatgacctgttggattggtttgtcatggtcctttgggttcacaaattctgtaaccccaaagttctttgctgcaaacaataacagcagaaaaagagttggaaaataagctatgtttgatttgcagacaatttttatgaaataactcatgcaatgtaatacattctttatcattcaataacacatacaaagcatccaatttgtaagaacacatttgtggtgcatatgggcggaaataaacaaataataataagtttgatctctggacctgatgccgaaaagcaatgtgatgattaataagagcaaggtgcatgcaagcaaaagaggataaatggtaataacaagttaacaatggatcacagatcaaaatctttcctatcacaactcagacaaatacaatggtggcaaattcaggaattgttgatggtgcatcactgcctttgcaagtcaaaaacgaattactataaagggatagtaagcctttggaatttattctagtatttgttgataatcaaacaatacgtagatttgcactttcaggttcgattcaagagagaaaggtctattagcaagttgcaccaccagacatggattgcctgctttcaccagatatacttaagagagtggaatatgccctttactctaccaaccaaaaggtgcaataaacagaaaaatggaaattatgaaacataccgacatcaaactttttgctatcaatgtcgatgccaataatccgagaagcaccagctgattttgccccctcagcaacctaaaatgaaaatcttagatgtcaaagctctctttccagactaacatgttaaatgtgcatggacatattttgacttactgcaagtccaactgtgccaagtccaaaaatagcaacgatggaacctgcttcaacctttgcggtattccatactgctccgaggcctaacaatagtaatttgtgagatacacatacgaatatatcataattatctagaagagaataacaagaatgtgcgaggcaatggtatgtaatattgtatccagtgtaccaaaagaaaagtaataattggaaatttggaggtatcattgacacagatatagtgaggctttccatatttatgaaatatggtaaaaaaaatcaagcacaatgcattcaaacaacccaacgagctctgcatgtaaggtttgtaaagctacaaaatgatagtaggtacaaaaggaactataattggtgaataaaagtttggcctccaatgaagaacctaccagtagaaacaccgcagccaagcaggcaaactttgtctagaggtgcctgtgggtttatctttgcgacactgacatcgtgcacaacagtatactggctgaatgtagatgttcccatgaaatgataaatgggttttccatttattgagaaacggctcttgcgatcattcatcatgacaccgacccctgtggcagcacgaactttgccacagaggttggtctttccactcttgcaaaacttgcattctctgcattctgcttggtaacaaggaatgacatggtccccaggctgcacctcagttactccttccccaacactttcaacaattctataaacataaacagaagaaacatatcgatgctcaattatcttagctgtgcatgatcatatatgtaattagcacatctatatgcttacccagcagcttcatgaccaagaatgcaaggaaatagaccctcaggatcctgcatggcacgtaaatcacttgataagggcctgtttggttggtatataataatgttgccaacatttgccacaaggtacagtaatctactggcggtagaatattgtattatactagtagaactcaagtcaacggtttagatgctactactgacgagaatactgatggtctactgcttgccagtagagaccactgtagaaatactcaacacttccaggtttctgccagtaattttgatttcctacagatgattgccatcaatctacacccattttgcagtcaaggaaaataaaaatataggacgaactcatgcaacgctagctagaagcctagaagaaacccagagtcctctagtacaaaattgtttaatcttcccattcataataatctgaagaaacacctaaatccttgaaacaataacataacgatgttacttgacaattaaatactaatccactaattaaacaaaaaaatgaatcgggttccatccagtgcggtcaccaactaccatcaccagatacgtggttggaaagagtatactaccctactaccagtgtaaatggcgagttcgagaaatctagatttcgaagaaacacggcgagtaagagtcggtgggacagagagagagaaaccttgccgctccaggtgtagtggtcggtgtggcagagcgcggtgaagaggatcttgacacggacctcgccggcctgcggcggcgccacctgcacgtcctcgatcgtcatcggcctgttggcctcccatgccaccgccgctgcacccaccaccacaccggggatcccccactccagatcaaaccaagaacactccaagaaacagcaaccatacatccaactctagcacactagcaaatctaccaccacgaatccacgatactaagagaggggaaccaagaggttacctttgcaggtgatgacctggccctgggtcgaggaagccattttcacccccccccccccccccccctctttgcacgctcggtggtagatgcgatggagaagagaagggaagaggatgtgattgcgaggtgagaggagaggatagggagggggagaagagcagccgagaaggggagaggaggtgggcgtgggttttggttgggttaattgggccgggtccactttggatattggaatattgcatttccaaattattagggctagccagcttggcagatcagcatgtgatgctcgttttgttcctaggccctgtttagatcccaccctaaaatttttcaccatgtttgaatatctgtatggaatattaaatatagggtaaaaaaataactaattgcacagattgcgactaatttgcgagacgaatcttttaagcctaattgctccatgatttgataatgtggtgctacagtaaacatttgctaatgacggattaattaggcttaaaaaatgtctcgtagtttactgacaaattctgtaattatttttttttattagtgcctgaacaccccatacgacaccctatataatacccgatgtgaaacaaaaaaactttacacccctagatttaaacaccccccttaaccatgtagtagtagcagggctgtttggcagagctccaactcctaaatttagttctaggagtcgggtctagaatgtagttgtgaagcagcctaaatccagctccacctctctagttcattttgtaagagagttccacccaacttcgctctcattttaggtggagttgaaactgtttggctgagcttcagctccaggagaggtgagctgtgccaaacaagcccgcagtagtaacaaatttaagcttttcagcatgtataaatattaatcaatttgttcttaataatctagttgatgtgatatttttaggatctcatcccaaaaccactgaagaactaactgttagtgcgcaagagaaatgaataattcacatcctctgaagttgtaactgtaagtctgtagtcagtcagtcctgagctgcttcaacctttcaattcaagatcttgagaagtcactgacgaacaatgtgaacttaaaattcttgtacagaaacattccgtaatttatacacagattatccagttgcgttgctaattacactggtacaacagaacgctatgaatgtgtcatgaaatcatgatccactgattagagcacacacaatggcacatcgacagtttcagacaactggtaggcagctactccgttttgtcatcagagttgatctgctgcgccagcaacagcagcccgattgatgtgaaaacagagagggcagtagatgtgtagccaagaacaagcagtgagaccttgagtgactgcattggatggaagagcatagcaggggttagcaggatgcagaaatcacatggaacttactacacaatcttcaggtgtttatgatgctttgttaccttggccatctgcaacgcgttgtcgtttgcgtactgcattgagccgtctggaatgttttgtataccacgtgctagttgccatgagagaaatctgttttacaagaagaatttgagatgctgtaagtcttgaattcacctccaaatatatatggtagatgtactgaacctcaggagacatatgataaaccagctactgcctccatctttttatatttgacgacatcatctaattaaaaatggagggagtatttgactattcgagtgcagcactttcttcagagagaaccaataaagaattaacttagtatggaatgggtatgtctgaactattaaatatgaccatccatctgttggtataaactaacagcccccagggtgtttgacgctgggaaaacaaatctgtcagcatggaaccgtatcactgacatcagatttgtcccccctagtaagtatcatagggtgaattctttaacatatatgcatgggcaagcgttgacgatatcaaatccacagacctgtggatgatatttcacagtttcaatagaaggaatgccaagtgagtcagctcttacccgaaaacaagtccaactgcagctccaatatttgccttttctgctgtcaactcaaactcaagttctaaaaactggcaaagtaggggaatgagaactatatcattcagaataattcccttaaccattatttaactgcagagaggctcttaccttcaatttcctttttactttcatagcctctacttcagattgaactactggacgttttgatagcagcttaccggttttgctcattgtttcagcaatctacagagatataacaaaaagaagtgttacatttgcacacatacctatgtggtcataccttttgacaattcagtaaatcaatgcagaggggattttccgatagtgactacagagttgtaacgtaatttagcgatgagagaaccatgacacaatgaatttcacaggttttcttctgcctccataggtaggatttttgccattaattcacccacattacagatgtttccatcgaactggaaccagttttacctacatgctcaatggaagcaacattcctactgccctgaatcgcaacatactaacctctacatgatttatgtttgaacatatgatcaaatgattagtgaccaataagcaaatgtaccgaaacaaattcaacaaaacaacagcatggatagaatgtggatagggtcagtgcctagaccttcttcagctctcccttgccgtattgtcccatggacgtaaacctccttccagctgacatcagccgcttgccaaatgctacactatgtaatgcaaacagcaagggacacatccttcaatcaagaaactatgctacataaaacacaactgttgaagaaatatgaatccaatccatgcctgatttggcactgccggtcaagtagggttccattgaaggaagttgcttgacaaggttgtttgatgtcgatgtgtcagccatctcccatgcctttgcaaggttgagcagcagatcacctacctcttggccacactatctctccacagagaaaaacgaaaacttcttgatacaaagaataggccttcatagatctaataatcatcgagttcttgcttgaaaaggacatcgaattcattagtacctacggacctacctcgtcaagaacaggcccattggagagatcaaatgccgcatcattgagcttcaacaaacaaccacataaacctttgttaacccaaaatagaatttctcgtgttcacaagttacactttaaactttgtatcactgcatcattgctgctattcgagagtgctaagtttgaaataaaaaagtagccaaatcgtatcactagaaaacataggcatgaattcaacggagatagggcaatcgctgcttacatcgaggcgaaggtcgcggggaagctgggacaggaatttgggcgggagaaccaagcaatcctacaaagagaaaacgcccgcgaattcaaaactttcgaatccaaacatagatttgggccactagagtgctcaccgcgagttcttgcaagaggggaaggacaggctcctcgtcggggttgtcaccgccggtagaagaggaggtaaccggctttggggagtcggaggagacggcgaatacagggggtgggtatctacatcgccggagatggaagcgggaggggcggaaggaggaggaggtggaggagacggcggcggcggcggcggcggcggcgaggagtgggcggcggaggacggccgtggccattcgaaaacgctctgcttttttttcacctcttttttttccctcaattttcgttctaattttacatgttgagatttttgttttggaaaccgaaacatctgggcttggagtggtggaagggcccacgctatctctttgcttccaatggaatttgtccaaaatc

SEQ ID NO: 39429 - DNA, 11150 bp, Oryza sativa
tgtaaatgtacatcacaaaacgtagggaatttcgatatgaactgcaatacagtttcgccattacaaatttgcaaggccagttccccgcaaaaaaaaatataaaaaaataaaaatttcaaggccagtttaaacatgaacaccaccatgatccatcactctatgacaattaatttacacccacagagtcatcagcagataatcacatccagttaagctcttcactgaaagtctgaaaccatccatggcctaaactacagagcactacgcatgcagcagcagagtgatctctctctctctaggattcaggcctcaggatgccattgacgacggagaggcccaccacgacgccgagcgcctcggtggcggcgaccgccccggcctgcacgagcccgtctccggcgagctccgcgccggccaccagctgcaccccttccccggcgacctccgccgcctccttctccgctgccttcaccgcctccccacccacctccgcggcctccaccgccgcctcctccacctcccgcaccgcctccgccgccgcctcctccgcccgctccagcttcttcctgatgccgaagagcccgatgccagcggcgttggcgggggagggggacgccaccgtcggcgccgcacccgccgccgcggacaggagcaggagcgccgcggagcgccggtcgaaccgcacggcggaggcggccacgcggcggcggcgggtggtggtggtggttggcgcggcgcggaggacgaggttggaggcggtggtggagacggccatggtggtgagtggcgttttgctcagctcagctcggctcgtctgctcggagcctcggactcggagtggtgagtggcgcggagggaggcgtcaagtgtggccgaggatgtggtggaccgggaagacggttgccccggagccaatcgtttggtgacatgtggcatgattattctcatttcttttttttttctttttccaaaaatcttgagatttggagtatattgatttgttctgtccaagtgtcaatgattgaaggccaaccttagcccacgttccgacttccaaattggccacacttctgtcaaggttatggcccaacatatattacctctgatttttttgaaggatttagactgttgactcataaaataacatttggtcatttaactcattaaaaagttaataaaaatatgctaaattataaattatacctaatttttttaacgataaaacataaaaaaatgataaatgatagtaagacgaatgataaaatactatgtcaaatttcaatgacgccatctgttaaaacagaacggagtatatatggatcttttttatggctgaatgcatggcccagtattaagattttcgtgaactgaaaaggttacatttttcgtaaatgtgttctgggatatcaattagaaccaatgcaatttctgctggagttcagataatcaaacagataaaacagactgaaaaaatgcagctccaagagaatggaactgactgataaccccagcagactaaaactgttcaatgttcagtcaagcttctatcagataaacgactgatagaaactaataaatttcccatgcatacaaaagatacatctgattcgttaaaaaaaagagatacatctgctgtaactcagaacaatacattcttcctgtgcctgctcttgccgtcttgcgatgcgctcaaacaagtaatcgctgcatccatggttgcctgaaaatcgcatctgaaggcagcattgcattgtattgcaagtttctcctgtgcatgtgaagtaaatctattactctttgattatttctttccaagggcgaggttgacccggatctccctgccttctagttcctgcaaaatacgttgtcgttcagttaactttgtaaggatgtcaacaaccatcttaataaaacttgatttaaggcttttcttcagatacatgagaagacaggttaagcaaatctcctttcgagcctaggactgcattcaaggttcattccaagaattcttttgcgaagttattagtgatgtgaaccacttaacctctacacatttaactggaattcatccatccgtttatttggcatttggaagcttaacaaatctactctcactgtcatgccaagctaagcaagcttttgggtgtagagtatcaaggaggaaagaaaacggtggaatgaaggtgcatttaccgttccattgagcgaggaaagagcttcatccatctcctccttggtggagtagcagacgaagccgtagccacgggaccggccggtctcgccgtcgtagagcacccgggcgccgaccacgttgccgcacttctggaacatctccgtcagcatctccgaggtgaccgtccacgacaggttgccgacgaacagcttgtgctcagtctccgggtacagcggcagcttcggcttgggcttgtccgcgaagttcaccctcatcgtgcgcccactgtacagctgaaacgaatcgaatcgaatccttcaggaacagaactgaataattgatcgattgaggatggttggattgatcatgagagattgagagtgctcacgctgccgtcgaggttcttgatcacttgctcgcagtcttcgatggtgctcatcgtcacgaacgcgaagcctcggctcctccctgtcgcccgatcgtacaacacctgaagtcaaattgcagatgttgagataaagtttaatttgtctaatatattgatatgcaaagcttttgcatgttcgtgaaaataaaagagataaaatttaatctgccgatgtaggttctggtgcatgtctcaaaaataagcaattagtctgatgagccatgatcatttacttacgtgtcaggtgctcgggtatgtatcttactcttacgctaggaacagacatagaacggtgcttgtgtttgttaattagcattgagttggattgttggcttgttgctgcaacaaaatttcaatttctctgaaccccaacattgggaattactattgagttcatgtcggtaacaaaaacaaaaacaaacaaataaataaacaccattttttttcgttcaccaactgaggaacgaattaagcacaagcaagcatgtgtctactgcatataagttcacttaagcatttaatcaagcagaagacggtgacggtgtacgatacctccaccatctccggggtggcgtagtcctgcacaatgccggcgagctgcgcgctgtcgcagttgtacggcaggttcccgaagtagagcttggtggtgatgcccgctgcctccgcctccgcctcgccgccgcccgagctgccctccaggacgccgccctgctcctcctcctgcacagctgctccgtcttcctcttgcaactgctcctcttcgacctcctcctcctgttgctcctccacagccgtggccgcggcctcctcctgcgagaccatcgccgtcgccgcgcgcatgcgcatcctccccaccggcacggtgacgggcttggcggcgacgtggtcggagaccgcgagcaggaggcgtcgctggtggtggtggtggtggtgcgcgcgcgccgcgggcgggcgggggaacaggggcgcgtgctggagctggagctggagctgcatgatcatggcggagtccgggagcttggggcgcgcgaggcgtagcgcggcgggagaggtggaggggcagctggagttggccatggcgatggcgtcgtgtgtgtgatgtggaggggcgcgaggccagtgggaagagatggaggacgagaggggataagaggtggtttactatgggccattgacatgtgggcccttggttctgcttcttgttcatcacctccacttatcatgcgttttctgttgagattttttccccctttttttcccttctactgtgtttagcttagcaaaggatcccttgtttagatattaaaaagtaggactggatatagtatataatctttttttctgttttgtactctgtatattgagtaactattattatccatctacgccattattactatatcagacctgtcagttgttgtaacgttggtgcaatttactcttttttttaactactacctctatattttaatgtatgacgccgttaacttttttcccatttgtcttattcaaaaagtttatgtaattgtcatttattttaccgtgacttgattcattgtcaaatgttctttaagcacgatataaatattttcatatttacacaaaaaaattgaataaaacaaagggtcaaacgttggtcaaaaagtcaacggtgtcatatacattaaaatacggatggagtatttctaattttatcaatttttacgtgtcctaaggcgtacattcaaaataatacatccaggaaaaaactcactccattaccatggtgttttttctttttgcataattcagtttattgaaaagtaagcataaaacagctcgaaaacagcaatttttacaaaatgaaaataataaggctgtagttaatctatacccaaatgccgctagtaaacctgcttatttatttgtccatcgaaagaatatagagcttgatttggacacattttacataaccttttttttccactacagaactgcctgagcagcattttattctgcccttgctgcttaatgtcctgcaagttctttcttcttcttcttcttcttcttctttttttataaaaagaaacagagaatgaacatctctggcaaaaataaaaaataaataactgctaaaaaaaaccctaaacagatgggcattcgcagcatgcagtcttgcgatcagacgatcagtacacgtgaagcacgggtgatgatcacctctcccactccgcgctgccgccgccgaagcaggagctcctccggcgatgccgccgcggcccactgctccggcggctgttggccttctccttctgctggtccggcgacagatccgccttccacttctccagcagcagctccagcttcctctgctccacggcggagcccctcgtgtccatcgccccggagtgctcgacgaccgccgccgccgccgccggcggctcgtcgtcggcctcctccgtctcgctcacctccacgatcctcgccagcgacccgggcctcctcaccaggaggtccttcacggagaacgcgtccggggagtccggcgagctgcagagcggcacggcgcgcgcgtcggtggcgtcgagcaccgccaccgccacgttcacgatgccctgcggccgcagcgaccgcggccgccggagctgcagcgccgccacctgccggccggtggtgcctcgcgcggaggacgacgccgacccgacgaacgtgctgaccacgatccgcgtgacgccgaggacggcgtcaccgccgaacctccgcggcgcgcgcacctcgacggtgacggcggccgtgtcggaccggaggaaggcttcttcgacgcggaacaggaaccggtcgttccacgtcgggtcggcgccgccggcgaggtcgacgccggtgcggagcttgtgggcggcgtcggcccaggccacggcgtaggcggcgcgcacgcggcggccgaggcggcggtgcaggtcctgcgcggagatgacggtgacctcgagcaactggaggagcgtggagggcggcggcgacggcgacggcggcggcgacgcggagcagtcgtcgcggtgccggccgcccgccgacattgtgcagatcgaacgaagcaacgacacgagggagagcaggttgagacgccgcgtggcttttaaaaggagaggcaaatttggagggaaccaagtatggcgcgtacgagttggctctacagctcgatcttgcagatgctgcctgcctatttggagcggtttcaattcaggtacgattcgttattgtttgaaatctatgtttgtgagctgtgacaatgatccgatttatacacccgtagcaattgtcaatttcatttatttccttttattttgcactctttttctaaatctcagacaggagtattttggtgtgctttgaattattggaattaaacgatagaagaaacgggaggagttcaaaccatgctgtttggcagtactaagtgctatctgtgtatggtaaacatattactgtagcgcaaatttagccttgcacgtgatacacaagaaacatgagcacatgagcaatagaacacaagaatgtgcgatacatgttggactagggaaaaatgtcatgaaggcgagcaaacagctaagctctgtgcctgtgcagagacagggagtagccaactagcctgatggaccatgcacaatccccacttctgaatactgattctagtatttcacgcatcaccaaaattgcaaaccgatgcagcgagttgcacatagacaacagcaacgataaatgcgtatgagagcgatgataacggataaaacgatctaacattcaaaactcaaggattaacatccaggatgcaaaataacagaaaaccagacatcgtttgcctcatttaggaacatagagttacgataaattaagcaacaaaaagacactggtctcccagcttagcgcaacaagtgcagtctagttgctagcagcagcccccttcttccttggtgcagcctcagtccctggacaacatttgcaataatcaattaacaagtgctacagcatttgcaatatacttcctccgtttcacaatataagtcattctagcatttcccacatttatattgatgttaatgaatctagatagatatatgtctagattcattaacatcaatatgaatgtgagaaatgctagaatgacttacattgtgaaaaagatggagtagtaaataatcagtgaacaagtgatagaacatagcaagaagagatataagcataccctctctgaagttactcttgaacctcttgggcacgtggcgaaggtacctcatcctcccagttccagtggtcttcctcctgatggccttcacactccagttgtctgtgtttcaaatttcgagaaagaatcaaagtagtcagaactacatatcagaggagctgagcagattctatcaaacttcatcaatgaaaacagcaagagacctgctgcatcaagcagcagcagcagcggtctgcagccaggagccgagcaggcttagggcttatatttggggagcttctagcagctgcagcttctcatagaatctctagctcccccaaacagtccagattaaatgcaaacacactatgataatctacctaaccacaacttcgtaattggacacaagggattggccaaaagatgtcaactcgagtaatttgattgaaacaaacaagaatctgaaagcacatatccccacacaaactgcttcctttcaatcagaacagattgcaagtcacaaagaatctgccacaattatcaacagtagatgtaacaaatactttgacaatgcaaagtaacatataggaacaacaactatgtacaccggacaatagtaacataacagaatgaagtaattcgataatgacaaacgctaccagttaaccagtacagttttgcatttcacgtctttacaaaatctctcgcatgttcagaacctactagtattatcgcaaatgcgacacaatataagcaaacgtataatgataaatctcctaacccacatcaaaaaacaaaataactcggacgtgatataccacaagcatagcctaggcacaggaacagcgcaatcaacatgcctgaactgatgggagcgcgaaaaactcatcaacatcgcaacaagctagcaaagagctaattaaaggagagggtgggcatgggaaaaaaagagagaggaggatctcgtcttacacttgcggatgcgggccgcggggtagccgcaggaggagcaggtgctcttctgcaggtggaagctgcggcggccgcagcgcacgcagagcgtgtgcgtcttgttccggcgcttcccgaagctccccgtgcccttgccctgcgcaaagaagaacaaaacacaaagcaaccagatcaatccctgtcagatccacgcgaggagaggcgctacaagatgcatcgatcgccgctcgccgcgattctcctcaccattttcgccttctccttcgcttgccgccgccgccgccgccgagggagatgaggaagaaggagagagcgcaactgctcgaggttaggtttagtaaggaggtcaagcccaactaacatataggccttcgaatgaaaaagcatgtaggccttttggcccactaagtagatgaggcctattaagcagacaaggcccacctaggctattcccaacttaggcccatgaagcgacgagctcgctctttcctcttccgccctatcgccggcggcgcggctccagcaaagctcggcggcgtgctccggcgaccaaggaggccacggaatactgagaggatcagtggaagtgagggccggacctccttagggcggagtcgaaatttcgtagcagttgagaatcttcgcaggtactggagggcggccatggaggagctggagttgcctctccccacggagaagctcgccgtggatccgggcaggtagcgagatccgatcttggcttgttgttggttgcttgatgggtggtctcatccttccatgtatctcttgattcgatcttgatgtggtagggagggaggaaagcgaggtgtggctgtgctcgtggccaccgggagcttcaatcctcccacctacatgcacctgcgcatgtttggtaagcctctaaattttgtttgattttttatgcctataagcttgtgttgtcccatgaacagcttgataattacagcaagaaagttttttttaattattttttcccgtctgatatgtttcatttagaactggcaaaggatgaattgcagcagcgagggtattctgtcttgggtggttacatgtctccggtgaacgatgcttacaagaagaaggtaatgtgtggcatcaccactgttctccttgtggtgtagaggccggattcttaatccattatctaaaaaatatcaccactgttctcttgattgagtttaagatttggaacggattagggccttttatctgcagcccaccgaattcgcttatgcgaactagcatgtgaaagctcatcttttgtgatggttgatcgatgggaggtaactttgtttcattcagcttatacgtcctggtggattctgtagcatttcttgtacagaatgttgtgtgtccttggtgtaggcaatgcagaaaggtttccaacgcaccttgactgttctctcgagaattcggaatgctttgtccaaggatggtttagctgatggaggtatctagcaaccagtttttttagaagataacaaatcctttttcaacatactgttggataatgtgaaccagtgcatctttgtcttggatacaatcaattatgtccaagtccaacatgtactgacataaaaaatgacacaggtagtcccaatgtaatgcttttatgtggttccgacctgctcgaatcattcagcaccccaggagtttggattcctgatcaggtgtaaacgtcgaactctggtgtcaatatagagaacttatgtgctcattttaactcttagtgttatatctagtttctgtgtgattcttattcacagaagagcttgctttgatgacaccctcttctgtatctaggtcaggatcatatgtaaggatttggtgttatttgcatacgtagagaaggaaaagatgttgaaaaaataatatccagcagtgagatactgaacgaatgcagggtaagaatgactagcttatggagcttatactactacagagattagtcttcttttctgatgacgtttgcattatccctttatggagtattttcaggataatattatttcagttgatgagattgttccaaatcaaataagttcgtctagagtaaggtattgttctttcatgcatttgtttgaggtttatcatacggcattctaatatccccaacatcctctgttggatactgacatgtgagtcatgtgtttatgcacaatcaaattgcagagaatgcataaaaaaatgcctatcaataaagtatcttgtatgtgatgaagtcatccagtatattggagaacacaaactctacaaggaagctgacggcagtgatacaagaaaatgacaataaagggtccagtgcaggcaatctgaatatagaccttaatatattcacggttaaatgttaggtgcctgttttatagctaataggcaaatgttgtaccctgggcatctgttttgggatatacaactgaattggatgatgagaagcatttgttttatttacaaaaatgaaacatttcgaaataaaaagagcacctgctaattgcatgttgactggaagttgtatcataatacagatagatgagatacttgtcagcagttgtactccaacatgtaatgctggacatatttcctacaaagcttcattgtgtccatgttagtatggttgctgatcacaatatttcagaaataacggctacttgtatgcgtatttgaccttgtacctggttgtgcaacagactgtggttaaacttttactaacatgtgttcagggatatcacttttcgaacaaatgcaaatgcaatttctgctggatttctgctagattagttaagaggagcaaccatagtatttgcaaacatattagacggactgcagttccaagaggatatgaactatggaactgattgataaacaaacaattgtaaggtgaataatagagatcaagttgtctttcctgttcctcaacaatcagtatatacatacatggaaggagtaaaagtataatagagatcaaattgtctttcctgttcctcaacaatcagtatatatacattttaggatggatagtatgatgatcctcatgcagcagcagcaatttcagttgatttacaaaatcttacactagagtcgtaataacaaagaagcacacgaaaatttactgacgaaatgttgcacttgcacaactactgtctactgccactagttggaagcactcgttgcttcgagctgcctgccattgccgccaccaccagcatcagcagcagcagaagaagacagcgcctccctgccatgtggctccaggagcgcctccgggctgcagctcgccggcacgaggggcaggatgccgccggggttgagagggaagagggcgccgaagtagccgtcggcgatggcggccatgtcgcaggtgc

SEQ ID NO: 39430 - DNA, 1981 bp, Oryza sativa
ggggttcacaatgactccagcattgtctgcaaatgtgacaccaaaggaacattagaattgaaccataacccataaacctgtgattaggtaattctgtagacaaaggatcaagagaacagcaggtaacacagaaaagtatagacatcctacgaattaagcaatttacaaataattcacatattatttacaaatgaaagagctgtacacttcattcacatattacttatacaaatgaaagagcttcacaattcactcggacattacatacagttgaaagagcaaaagaagaccacaaagtttgtaagttccttcatgaaacacatgcctaatgataaatgtggcataatgcaagataataacatactatgatgtctatttcaggtcaaattgcattccagctctatgctaactaatgacaatgcagaaacacaatctaatttatccatcaggaggttctctctaaattgaacaatgacactaaaactgaatcctatcttggtagacagaattacagaaactgaaaaaaaaaagtctggccaactatcatgtaacatgctcaaagtcgtgtgcaaatgccttccacttaggccttgttcggtttggaggggattgagggggaataattccacaccacaataggtgtgcaataaatcccctccaatccctccctcatgaggatcaaccgaacaaggccttaagcaagcaatttcagttataattcaacagtatatgaattaaaaagaagcatgcagctagttgactgactaaataactaacacaagatgaagcgcaccaaaacatggaaacagaaagtaccttcaaagtacatgtagacaccatcctttcggcgccacggcttgcgctgcctcacgatgacagctggcatgaccttcttcctcaggtcaggcttcccttttttcacagtagccataaccatgtccccaacacaagcagaagtaagcctgttaaggcgtcccttgattcccttcacagaaatgatgtaaaggttctttgctccagtgttgtcagcacagttcacagtggctgccactggcagacccagtgacatccggaacttgttaccagcactacctccacgccctgcggtcaaagaaagagcaatagcagccaggtaagttaggtccaaaacatctaaatcattgatgcaaaatagtggtcattcaaagggtatatgcttcgcctcattctcatttgataataacaacacagggaaaatttaaaatggtttagcttgagaaatgtgactagccacactatttgaataggaagtagaagaatcaatagcaactgaactagtaaagatctataaagatgcagcttcacaaacatctaaaagaattcgtgctaaacttgaaggatgttcatttccgaaggtccttaaaagaatttaacacatacagggatctaacaaacctaagtcaacaaacagctaaacaaaaatcttctccacatctaactacagataaccagactaaatcattccttgtaacactaaaagcaacacatctccaaattatacaacgcatcactgccttcaaaatatacaacgggtcaccacccttgaagcgacaagcagactaaatcatgctactcgaacacttgcacaagatcctagcgacacagcaattgacgcatcgaacaaccgcttctgcatcttagaaacggtaatccacagcagatgtctgcgcatccaaatcgaagcatcacgccgcgcaaactaaactagcatacgagaccagaatcgaggatcatgtgggagaagaaatcatcgggagggagcaagagattttacctcgcttcgacatcttggaaacggaaggggtgacaagcggcggcggcggcggcggccgagggggacggcttctctttcttatatagtcggggtttctagggctttgctggtattattcactttacccccttgacacactattatttttacttaacttactatactaac

SEQ ID NO: 39431 - DNA, 864 bp, Oryza sativa
aaggttgaggagaaaagactttggtgcccctcaataaaggagggatagtggttgagggtagaacggaaagaaatttgaacggaaagtgattgatgggacaagtagtgtaaatggtggtagacatgcttgtgttgtggtacaggatatgaatcctagaaatgcttatattttggaatggtggtagtacacttgaactgtcagtactatcaaagcgtcattatgtcaattattgagggcactactctgatgttgcaataattgtgaaaaactacttttagaagttagcaattgcctattggttttgttggttacgatcaagcagcctttctgagatacctgaggaaacaaaaaaaatatttagcgggcataatgttggccagatcaagtcctttcatgtgtggtcattatttacctcttattttttcagtgggcaagaattgtttaagttctttatttctcaaagctgttaatcgctgttctttaaagaaagtaatattttaactgaacctttgaactccaataggagatggatatttgtgagtatgcaaggcaatcattagagagcgaaccgtacatattatggcttctacctccagttcttactgctgcagcaatgccgccacggtgagctgcttgcttttcaccttatgctatggcctgttctgtggcatcattattatggtaatttagcctgtaatggatcctataggtcaagcttgtttaagatataccttgttgaaatagataagcaactcggtgaagctgcttccaaagaccggtatgttaccaacagctgagtctatgcaggctatgttacatttgcaaattgtgatatcagctcttatccttcatttcacagaaaat

SEQ ID NO: 39432 - DNA, 3120 bp, Oryza sativa
  unsure (1)..(3120): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccagaaattgccagttggttgtggggctgcaacttgatccacagaaaagaaatttttctagccacattaatagaaaggccacatgttctcaaggggtgaccgagccctggcccatgtatgctgctacatagcctaaccaacctcctatgcttttggtcttgaagtcatattggttctttgtgttcaaactcatagggttggccgatgaggtgacattcagacctgtgatcatactgatatctatgagggttggagtcatcggcccttgattgaacagaaaggcattggtagtgtttgaccagaagtaagaagcagctgccatcaggggttcatctttggctgagttcgctataataaggtcaagtgcttggccgattccaatttcatcccagtgaaccctcttgctggctgatacacgtttgaaccatgtggtccagctcttttctggtggaactttctctagagatggccaggatttgaaggtattcttccagtaacctagatctgggttggttaatctgaaggggatcctattggtttcaccaataatgaactcggtggggtctggattgccgactgggccaagaaagtagtgattttcatgcgacaggctgagaatcgcaactaggttggaaaggtactacaaatccaaagcaattcagagggagagagtgatatcagattggagaagatcgatttgctgctaaagaaggggatttagctgatgagaacttacctcagcgtattcggccgatggtgcaccaggtgggctggcggaagacgacattcgtgcgggcggagatctcgtcgggaaggaagtcgcctaggaatcgcctttgcgccagaggaatcgccggagaagagagagaaaaggtttcacttgagtggtgaaaacggaagtcacggcgtgagatttctcgggggtaacggttagtatttaaagcgctggaataacggtcaaacgcggtcgagtgcgaaacttgctcggagtcggcatacagcaaatccggaccattatcgaatatcctagacttgggggacatgtgttaacaaccaaatttggtaatatctatgtcaggaaagaggatctcatcaaagtggagtcggaggtggagatcgagttcggaagcagagcaggaatcggctggaatccagatcggctacggttaggatcggctggatctgagtcgggctaaataagccaatatagccgattccgacaatacaacttgtacgcgacatcgggttcaagttaatgtatttcaaggtgattgccacgcacggatagagtcctgggaaggcaattgtatctattaattaggatatcttatgtaaattccttatagataaatgtgggcaaaagtctgccgcaaagacttatagtatcttagagtttgttagagataatggtcgtatccggtatgggcatatcttgtaattctcaggaataaatagaccccgagccctatgtaattttttaacacacacgttcaatacaatctcggcgcatcgccacccttttttgctttagttttgtttcgacgaattcttcctttcgggttgagctgcatcgatttcgatcttcaacaagaggtaaaattcgttatgacggattgcgttcttaggattagtgcttccatctttatgatactctaatcttgtttatgtaattcgtcgagttatcatatgtcttacataatatctagcaatatcgccatctaatctactatcggccaatatctgtatgcagaagacagccgattaggttagatcttgacgttgatctagattatataagatatctaccattctatgaaacttctagcagcttgattgtctaagtatcgctcttcttttcatacttaatactgcatcagttgagtttgatctattaagtcgtgcttagaatatcgatctctagcctgccttctagttgccgattagaatagcattggagtttcagccaatcgtatctgatttaattatatttgttttatatgctttactgatatgttaaatctgccctttatatcaagatattgttgtatctaagtatgttaggcctttgtttgatatattatacctacttttatatcctgatatagagttgtatcggagtattagccgatacatgctagatctatctgatcggctacgctacaaacatatatagtcttgttattgatatatatttcgatctaggtgatttatactgtctcggtatggtgaccgatctatcccaatcacttgatttaagtatatatcgacataaggagtatatatcattaatatctacagccgatcaagtagatttagttcttcttcacttattcatgactgccgatcgatacacggatgacatcggcccaaagataaatgatatgtcattggcatctagccgatcggctatcatttatagatttaaccacggtttctttgcttctatttcttgttgattacaggatcaaatcaactggcacgctaatacatccgaaggcgagctttggacctgcactggagttaagcagatctcccaggccacgtgttttctgtcaacaatgacaaatgggtcccactaacttatagcttttctcatccatgctatatccctcctaccaaacaagaaattggatcgccatatccatacaaaccaaacaaaaaaaatggatcgccatatccaacaaaatatggatggccatatcccatccatgcatgaccgtgaaccaaacacaccctaagaggatgaagaagatgaggaggggctccacctcgtagatcgggatcgccaccgctcctctccccaccgtcgctggccgttagccggcaccctagagggaaatcgtgctcactgaatccctcctccgccacgcccagtcccttctctctgctggcgcccacc

SEQ ID NO: 39433 - DNA, 1971 bp, Oryza sativa
ttctcacttacatgtgggccctataatttttttattttgctgactaggatgccacgtcacagaaaccagagactcatgctgccatggaaccgaaattgcatggttttgtatagtttagaggtgaagatttctggtagtgggaattagggatgacacccaaactcgatgaaaagttgagggatggatggtgaacttattcccaaaatttttttttggaagctttcatgggtccagttgggcttgggcttgatctttggcaggcggcaaggccggcctagatgggagtaattattattatttctcatgttgtatattggcacatttagccacaattagcactatggtgcgtatgctcgaatttttttttagataatggaagcttttattgaactcagtcaattacatcaaggtgatacaattatcctgagaacacttccggcctctgcataactaagatgcacacagacgaacaaacaaaaccacactcgaaaagaaaaaagaatgacatggagtattgaggaccatcaatctaacgactaaatttccactcatgaacaactccttagccatctcctccaaaagcacagagttttaaggaccaccaattctaagactagattgccacccatatccctgggtaaaaaactccttgaccaccttctccaaatgttgacatgccgcaactaccatatcccgcgaaccaggcttgtgtaggatagcccatgtacgaagccaatggataagagaatatataacctgcaaaggtgaagatatgactttttttatcaaaaaccacaatattcctgcatagccaaagcgaccaacaagtagcagctgctcctaatagaacatgtgatttcaaattattatgaattccatcaagccagctcctgaacatatgcgctacacaatgtggtggagaaagtccagatgctgcttggatgatggaccaaacagaaagggcaaaacgacatttgaagaaaagatgtctaactgtctcgtcattgcaacaaaaacaacggttcttattgccttgccatttcctttttatcaaattgtccttcgttaacaccactccatggcgcaagtaccaaagaaaaatcttaacttttaggggtatctttaatttccaaagacggttattaatgttgggaacgttgctgtgaattagagctagataatgagacttcaccgagaactccccatttgaggttaagttccaatgaaactcatcttgctccttagttaaataaaaaccagtgatgcgcggtaataaattattccacgccgctagttttgatcctataaggtctcttcgccatgaaaaagatggaagattgttttcgaagacttgtgcaactgtagcgtgcttatgcctaactatgttgtaaaggcaaggatactgttctttcaaggttgaattgcccaaccatttgtcttcccaaaacctaatttaggagccatctttaattataaaggatccaaaacggagaaagtcccgtttcaccttcatgaggctagaccaaaagtgtgagtcccctgccttccattgagcttgagaaagaggtttatcaccaagatacttattacgcatcaactgttgccaaaccccttccgtggagagcaacttgaataaccacttactaagtagagccatattcttaatttccaaatcatgaattcctaatcccccttgttccttggggtggcacagtatgttccatttagcaagacgatacttttttttttaccatcactttgccagtaaaacctggagcgaaagtagtcaagctttgtaagtatccctcttggtatggtaaagaaggacatcatatacaacgggaggctacttagcaccgaattaatcaatgttagccgtcctccggtagataggagttttcctttccaactgcttagatgcttttcaaagcgttctacaacctccttccaatcggcatttcggggtgcagg

SEQ ID NO: 39434 - DNA, 18054 bp, Oryza sativa
aatgtccaacttcgtcattaacctttaccgctacacttcctccagaaatgaaagactcaacccaagagatccacttaggcgagaaacctttcatacgtagagtttgcaagaggaaaggccatttgactttatcataggctttttcgaaatctactttaaaaattaccccatttagttttttacgatgtaattcgtgtacagtttcatgaagaacgacaactccctctaggatattccgtcctctcataaaggctgtttgagaagagctcaccacatggtctgccacgaaattaattctatttgttgcgaccttggtgaaaattttgaaactgacattcaaaagacatattggcctgtactattgtatacagtttgcctcatgaacttttggaagaagtataattatcccaaaattgagactaaacaatggtaaatcacccatatggaaatcccggaatagattcatcaaatcaactttgatgacctcccaaaaattctggtagaactccgccgggaaaccatctggaccaggggctttgttgtgttccatttcaaacacagctccccggatctcatcctccgagaaaggtgccgttaggaattcattttcctcattcgttacctgcggaatatcctcaattctagattcatctagtgtgatggaagtatcctcaggtggcccaaaaagatttttatagaatttagtaatataggacttcaatgctatattaccttctattttccctttgtcctgatcgaggaaaaaaatacgttttttccttttcttaccattggcaaccatatggtaatacttggtgttgttgtcccctagtaggacgtcagtaacttttgccctttggtaccatttgatttcttcttctcgaaaaagtctggataactgatctctagattgagcaagatgctctctctcactatcagttaattctcgtacctcggctgtgatgtctaactcatcaatgatattttgtacggtatttttttcttgtttgtaagaaccactggtgtgagccgcccaaccccgaagatgtcttctcaaagcactcatcttattgttccatctttgaacagggttgcggcccttaactggcttattccagatttccacaacacggtcacgaaaatcatcccgaaggaaccagccaagttcaagtttgaactgtgcacggttccctgaaaaagctgatgatccagtgtctagtagcaatggtgtgtggtctgatagacctctgtctaatgcttggacagaaaccaaaggatatttggattcccattccgtagtcattagaactctgtctaatttctcatatgttggggatggtagagagttagcccaagtaaattgtcttcccgtcaaagcaattcctcttagatcaaagctgtcaataacagcattgaaaagaaaaggccatcggtcattgaatctgtcattgttcttttccaagctgctcctaagaatattaaagtcaccccctataagggtgggtagcggattttgttgacaggaacgaactaactccgctagaaaactagatttgaattcatcttgtgccggtccatagactgccattaaaatccatttgaatttgtcttccttattgaccaggtggaatttaacataaaattcgccttcgacaatcaaagacaaatcataggtagatgctttcaccccaagtataattccgccggatctgccgcgaggtgggagacaatgccaaacgaaatctacacccccagatagacggtttagattcgtctttgacatatcactcttacctgtttccataagtgcgacaaaatctaaattgtgctcctttatacattctgccacatatcggtatttagccaagtcaccgagacctctgctattccaaaatatgcctttcataataacacaattgtagagattatgtaaaggaacggtttctccgtctctttttcttatttgatttagattttctcgcggacaccatcaagtcgcaaattttgctactcatgtccacatcatctaaatccacctcagtgacatctttcactaagtgagcgagtaggctaccgtcaagttcggtatcctcgtcatcactagcatcaaaaggattgtctttctctaaagtttgattcttaaaaggttggtgagagccatttattttagatgctgctattgaacgatctagttcaatatgtttcaatttattaatggaaattgtaatgtcagagctagaagaacccaaagaaacacccacgttacttagatgagaagaaactctatcatctggtaaagacgtaattgaaaaaacatgtttactttgtgggggagaagctggtgtagtgtcagagctcgacggagaattaatcacagccaactccttcactggaccatctaggttgcaaatagcttttcgcctcattgccttactgagtgaatcctcatccgtcatcgcaattccgctgatctgttcagcattcgaacgaccacttcggcgaagaccattgcaatctccaggagaggataacaccggccattcttcatagtttccttgtgtcgtttgctgcgaactcagtggtgctgaaacagtgcccatgcgcaccttacttgtgctcccaaatggagcaacagtattgcctacactgcacttcttcactagtggcactgaaagatgaccatccatcaagcctggtgatgggttttgttgcttactaatcggatgtgccaccgggacaacatgttgctttctattagattgtatctctgttgctggtagcgtgcgcggcactgcctcgatctcctgcacctcagctgcgttcatacgcatattctctaggccaaccgatcggggagtagcaggtggtgagattcctgctggactgatctcctgtgaaacatcaggatgctgcagctgcagccctaccaagtccatcaccacaggccgacgagatggagacgacttgagaggtccaaaaggcgttaacgccaactgcattggcgttggaccagacccctgatcaggttgtgtagttgtggaagagttgcttttgtgtttctttacaatgtgatttgtattgttgtcttccttagaatcccctccctcttctgcaccttcatcaccaccacctgtgggctcatctaccacatgcacagccggctggaacccttcttcctcaagagagaaagtgatatgatatccaatcttgccgaagacgatatcagtcttaattggtagatccgcacggctaagaactcccactttgacccgaataatgcccttcttacgaaaggtcagcatatctacctcttgtgtggttccaactacagtgcccaaagcccagaaacaaagatagtgtcgccaagagtgcagcactccagtgatgtgcacccacacctcgtcgagctgatacaccggtataatatcggaatcttgctgccactgttggattgtgatagatacaccgtgattctttaacctgaattcaacatcatccatccggttgagttcctcctcagacgggaaagtcacaaggtatgaattgtcaccatgtggcacagcctcccaattccaatcggctcggatgaggcgtgccaactcattctgcacggcactagctgctaaatgaccaccgagaatggtcaccaaagccattggcgcaggtttcggcggcttcaacttcatatcaaactcctgtatcggcaagaaacccatgttctgttcactgaatccaaataaagcagcagtaggttttggttcctttagaataggacatctattcggcacatgtgcatctttcttgttacatataaaacagtcaaggacagttttgcagccatccaacaaatggccactacccttgcacctgaaacagtgaagtggacgaggtttcttggcttttgccgttgttacctccacactattcttggatgaaagggcagctgtttctcctcggccggcttgaatgtcttgttttacagtactttctattagggcttgatgaacagggacaccttgattgcctgcatcccttcgaggttgctcatcacggccatggccctggaaccctggccggaagtttcttccctatgggcgctgaccaaatcccggacgtccacctttgttgtttctgtaggaaggtaaagcaccatgtcctccttgatttggtggtgcatcccagcctccatgtgcaccccggctactttgatcacgatgatcaactcggccaccatgtgcaccccaaccgccttgctgcgtagaacggccttgctgcgcaacccggccgccgtggtgttcttgcaagttggttctattgatttgttgctggggaggatgatttgctagcggccgctgctggttgtggcgaggagggtcagtcgccgccatcgcagcgtaactagggcgagatggctatgttgatggaatgaaagagatggcagattgcgtcaacgatggtcgaagcaagtcatatctcgatctgccgtaaggacgcatgccgaccgggcccatcacacggcccacaaaagattgtttcgaattttgaaacaatcctagtgaaagcgcgtgatctgaggacgatccttgtaatgcgcaatctgaggaaaccattgtcgcttggtttgatgtcgccgccggcaggaaatcccccagtaccactaccgtcgccggacgtggacggggaagaggacctttccatggccgaatcagccatccacgtcgacgctgtatagcaggaccgaattcttttcctgatcgactgtaagacaccaaattccatccgccagcgttgtctttctcagcaagcttcggtgaaagagagcgaaagcgagagggaggctcgggttgtttttcccaccagcggttcgccggcgtcggaaaaccaacctcgctccagaactcctgtactagcgaagcttcatcagatcgagccggtcgtccatggcctccaccatcacttgttgcttgcctgtgaccaccattgtctctcccactctgcctagtttcgatgacagcctcatcggcaatctcatgcgaggtattaacaccatcgtcgtcgtccccatcccgattttcctgcaaaagacactcaaaacgagagccacgtaccacggaggaagaaactggagccaaggtgagacgccggcggcgatcactgtcgatcctcatctcaacgtcatctcctttggagccagtccacccagcgtcgtcgccgccactgccgctgccgccgtcgccaccgcaatgtgccgagttcttaaatgctggttggtaatagattagcacctatattcatacataatgccctcgtatgctcgaattggaagttttaaatttgcactgattgcctaagaattttacagtgtgattttttgaagagtttacagcgctgtaaaattccctcaattttctaaacttaaagttgtaaggtttctaaattatgcaagttagtgatatttgtgcaagcttaagtgactgacaagtaagaaaaaaattaggtgatcactgacaacaagtgaaacggaaaaaagaatttgtgtagtctgtaatctattgtacgaaatgttttatagtataattcagtttctcatttttaccattgagatagatgacctcgaggtgatgacgattttacctcattttatttctcaaattaatggagacttattgttggacctaatggccaatcggccatctcatttttcaaataaacaagatcatgcatttatcatgacacactagttgtttgtgcttaaaacaaattgtggttagatgttttcaaataaagcacataatattgtagctagatgagtccaattaacaaattgatgcaaactagcaagtagcaagaacgcttcgttcttaattagaacgagcgaacatactatatatatatatatatatatggggagcgtatcctatacacacaggcactcgcgtgtacacactgtgtacaccaactaaaaattatcacaaaaaattctatgaaaattcgtacatgtactttcaatagtattacatctacgtgcaaagtcgcatcttcaaattcattctacatagagaataacaaaaaagataaaattctgacaaaattgtaaccttaaaactgtcagattttttgttttttttgttacggctaaaatataatgaatttgacgttaagattttaaccctaggtgtaatacaattgaaagtatgtgtatgattttttctagattttttggtgatattttttagttggtgtgcacgtgtgtacacgtgagggcctgtgtgcataggatatgttgccatatatatgatcattaatttttgacgatctgtgggacctaatatcacagtagcaactttagctatgatttttggcaatttaattagggccacatataccaaccaaaaaccatcgtaccaagagatctgataacaatgggacacaagaggtctatccaactgtggcatcaacaggccaacagccatgcttcccataagtgaaaaatgtatgacgagtcgtgttccttccctgaacgctttcacaacacatttgcagacagtagcaatataaagaagattcaattatatacaaagtacctaataattgattcaatctacctatttttcttctttgccgctagtcatatggaccatgtatagtgtgttccccacttgtttgagctttgtcttataagccgcggccactgttgaactttaaaattactagctgaatgactgtgcttaatttgcttccgatagaaaatatattatagtggtccaaaataaataaaaaatatttctatgaaatatattacccgtcctcatgttgccatagggaatattcacctcaatttaattttttgtgtggttattcgtttatggttgtgttttaatattaagaaattcaaggaataatttgtaaaatttactatggaagtagatgaatggcacattcactttcaccaccaatatcttattttaaagtactacagaaattggagggtttttttcctactcttaattctcaactttggcctgtagaccattaaaaataagaatatgaaagtcactatctccatcagtaaatataagtatttctgacgctgtaaatctaaacgagtgtttgtcttgcttcagaaccatacacccttatatatatattttgaacgactcgcgccaaacagtgcgaagttcataatgatagagtagaaaaaaattacaaaattataaccatgtaaggtcgtaaccaggaaaacgaagaaaaaaattgctaccacccacacaccgacagctctgacacatgaacccaggagaaggctaacaccagaccagccgccatttctccccctaggccctccgacatggtcattttgtataagctagggcgccaacacaagagaaccaagatctagagcgagcttgcaccagttgtttgggaggtttcggccaggggttgcctagacaacgtctccagggagaggagcgacagaaacaccgccgcggccgtccgtcatggagactgcgctttcacccgacaaactccttagaggcgatgggacgacatgacaatgccctcaagagggaatgtgacgcaaacgccgtcgttgtcggctcggccaaaaccgggctaggttttcacccatcgtctgccgcctgcctatccaccattgatgctacattgctccttccctgtcaaacctccgtcagtgcgtgggtactgctgtaccggcacccaccgtcggctagcctcaccagctacgccacccgctctagtgtaccgttgccgctgatgctacctgccgtcaactgcaccacacctccatgccgccggtcattcctccacggcggcctccaggccggcctcacctccacgcgtgctaggtgcgcctccacgccagccacgacctcgcaccgttgtcggctgcacctccatgcaccgtggcggcctccgtcaccgacggccaaacctccttgctccgtcctccatcgccagccgccgcgcctcctcagcctacccgtgctacgccagtgccacctcacgccaactgctcgtactgggcggcaatcggccctggccgaggacctgatccggcggcgcccaccgtagtcgccgccgaccctactacgaccccgtcacttccacccctacctccaccatctccgcctctagatctggcagcacccgccgcggatttggcatcgtcgtcgccaccgccacccccccatgcagttcgcacctcgccgctatcttctcccttccccgcctccaccttcgtttgtcgccgtcatccgcgcgccggcatcccgcctcaatgccgacgtctttccggccgacctccaccttggattcgcccacgccggatctatggtggtcgccaccgcgagccccaccgtcgtcatcctcgtaggccgccagctttaagcaccgactttacggccactcgctcaagtggcacaaggtaggggagaggttggggaaggtaggctgtggcggctaaggtttccgcctgagtcacctgtgccatcacagagactgggctttcacccgacaaactccttagaggcgatgggacgacacgacaatgccctcaagagggaatgtgacgcaaacgccatagttgtcggcctggccaaaacctggctaggttttcacccatcgtccgccgcctgcctatccaccactgatgctacattgctccttccctatcaaacctccgtcggcgcgtgggtattgctgcaccggcgcccactgtcggccagcctcaccaacctccctatcgtcaccagccactgtcgcgtcagctttcctcgccatcggttgggccggcctccctgtcgtcgcccataccgaacctcctgacgccacccgctctggtgtaccgttgccactgtcgctacccactctcagttgcaccacgcctccatgccaccggtcattcctccacagcggcctccaggccggcctcacctccacgcgcgccaggtgcgcctccacgccagccacgacctcgcaccgttgtcggctgcacctccatgcgccatggctgcctgtcgccgacggccgaacctccttgctccatcctccaccgccagccgtggcgcctcctcagcctacccgcgctacgccagcgccacctcaagccccactgctaggcggctgccggctctagccgaggaccagatccggcggcacataccgcagtcgccgccgtccctactgcgaccccgccgcttcctcccttacctccaccttcgccgcctctagatctggcggcacccaccacggatttggcctcgctgtcatcgcagccaccccccccccccacgttgtttgcacctcgcggctatcttctcccttccccgcgtccactttcgtttgtcgccgtcgtccgcgcgccggcatcccgcctcaatgccgacgtctttccagcctccaccttcatctgtggtggtcgctgtcgctgtcctcgcaggccgtcggctttgagcgccgactttgcggccactcactcaagcggcgcgaggtaggggagaggttagggaaggtaggcggcggcggctagagtttccacccgagtcacatgtgtgggaggcgacacgacagctaagggtatgcagtccactccactctagtagcccatacacccttatatatatttttagagaaggatattttttacccagcctctatatccaaccggatatatgcagccttttaattgggaacttagccccataaataacccaatctaaaatttgtttctatggagatttgaactcgggatcttaagatgctacctaggtcactacaacaattaggatacatgctttttcgcatacactcttatattttggaacggggatatatagtaatatcgtgtcttttattttgttgcacatacatatacaggttatgagtgtaaaaaagaacctagggctgaaactttttcttcaaacttccaacttttctatcatatcaaaactttcctacataaacaaacttccaactttttcgtcacatcattctaattttaatcaaactttcaattttaacgtgaactaaacacaaccttggccggcaatatttcctgtatggcctatatgtagccaagtgcagtccatgtcaatcatcaggtcacatccaaattaaaaaaacatacaattagtagttagcagcaaaaaaaagagaggctaatgtgatgagatgtcagagtcctagctcacatttgtatattcttaggcgaccctttgcattctccaacagctatcaattattggctcaaaaccttaattagcttccctccaggtagctaagcttaccatgttttcttccccttgttgttaattactctcgtaataatcgatgtgatggttggatcagaggatgagatcaatcgagtagtactaagcttgtactattaattaagtttgtacataatggatcttcccacatggggtaatattaagcttgtactactatagttttacttggactttacgggttaattaattatagtttgtttcatacttacatcatgtgtgatgatgaatcgctgtgttaattaatgttgctttcagcttaagcttagctcattagggaagggagacatgaatagtcaaatatatatggagctctcaacgtgccgcacggaagctacacaatacatatacagatagggtcaaacatagagaaatttgatagttcgacactttcttcggtatcaatttattttgattggcacttataaaaataacatagtgtactatcagaaatatcaaacatagcttaatttattttgattgacgagagtaaatgaaagtggatcagaaatatcaaataatcgaaacccactttaaaaaagaaccaaattatcaaacctctcgtcaaacgtatggccctgctagaagccactgcacgaagttatatcactatcgtgatatcatctaattactatttctctctattttaaaatatacgagtcatgctcaaaatatatttaataataacatattttcggttgggtggtattttgatgctacaggtttttggaatagacacttcataacgagatttatgacttttgctcaatgcatatcgcaactgcaccgtatacgcatcaattttcttcagctagcaacgtacatgatgacttctagtgacagtacgtaacatttccatccgattcccattgtttgttctgttttcagcctctctgaatcccaaatctgcaagtttttgcccctctttagtaacgttaatctatagctattgtcctcgttcttttttttaatttcttgtggtttagaccaagcttacaattctgttctggttccaaacggagtgacaccattttaaatagactcttccgtttttaaacatacgacgtcattggcttttggtatgatatttgatcattcaacttatttaaagaatttaaataattgttatttattttttgtgacatattttatttttaaattaacaattggtcaaactttaatccaaaagttaacggcattatttattaaaaaacgaagatggtactccctccgtcaaaaaaaaaaacctaacctcgtactaggataagatagatgtgtctcatcttagtgtccagattcgttgtattaggatgtgtctcgtcctagtacgatgttagttttttttagacggagggagtatgtactattccatcaagcaacgtctagttcgacccataatataagagagtaattccagtaatgaccgaccgtgttcatccagtctagccattcctagggatgggcatgcaagagacagcacatgagtgatctttggtccattccagtctaaccaaataaactaaatttcattttctttaattatctgcaagccgatccaagcacaactctagccattccacccattttttttgtaatggcctaaaatttgagtaatcatttgttgagttaggctttaagcacaatctaataatcctgtcacctaaacttgctttaaattgtgagagatacaactcaaacttagatttattacaatatctattatatactaaaagtccattaaactttctacaaacgctcctaagccgccacatggcgctcctacaaatactcctaggctgccacatggcactatctaatctcaccgtcgattttcatttaaattggtgtacctgttaatttagaccattagattagatctattattaaaaaggtgatagttttttctaaaaaatatgcaactggtggctgtgaaaaggaaagaaaactaaatattcgtacgcaagtataattgaaaaaagaacaaataaagcttcctactgttaggcggaagaaaaaaaaaacatctgtgtacgacaaaaaatgataaagccaaaaaaaatgtgtagttagtaccggtggaaaaaacgacggtctaaaataggattttgtataatataaaatataattacataatatacggaagtatatgatctatgatataaatatcaaatatcaaatcaacggtctctaaacattatcttttaaattatttttcgtttaattatatatagtatcggtgtataaaagtaatgttgtggtcctaaatacatcatgacacatcgggtcgacatataataggtaacgttagagacctattaaacgtgctacaaacgcttctaaatagtcgtgtggcactcctacgaatacttctacgccaccacgtggtgttctagtaaattagagaaaaccttgtaaattatgagaaaaaaaacatccaatcatttttattggttgacccactatttttaaactactagattagatttatttataattcatcccacgtaacctgctcgaataaaaaaatcacgtgaatagttgcacgtatatatacatacttccatactttgctactcactgaaaaaaaaaagaaaaaaactggggttgaaaaaaaataaggtttagccctgccacagtcccacctaattgttacgagtgacacgtacatatgtactgttcacccaaaaaagtgaaaaaaaaatctcaaatgtacaatacgtactactgttcactggattgagaaaaaaattcgcccgagtttgtacaaactacgcgctgtccttcactccttgaatctttatacataaaatcaatattcacccatcctctaataaacttatctaaataataaatagatgtatatgggaaaatattatgattacatttggtattaagtatattttaatttaaaaattatcacattgaagcatatttagagctttgtccattaaatatcatgtaaacgctattaagccaccacttagtacatctacaaatgctcctacaccatcacgtggcattttaataaattagaaaaatcacaaaaattacgagaataaacaaaacatccagttgtcgattttcattaatatacggtggacctattgtgtgtacgtacctctccacctattttctttatctcctattttccagtttctgttagatggaaaaaatattttaggataaaaaaattttagacaattatattatctaaatcatatagctaactttttattagtgcacaccattagattatttactataaaacataaaattgaagatccaagttaactatattattaaaaaaatcattactctgggtcatatatattataataattattgtttttcactgatccatacatttttaagaaaaaatatatagatttttaaaccttatgattaataacatacacttaaattagaacaattttaaacaatttaagttgtttaattaaaaagtacaacacacaaagtattttctaatagatctaagattatatgtgtttataaaactaggacccattcaatctatgttaaaaacaataatctcctcctatcctcataccttacgtatacctcggactgacccatcatctcctctccaattcaattatctcctcttcttttttttaactaacataatataactattgttttatttataattaaataaataaatcaagataacattagctatatttactataaaaagttaaaatacatcatttgatggtagaccctatcatttgaatggcaactaaataacagccaataattaatcgaacatatgtattatgttatactaaatcactataggtaacaaaaatcaattaaagcccactagagcgctaataaatcaccatataatatgtcctaaaattttaagaaaaaggcaaaatttgatacagaacacccaaaaaacgtgtaattggctgggagacaccgtaaaaacgtgacatggctgatggacactacaaaaattatgtaattggctataggacactggaggaaatattttataatttccgagtcaaaataggtgagaaattttagcttattttgattcaaactctgtttttttttctttgggcatcgtatgggatgtaattgcacgtatgtggatggagggtgccgcttggtcggattgacggacaaaaaattattgtgacaattggaaagttactaatttttaagtagttaagatatggataaatgtgaatttttccatatttatctctaatttttttgacacagggagtaaccaacagcctttttcccacgaaaagaaacaaaaagaacataacgaacactgactgcgaatcaccgagcgacacgtggctggacgtacgaggtgctagattaaattaattcaattaaattgacgtctccattatttttaactattagatctattttttttgaaaaaaaatcttaagttaccatggggcacgtcctataaaaaaagggataaacattggaaattcttaaaaaaaatgaaacatcccgtcgtaggctttcacttaagtcatttagaaaaattagaaaaattggaaaaacaaaatctccacctcctcctcactctcatatctacgcaacaatgtcgtcccctccctattattttatctattaaattaaaagagaaacaataaataatgtttgatatttttttaaaacaaagtacaaatgcgggcgctcacaacacgcacactcacctctatgaactcatacatacacatacccctatgagtacttcttagagactaggctggcatattttgagattgacgaagtcactatgtacttctcgttgtcgatgtgtatgttatctactactgaaagaatttgtccaagtctaggacatgaacccgagtgggcaaattccatcacaatgaacctaactagttgagctacgttcacttcacaataatgttggatattaaaataaccataatttttaagctacatttctggattactccaatgccctttaaaccggtggaatcattatttttgacagttagatctatcttatataagaaaaaacagatgtgtatacatggtacatcacatttaaaaaatattattatgcatggaacttctggcccactctatatgaaatattcatagatggatcggctctcaaattacatcaatcatattaggctatataaaccaatatatttagtggagcttcacgtcccacccaattaattctcgaataaaccatgataatatatatgcaattaaaaaaagaaaaataccttagttttactttacacttacttttcattgacatgttttcttaagaaaataagtctaccttctttgcaaatgatgaagaagattataaataattgcttatagatattacttaaatatgatataatataaagctaataggttagaaaattataaaggaaattaatgtcgacgaaaacaatttatggagtaatcatggtagatgttcaccggttaatatttcgctcttataactgtctcaatcttagcgtacaaggcatgcccgcgtattcgcgcgggctaccttcctagttgtatataaaattaaaaatatgaactattgttcttttgataatgtaattatcaatttagccttgcttttcaaatatgaagcggacatctgaacctggaatagttaaaattgttaaagttagcaccaaaatatcgtttatgcccatgcttatttcccatgctttctaaaaggttgttttttttttcagttttgtgatgtatacataactttgtgattgaaattttgaaatatctgtggaaaatttaacttagatttgaaaaattgtaattgaactttaacacatttgtcacaatatgtcaaattaagtcaaatatgtcacagatctgtcaaaattttcatcacacatttttataagtgcacaaaattaggccaaataaacaagacatttttgaaattagggcataaaggatattttggccctaagtttgaagtcagacaataactttatttatttatagcagggtcgaataaaccaagtttaagaaaagtccaaaagcttaattatccgtaaaaatacatattgaaaaaatatatattgttttgttaatgcaacggtatctatcggtatcaaaacgttccattccaagaggtataccggaatggaattaacaagctttttaattttgacatcagcacgatctgtaatgcatttttatctctgttttctaacaaaccgatttataaagcacttttaaaatataactatataccatgtttttcatgataaatctatgtcttatttattttgtacaataaatcgtagtactaacttttgtatgtaataacgatttatttttttgtgattcggttgcacgcacgccgttggactaaatctatatttagaggaaaaggtctgtatgtatgtatgtatgtatatatatgtatatatatgtatatatatatgtatatatatatatatatatatatacatatatataattcccatatgggactccatggtgtccgggctccaaagtataaaacacacaaattctctcaaatttttaaaaatgtttaaattgtgagtatatacctaggaatatgaatttgattcatccaaatacctaacaacaaaacaactcaaactcaactttatttcacaattcattattacatacctaactaattatatgtttggatgttatatatctagaaccaaaatctaacaaaaaaaaataagttcaaacttgttagtaaagaagttaatgttcatatctaaacatttaaaaaaatttcatactcattcaaattgggtatatactcaatttgaatcatggagcccatactccatgtagcaccaatcacacggtggcgctgcgtagcgccacacataaacaccgtgcgctacgaaacttcatagcgcaagtcacgacttcccccactcccggtttttctgttccatcgctcctccctggcgtccccgctcccacccccacgttccaacgtcggtaaaaaaattgctcacccagatttatcgatttttctctccgaaatttctgttagatacgcacagttgttttcaatctcagattttttttcgttcgatacacctgctggttcccactaagagcgagtaaaaaaatcactttgcttctcatgccacatgtatccggtcacgagtaaaaaaatcactgcccgattagattaggtcccgttaaaaagatttaactttttaactttttgaacagcgtccacacgatatcatattgagtagttaaaaagttactagctcctgttcaatatgcattgatcggccagtaaaaaaaattgctttcatgcttccgaatgcatccatctctctcgtttcctgtactttccactttattgggttctcccgtagatttgttaagtgaaaaaattactccatgttctctgtccactttatcagagttccatccaacagatttgtcgagtaaaaaattattgtaccggttatttcgacatggttagggaaaattatttagtgcaaactacatacatagtaaaaacttgtaaactaccgttggatctaaaaatggacgtccgagatgtgtacatgtcaacgtaagtaaaaaattttacttctagtaaaatttttactcatcagtgaatatgcgagtagattttactcccagtaaaatttttactcatgagtgaatatgcgagtaaaacttttactcgtgatgatgttgacgaacatctatttttcgaccc

SEQ ID NO: 39435 - DNA, 55163 bp, Oryza sativa
  unsure (1)..(55163): unsure at all n locations
tcatcccagtggcgctgcgaccaccaagggagttgcttggaaggagggtagaaggcccagcgggcggcagcggcgcatggtggatgttttttgccgtcgtagcccgtcgatgacacttgcttgtgtcggcagtgccaccgcctcctcttgttgctgctgtccctcccgtcgtcatcttccatagtgatggcggtggtgaggaagcggccatggatgcgacgccatcaggcctggcctgccactgcaatggaagacgatgggagaaaggatgatgctgcggctgctcctggtcgtgacagccatcggtggccacagatcagatggcgtccatgccaacgaccaccacgccaccactgctccaccccaacaggtcgcgcagtcaccggccaccgcttgggatggcctcgcccgcatggctgccaccgccgcactgtcgccagatcagcgtaaatcgtggtagcctccttggtactgtaaaaaatacaaaaagaaaataaaaaagaaacagaaaaacaaaatctcactcccgaggagaagaccatcggcaccaccgcactgacgagtccatgccgtcagagacgtcgccgccaacgctcctccactggctaggaagaacagggcgtcaatcccccatgatccgcctcgatagttgagggatattaggatctcctctcatatgtctcatcgtcgatccgaaaaatcaggatcgtatgagaaattaaagaatgagaatggtgggtacaggcgtacagtagtatcgacacctaatataaatagacatgcatgagtaaaaaaattacttgcaaaaacataatgaaacagaagaaaaataataataacaaaaaaaattaaggtatgagaaaaaaagtttcctttagttaataaataactcattatgctaagtcacgtttattatagttgttgaatcatacatagttaaaaattaactgattaaacgtggatatatatggtgggctatgtagtagtaaaaatttaactcgtgaattaaagtgggtggagttaggaggggagtggggtggtgggcagtgggtgggtctggttactgtgagtgccgtttaatacgtagcaccttaagatatatatatatatatatatatatatatatataaaataatgatgatgaagacagtaggactacctttgtccaaaaataacgcaattttacaacgtttatgttcaacgtttgatcgtccgtcttatttgaaaattttgtatgattagtattttttattagatgataaaacatgaataatactttatgcataactaatttttttattttttttaaataagatgaactgtcaaatgttgaacacgaaaactcacaactgcacttaaattaggaggcatgtagtacatatatatgcatatataaatcagttcctacgtgcaacgggcgcaaaatatcccggggtcacagatccgtttccttgtttgtgtaacaagtgtttggtacttcctgcccattactgcacgctggtggtggacagtagcagcacaggagaagacagccatggggatggggcggccaatgggaaactacaccggtggatattttgccgacaggaaatgctgcacgcactaaccaatgttgctcacaaagtttttttttaaaatttttaatttctccctcgcatcatgtggtccctgcagatacatcatgtcataaaagtttttcttaacagtgaagtattattattattattgtttgctcctttgatatttatacttgattatgaaatcaagtttattgtattatgtagaatatgcagtgccatgcttgggtgtctctctcgtccagaagctgagttagacttcattttttttaaaagattgtacattaatttaaccacaacctacaaaagtgcttgtcttgtgcatataaaaacatgtatgttatattatttttttgcgaggaatattatggaatggtggaatatatttatctccttttaaagaagcaccttgtttctatatttcatatccatacctttaaaaacatcacgttgtattttgctccatcgtttgcccgttagcttatgagtcaaagcaaaatttgaatttttagacttaattctagagttaattttgaggcatttttttattatagtttagttttcagcattggtttttaaaattgccaagagcacatatatacaaattttatacataaatcaatttttgttgcttcattctattttacaacttaatggcagagcaaacgatgaaaataatttatatcgtgtgctctagaaatgttgttttcactatatcatggatcagtttaggtagacgtgtagatatccttactccgtaataaaacgagccaacaatgctagcttagagccgttaattattgttacaagtaaatgcaaccttaatctatatatgcttatctgacttcaaaagaagtactccaaccatgtaaccaaaatccaaccgtgttataagtcgatttaattattctctagctacttactaaagtttgatatactcttatatagagaaaattagcaacatctacaatacaaaattagttttattctaacattcaatacattttgataatacgttttaaacattagtatataattctaaaaaataaattaaagcaatgtcgagtggaaaatacaacttttatcactgtgatgcaatcctatatacgactacctttatatactactctattcatttcaggttacaagacgtttttactttggtcaaaatcaaactctttcaagtttaactaaatttatagatacatatagtaatatttataatactaaattagtttgattcaatcaataattgaatatatattcataataaatttgtcttgagttgaaaatgttattatttttttacaaacttggttaaacctgaagcagtttaactttgataaaagtaaaaacgtcttataatctagattagagggactagcaccagtagtcggcaaacacattgcaactatttgaccagagtcaagtcaaacaaagcatagcacactcctccttaatacaccctacatacacaaaaccatactactactactagtaggagtctccccgttctgaaaaaagaaaaagaaaaaaaaaacctccatctcccgcccagtgccgccgcgccacgtcacccctcccccgccgcgcgtgtgtgtacgcgtagcctttccggcggagacgcagcacaaaaatggttttacttgcgatacccttcgtctccctcacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctgctcggcgggagccccgacgaggacgggtgctcctcgcctgtcatgacgcgccagctcttcccttcgccgtctgcggtggtggcgctggcgggggacgggtcgtcgactccaccgctgacgatgccgatgccggcggcggctggggaggggccgtggccgcgccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctggttagcttcgccttgctcgatttccctcacgctgacttcctctgcttgactctgcttgattggagtagtaatctcttcgtttgtctcgtccaattttggcagggactgcgggaagcaggtgtacctgggtgagctcctatttctagtctcccaagctaaattcgctcgcatgactgctaaatttgggtctctacttagcttgattccgatttgtttgctcctgccttgttttttttttctgttttcaggtggtttcgatacagctcatgccgcagcgaggttactataaatggtcaccaattgtatcttaattgttgctctggtttgccctgtgtgctgagattgtagaaccccttgtgcagggcctatgatcgcgcggcgatcaagttcagaggcctcgacgcggatatcaactttaatctgaatgactatgaggacgacttgaagcaggttgtttggaatatagttcaattgtcatgtgtgattctttaggttctaaggggaggttcattcaccggcctgtgatggtttatgatggattggttcgtgctgtgttgttagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtaagatccctgaaacattgattgttcttgctagtaacttacaatacaatacattttagattagttcaggaccatttttcatgccatgaacgaaaactgtgtcaagtttgcttttcaaaaagggaaagaaaaaaaatgtgtcactaccaagctggagaatggtaggctacccctggagtccacatccacctgaagatttgatgttgactcttcacacactagccatttactattggaacaccacaggtgttcaatgattatagattgctagcttctttaggaaagaactaagtgaatcggaatggctcctcggaattaattgaggggaaatgtttttgtttccttggggattgtgttttgcatcctaagtcagtgataggtgaaaagcttcatttcaatgctcttggttgtttttgccactaagaatgttctgcttatttacgttgaatttttgattggctgttcgtatcatagttgtgcatttcctatatattacaatctttgtgaactttagataattctggcatgagctctctctgtggtattgttctattaacagaagtatcattctgtcaattccccactgataagtgatcttttgtgcaggtacatctatctaggattgtttgacagtgaaattgaggctgcaaggttcagttagtagtactttgctcttctcagtttgatatgtgcttgctattcctatacttctctcactttcatctactcttcaacttgtagagcatatgaccgggcagctatccgcttcaatggaagggaagctgttactaattttgatcctagttcttatgatggagatgttctacctgaaaccgacaatgaaggtatttcttttgtactatgtatattgtgctttatccactagaacgacaaatccaaattttatattaacaaaagcacactggggattgtcttagcagtggttgatggagacatcattgacttaaatctgagaatttcacagcctaacgttcatgagctgaaaagtgatggtaccctaactgggttccagttgaattgtgattctcctgaagcttcaagttctgttgttactcaggtaaatatgctacaatatttggtgtttgtaaccgctataccatttgagatttgaccgtcttcagattcttttgatcaggtggttagtcctttttcataacattatactatcactttcaaaataattagtacactaattgtatgtgtcactagaattgttgtatgaaaccatctgggaaccatcttatgcagcttattgacaaatgacaactcactgttgatgtattcccaaatcaagaaaagccaatctttttattcaatttctccagttcattgaattgaaaaagaaattgccgaacaactaccacctgaagagactggctagatattttgtttatctgtgtatttttataacctataacagttccaaagccacaaagctcttttaccttgattctgataacgttaactgaggtatcattttgtgattgttttctgtagccaataagtcctcagtggcctgtgcttcctcagggcacatcgatgtcccagcatccacatttatatgcatctccttgtccgggcttctttgtgaacctcagggtatatctatcatcaaaacttatatgcaatttgaaaagacagttaaacttgtttcaagttaacattcgattgctaattagctactacttccatgctcctatttcttgagatgacgaaccatatgtttgttcctttaattacataatggtagccgtagatactgtttgccttgtgaactgtcagatatagcaggaagtaaatctgtcagcttgcaactttccatgaaccacagctgtccaactttatacagtggatgatgacttgcatttgatacatcctagtactttcttgttgcactctgcagctttagctctgaagatgctctatatttccatgaatgctcacgttagctctgaaatttcgaactttcactccataacatgctcacttaggctgtgtttagatccaaacttcagttcttttccatcacatcaacctgtcatacacacacaacttttcagtcacatcatctctaatttcaaccaaaatccaaactttgccatcaactaaacacagccttattcattgttccaccttttatttctgccattgctaaggtccaatcttgatacctcagagagctgcatgatgtgtagatagtcctaacttaggtccgttggttagaatcatccattcatgtttaggaaaagtgattaacaacgtgtgctgcattaaccattaatgtggtcaactctgatgcttgtgctatggtcactgcaggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccgtgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccctattgtgccttgtctctttcacctcctccctcacttgtgctgcctctggccactagagtggcgccctgcactgttgccatgcatggctgccacttcgagagtggagatgggggttggcctttgggtgatttctgtgtgccatcttttggctcaatgtcgttttgggactggtgcatgtactggcaataggtgagatgagatatgaaatgtcctctgctgctttttctatctaaggagtagcttagctatcaccagctgcctttctcttctcaaataaggttgttaaaagggggggtcttaaagctaccccaactgctgccaggggccctcttcaatgccctcccagctgccgtttctttctttattggtttgcttctctgctgcttcttttgcctggttggatggatgtttgtttgttcgtatgaattgggggagctactagtatcattcatgagtagaggcaggcagggcagagcaggctgctggctggccaggcactgatgtgccaacagctatttccagtgaaacggctgccatttttctttgctgggattgtgatagtggtaggctggtagtactagctagcagtgtattgggggaaatactggtggtccatttgcctgttagccaatctgatgcttgcctttccatccgctggtgatggtccatttgctttggcatcttgcttgcctgttagtactacaaaagttgcatacatatgctattgaggttagggtgtgtttagttcacgcaaaaattggaagtttggttgaaattggcgatgtgatggaaaagtttgaagtttatatgtgtaggaaaggtttgatgtgatggaaaagttggaagtttgaaaaaaaatgtttggaactaaacacggtgttagagttgatctgagtacctgacaacttcatggcaaatgctctttacaatgacatcaacagactttagttttgcagcagttcttctctgtatctgtgtttcaatgcatgggtttggattgtgaataacagtattatatttgcctgcccttccttttttggtttaaaaagaaaggcattgtctatggtggcaaggcttttgatgaatagactatgcatcctttctttggtacactttgttagaatagtatgtggaatattagatggaccaaatctatcaaacataataatagtacaattaggatgtttggtagagatttgagatatccttttttttgggagagtttgggtgtggttgatttaactcccatagttaaattaattaactaatacaaagaaatatactgaaaggaaaatttccaaggtaggagtttttgctaaatttccttcaaattctctacaggattgttcatttcatatgaattccaagagataggataggattcaatcctttgttttaaagatcttcataggtaattttcatataggattaaaaccctccaaaattcctttgtttttcctctaaatcaaaggaaccctaaaacacatgaatatgagatgttttgtttggatgcttcaaatgaaaaatacatagaaaagacatataggaatttggtagattcatttgagagtagatagatggagaagagttgcattggacctttcaaaaagtgaaagaatgaagtttgagcaattgagctcatcgtttaagtttcccaaggaagtggggcataggaactcaatccacaggggcatatgtataggaaattttcttagggattgtaatccatgctttctaggaaaatcatactgttcaaaggagccattaatttagtataaacaaatggaaacaaagtcacttgagctatttacttgtgcaaaaatttaaaattgcaaagagtatatctctactatattaaaagtagggtcatcctctttccatccccttctcccaccgtgcgcagcgcgcccacgtgcatcatataagtaatgacctgatctaagttttaccctacaatcacacttatagtttatccttccttatacatgtctgattcgttataacataggggtatgttactagtattcaataaattagggctatgtttagctcctaaaattggggagaagtttgagaaaaattggtagtttggaaaaaaaagttgggagtttatgtgagtaggaaagttttggatgtgatgtgatatgatggaaatttgagagtttggggaaagtttagtgtgaactaaacaggactaggagtacatagtcgatcatcatcctctctctttcccttaaaccccaaagaaccctaacgatggatgtcctctctctttcccttaaggacataggaactgctcatctttaggaggatgtttttggagtcattgcctactgccaaggacagcaaggcgccagcgccacttttacttccctcccagatgacagctgaacctctcctatcatctttagttgcttagagcataaacaatgccacttctagagtgatggccagatggactaagggcacacatttaggatgggcctttcctcacaatgcaaagtgacagtaggggtggctttaaaattttcaagacaacatgtgacactatctatttaagcccacatattttttttaatttacgtggaagtctaaaattttacactaccagccaaatactcgtgtgtgcaacggattatccaaaataggaaaaaaaataagttctcttggttaaaaaacaatgttttatgtttacttggtttaaacaagatttttcatcttaaaaagaaaaaaaagctagctggtcttgaagaagtaggttggtacactgacctaatatagtgtaaatcatagttccacctgtcagcaatggcgttggtgacaaactcatcaccaccactagagtgtttttgaagtagtataagaaacacgatagaatccatattcaaatacactgctaaaagaagaattttgctgaaggccaaaataggttttcgctggcggccagcattgccgccagcaacctaaggccagtgaaaacaatgcatgttcactagccgtcggctagtcgcgagcgaaaaccgagtttcgttggggcaagcgaaagagatccaccagtgagaatgttttttagagaaaaaaaatgaaaatgtagggggggggaataggtcggcggcctggtgtggccatcactgagccctcttcggaacccttattgtcgttaccggatctactaccgccacccttcccttcggtgccgtaaaagtggacccggcgatcccgagcaacctccttcaacgatgtcgtccctcatcttcaccgccgtggaagttgacctggcgaccccgaacaccgccgctaccagacccacctccttcaccaccaccatccctctcttttgccgccgtggaggcgaatccagtggtcttgagcaccgccactgctagatccattctcttcatcgttgccactggtctccttcacactgtggaggaggatctgctgaggggaagccatagctgagacgaagtcatcatcgtcgaatccatgcccccgtgacctaccgccaccactgctgttggatctatacatagccggccccgctcctccggtcagatctgggagatggaggggagggcaaggtcactaccgccactccctcggctgcgtggcctccccatcatcgatgccacgcgctagaactagacttagcagccatcgagcttctccgtggcttagcaaaccggcgtcaccttggacaagaactcaacaccaagattgcgggcgctgagacgttatagctcagcgctaatctcgatggcgatgaactataggtttatttttgttattagtttttgccacagttcattcttcaaagaaattttttgaaagtgtcattttgtcaaaatttcagcccctcccctgcagatgatgggcccatttgtcgtcgccaaatctccgtttctcatactgtaaggatgagcacgcagcggcacaaatcagatgagggcaagctcgcaatagtcgatcaagacgtgtagtcaagctctttgtcagggcaaatctacttagagcaatggcctcaacaatagatctgctcgaggcggtggtatctatggaggatctgcccggacaatcagatgactcaccacctcatcacattgtttatgcccctatcttcttttctccgccaatcatagttagaggcaaacaggagccaaggctattggtctagttgctctccaaaagttcagtggatacgtatagagagcacaaataataggaaaaggaaaacgagagaagatagagaagagaaaagaaaagaatgcaatttgtacctgtatctcgcttaggctgggggcactttgggtccccgtaactgcccctatagatcaatctctccctgtctttctctcgatagatcacagtcatctctgccagtgtgtgtgtgtagctcggctccttttggagaacagtggtaggtcctgtgaatggcgagaccggctttcatcactcgagtactagctagctaccccccctatctagcgtcgcatcggctgaccagtgaccaggacgccgtacgccttgctcttgcaggggtttggggtttgggttcccctttctctttgagcagaggcagagtcagactgtctcagagactcagagtctctcagacccagagagagagaggtggtactgtcctactgtacagtattcatgtgagtgatggagaggggggttgcagctgtggcgacatgccggcattggtacgacaggatactgtttctttggttccctgatgcgtgttttgctacgcgcattcttcctctcttccataagaaaacaaacgaattatagatagatttgtagtattaaaatatgtcatatcgtatactaagattcttttatggtactatagatggagtataggaaaatgtgcattatttccctaatgattgttgagatatttttgcttgatatgtgtagttgttacttctttccttaataaatattacctctattctaaaataagtgtagttgtggaaatccgtcttatttaaaaaaattataatttttttaaaaaatagttacacataaagaattatgtatgttttatcatctaataacaataaaaatactaattataaatatttttaaataagacgaacggttatacgctaaacatgagcagtacaaaactgcacttatattattttgggacggacggaatagtaatctagtactccatccgtctccaaataaattttggttggatgggacatattctgattagtattacttagatgtgtcccatccaaccaaaactttttatattttgggccagagagagtacttgattagagcatcaacaattcttattgccaaaccatgcaacaagtgtggattccttgtgagataaagcaactagtaggaagacctcacaatgtgtgtatgtaagttattttttttaaaaaatgtgtgtatgtaagtgagggaaataaagtgggatccacattcaaccaatctatcataagctttggtgtgatttaaaaaagtgagatgggacccgtcacaacatattttatttccttactaccaataataaggctatgcactggtagtaattatttactgctctcataatgtttgttacttgataacaagcacatattccgttcatcccaaaatataagagattttaggtggatgtgacacattctagtactataaatccggacaagagcctgttcagatttatagtactagtatctgtcacatcacccaaaatcacttatattttgggatagagggaatatttaacacttactacatgttctaaccagggttggaaatttggggatacgatattaattcggatgaatattttgaaattttcaattttttcatgaatttgggtaatatttgttcaaattcaactaaattttgttcaaaattttggaaattttggactgaaattttcgaaatttcaggatttcggtgacccccgatcaaaaaccctaaaccgatataatgaaccctggttctaacactacattgtggatgcccttaaatattacctaggaatctaaatctggagttctggacaactatgttcagattcgtaagtgttaaatattccctctcagatccacagtgttaaatatgcgaagttatattttggcacatcttagagcaagtttaatagtatagcccactacaagccccaattcatctatagccgatctaatagtcaattcatacaatagttgcttactatactattaatatatggtcccacatatcatacacacattgtgtcttaaagaccgtgctacagccggctacagatctgtagcccgctgttcttctctcttatcttttatcttattaaaatatgtttatagctggctaatagtctgctattgtacctgctcttagacgcccgtgccatgcatgtaaactttgtgaaagcattttagaaacagtgtcttttcttgcatgtggtcgttagttgtgctaatgcaacatggcaatcagcaattggttagcactgtaggataaatacacagttgctttgcatttttcaaaaccactatggagatatatttgtttagttgtggatgggttatggggattggaggaaaacaaatttcaaacttactttgggcagggtatcagttaaatttggacagggaatgagtttgatcagagtaggtacaaatttttctactaacggtactaatatccttgcttatatggtcaatatatagtttcagtgtgtcacgatttgatctaaatatataggtgtaagtggcaagttaacttgcaaaattatgcaaccgcatcattaaggtggtattagtcatcagttttttctctttatattataagcatgtgtagtggtgaaacattcccctggtgtaaattaatttgtattgcatcctgagaaatcatttcgccttcaatgtgtgtaggataatatatgggatttctctattgtgggtagaaatccatgacgaacgcgtgtgatactttcaggtgcacattactcatgcttatgttttgatgcacccaaaaatttaaacttaaaggtctaatgtggtaaaaactttggaatgaagatttttcttaaaaagaaagtttgcaggaattaaactactactccatgtgagaataatataaaattccgacattcttgaggaaagatcacgaatgcaatgagaagggagaaattgagatagatggacgataactcacattgctaggccatgatgggcttttggagttttggaccgttgattcttttcattgctcactactcattttcacgaatctgtaggtcttaaatttaagtttataagatacaacgaggatgaacgtgactgtggcacacacctcgctccaagtcttctatcatacattagacgcaggcttggatggattaattataatgccaaaccattaaggctgtgttcatttcaacgagttgggaacctttccttccaacatggaaaacgacatagtttattagtgcatggatgttacatcctgaagttcttctcccaagcctaaattgaattaataaatggtcttaagaaattatttgtgtaatagcaagagagaaaccctaatttaataaatgcatttaataatcgaaaatggcatctgtaatttttcttgggttctacatgtcaaaatatgctaacaggatttttagtagaattttcagagctctagaaataattttaatcaattaaaattgagcacaagcaattattaaagccctggaaatcaatttcctttttctttttctctttccccccctcctttttcacttgttgggcccgntggcccttttcctaccgcacgcgttcgntgggtgagcctcaggacgaggcccgccggtcagcgcgccccctcgtgtgtgtctcgtggtcactgacacgtgggacccacctgtcaggtcctccccaacctgcggtccgccgcctcccgcaaatgcggtgccagcgcatgctgtccactctccgcaccccagtacacctctcgtgtctgcgattgcatcgagacagccgggattccatttttgaatcccgcctctctttcctcctccacctcccccacttcgccggtgaatccgcgccactcccagccgttcccgcactccccacccctatataaatggccctccctccttctctacctttttcctttttccaccgttcgctcccgaactccccatcgccctagcgtcgttgcccacctctccgccgtcgccgccactgctctggtcgccgctagccgccgtgccaagccgtgccatcgacgtcgtcgtgctcaccgtctagtgagccgcgccgtccaccccttcgccatcgaggtccgccaccggagcccgccgtccacctcgcgccggtgagcatcgccatggccgccgccttcggccggcgctccccattgtgttccctaggttaccacgaagctcggtcgcccgtgaccgtcgacatcttgccgcccatcgtcgccgttcgccgttcgccgtcgccttcctccatgccgaccgaatccctcggtgaggaccagcatctcctctccctctctccctctcccccttgtagcaccgccgcatcgccgccgctcttcgccgccagccgttcgccgcaggtcgccgcccgcgccgccgccgccgcgtcgccatggcgccgggccggcttaagccgcccgtgcgcgccggctgcgagccgcctccgcccacttggccgccagcgtgtgcgccacctcggcgccacgtcagcgtcacatggtgctcctctccccagtcccgtggactcggtccactgtgctccgtttaagcccattcaagtctcagtaaatcaagaaaaatgcaaagaatccattaaaaaatgttttgttctctgttttagtagtcttatagcatgtttgcattgtttgccttgtatgtcgcgtagattctggctctcccgacgcttcggtgtactttgaaatagtcgccgaggtccctctagccgcagagcaaggcaagtcatgcttgttacttgaacatattgatcctatattgcaaatgctctatgttttctttaaaattatgcattgttttataatgttactagatgagatgtttacctactattatcagccatactatttgttcatcttattcctttgctagcttaggttgtaacatggctatatgttggattaggaattgcatagctatgcttagttcaactagtacacaaagggggaaacacactatacatagactttggaatctagcatgactttggtttagtaccaccgcaatggtgttggttaattaaaatacactaaatggtgggctgtgggtgcatggttttgctggtcgtgcccatggcgattaaggaccggttcgcaggatgccctggaagaacttatcgtacttaccacaagcagggtgggcaacggctggagttgtagtgtagctttcctctagccgacacatccaggtaagggtgggcgtgatggagcggaataggccctgcgatggcctttgtcgcttctggattcacctaggcatgagaggtgcccattgccttttgaggagtgggggtgaaacttgaggtgtggtgtgcttggttagaggggttatgcgaagggtcctgtcacggcctctttttggtatgtcgtgatggcatgtcggctcacgggaatgtgtcgtggggctgtgtcttgtgggtatagttgtatacctctgatcagagtaaaactattcgaatagccgtgctcgtggttatgggcgatcaaccagattcactgtgattagtctcacccctagcttagcataatggaactgattagttcaggtggtggtttgggccagtctcaacgtggtgtagcgttgagcagtgattgggttaaatgatggataattattacaactgttttaccactttcaactactgtttataaatgctagctttatgcaaatgaaccccctttagctctctttggttatatcctgcatcataccctcagttccagtatgacttgttgagtatagtgggtagtactcagtcttgctctatctcccaaccccagagtttgagtatgcgtcagatggtggcttctcataggagtaggcttcgtctgtgccgtcgaggatgcctgtggaatggtgtctcccgctgctatccaagtcaaggcttagctctagttatccttttaatttccactgcagttatgtaagacttttataatgtttgtaagacgtagatctgtatgttaactttgtcgtttgtgaaccctggccggtcctggacaggggttttaatgcacattctgcctggaattctattcgggaatttctgggcgtgacaatggttaattaagtattagaaaaaaaattgaaaaatgcattaatataatttttacaacaactttttaatttcatagaaaatttttgaaaaaaatatattgttcatctgtttgggaagtgcgcgcgtggaaataaatgaggaagtaaagttgggaaggtgtagaaactaacgtaacctaagctactatggcaatctggcacctttctatgcaggcttgttcactttgttgccattgtcacccctaccaaacttttggtaatgtcaaattttagcacatttcggcgtcactaaaatttgatagtgttggatgcgcttggtttgaagctaatttacctaaatttggttgagtgtttgagagtggaaacttccagaattaaaatttttttagcagagttggaatggtaagggtatgtttggtttgttgctgccataataaatttggttatgttaaaatttggtagggttgaaagtgacagtaaaaagaacaaccccacatctcgatatcctcgttttgtttgttgctaaaccatgtcacgtgcccatgccactgtgatccataagtataactttgtttttgatggagttgtgcttgggtgtctgcacgctgttagtttctggaaaaaaaaactgtgcgcgcgcacatcttgataattaattatgttcaaagcacagcattttcttaaatctgagattttctttttgtagaaagcttgcttttccaaattaaatggaaggttttgttgtccttttttcataaatattgcacgcaaacagatcaaagacggacaccactgcacagtgcttgtgcaccaattaatcttaaatattaccatttcaataaataccaaaaaataatatgcatcactttcccacatgtgagcatgaaacaaagattcccgctacatttaaacttcatataaaattttcccttaaattacttatccgatctacaatccgattgtaccgttgtatttgtttaattaaatctttacagcaagatcttacatgattatattctaatgaagaaaatatatatgttgtaaatatcttttattatatatcaatattacttttctcataaatgtatttacttttaaatttgattaaattacttcttagaaattgataataccgtgaacatgttacttttgtagccgtctttattctgttctatactttgtgttgattcaattgaatttctagaaattgattatattgtgaacatgtaacttaagactcatgtttttacccctacaacggatttacttttagtgccatgataacttactttcatttcgtgttatgttagtatgttacatttataatatgtgtaaattacttttaggctttattgaatttactttaacaaatatccaggaagtaatttaatcaaatctaaaagtaatttacatatatgatgaaagtaatttacaacatgtatatctctttcatcagaatataattatgtgagatcttgttataagttttaattgcaacggatataatgatgtaatcggatggtaaaaaaataaaccagatttaaaaagatacgggtatttgactaaaaaagtagagtgtggtctacttaagcctaaacagtgcgtatgcactatttagattttgcctttgatacttttatttgagaggataacgtcacatgagctgaactgtcggaacacaggtggcccacaagacgagaagaggagaggaaaagtttcctcgctgaagagcataggaaaagtttctctgttgaagaatgatgggagttctatgacatggtgcagtgatagcatttgcttgtcaatagtagtgcgaatgtctatgcactatcccccaattcaaatcctctgctgtgctgcacatgcagactaacatgtgggccacagggtctatggggcccacatatcagtgagcagtactgtatgtgcagtactgcagaggacccttactcgctaaacccaccctcagtatttaaactttgtgctcatgcaacatggcgaattgacatctttaacatgttaacattgcactaataactacaccattgctttgcattttttttagaattcgtatgtacgtgtatttgtttagttgtggagggattatggaggattggagggcatgaggttgatcagagcagtcacaaatcctgctgcaaatgaatgatacccagatcctgacttatgtgttgtaggaggttgatattgttgtactgtgttgcggtctctgatctatataagtggattgggtaagttttgttgcaaaattatgcaaccacatcatcaaaacaattttactggtcagatttctactctgttacgagctgttggattcacagcatatgaaacctcttccatatcatgtctctagtgttgatagaatagtgcatacattaccagagcaggatggaagtgatatatggatcttcttctatcgtggtctaaatgtatattgggcaatgggcatggatacaaatagatgttctcaaggaacaagtacaatacactttgtgtgaactaattggagaataataattacatatgtttcatacactgctagtacaagatgtgaccgacttttccttgctggccgatggatggctttttgttgttgagtatgatgggtggctcgacatgtgatacttctagttgctcattactcattcttttgtcttgatttagtcctaaaatttaaatttaaaggtctaatgtggtactccctccgttcatctagttgacagctattttgaaacaaataagtgagcttggcggttaaagtttgttacgtgttattggttgttagacatgacacgagatttgcttggtacgtgttaatgcttgctacatgatatcaagaaatacggcgcattgcacatgccctacatgtaaactttgtgaaagccattcagaactgatcaagtttgtttgcatgacttatatcatgctgctgcaggatggcaacgggcaacatgttataaataaacagtttctctaagttattggttgagaataataataagccatatgtttttgttttagagggtataattagcgattggagagatattggaggaaaccaaatgataaatttaaatttggggtgtgtaatagttggtttgccagtagatgataaaaatagttgcgttaatgtcatctattgagttgccagtagatgatagaaatagttgcgttgcaggtgatctgggatcatcctagtcttgtacaaatgttgccatgaaagatgtggtcgctaagtatacattcaacaatcatgaactagcgatctatccaaacaagggggctcgccaagatcgccatgtcggactccgaggagcaccacttttagtcgaaggccgaggctggaaccatccgcaagaatgggtacatcgttattaagaaccgcccctgcaaggtggtggaggtttctacctcgaagactagtaagcacggtcatgccaagtgtcactttgttgccaaggatattgttccttcatcccacaactgtgatgttccacatgaaccgtacaaattaccagctgattgacatatcagaggatggattattcgtgagccttcttactgagagcggtaacactaaggatgatcttggactcccaacttatgacaatctcctgggccagatcaagactggatttggtgaaggcaaggatgttgttgtgactgtcatgtccgccatggggaggagcagatctgtgcgctgaaggacattggccctagtaacttcctcaagtgaaagactacgaaacagagggatgcttatgtatcaaacctaaactataaaaaacaatgatgtactatatcttttatggacaggacttcaccgacaaaggtctaataccagtgtttgaggacaggacttcaccgacaaaggagatagaaataagcatcctactaatggctttaagggtggtcagtattcactagttggcacaataatttaggtgatggtatgcgccatagtttcctatgttgatatttattcattagtttacataagttgacatataccagcctgtatgttgaagaagttgaacttcatcttgcaaataccgaaaaggatagggtacatgttgcaaatatacttatcactgccaaatatgctgaggacctatatgtgatttctgcaaacaatagtgctccgatgaaagattgaaagagtttcctaaatgacatttagacccagataccactatgtaatgtaaactagatggtacctcgcgcgttgctacggaacacttaacatattgtcggattaggaaacattttttttataatatgccatataagcaatctaacatggccgctgataacttgacaggcagttatattgtttagagactaaataacatgttaggaaggaaaaatgagataaattgtatcgttgattttaatcataaattaaagaaaatgcttctcactaatttggtagacatcacattgctaggtaaagctataatcacttgaattgtttggataaacagatgtcaatccatcccatgactccatgagggagatccattagaccaaatgctgatggtcgatgcagttgctgtaaccattgagaaaacatacatttactagctaaaatcaagtttacataccagcaagatcatgtaagatattaaagcccttccatagttccatcaaatgtaagtctgaagagcaagagactggctttggtttattccttttatctagtggtctggtgatgaactgaaacaattcaagttttagtgttttattatggaaaaacaaaatgcacctaaaatgcacagagctccgatggagggaggaccatggaaatgatgaggaagatggcggcaacaggaggggattcctcggcgacctactccacccgttatcgcgctgggagaggcgacgaccggcatctagcgagcagccggcggccatggtcgacaagcggcagcttcattcttgatgcactgcttttttcagcttcgtctttattttgtgattgggccgaacctagaaggccgtagcacgcttgtgggccgagcgactgaggacggaggctggattagcgatgccgttggatgcagaagaaacgatggatctggcatctacgtccctctgacgtagaggcattctacgtcagaggatcgtgttcccacctagtaatataaatctagacaactctgttcagattcgtaatactaattaagtggcatctaatcgaattctatgttgctagaatttgatacggaaggagtagttgctacataggagcaagagatgtggcacatcttagatgcctgtgcattgcatgtaaactttgtgaaagcattttagaaacagtgtcttcttttttttttttgcatgtggtcgttggttgtgctcatgcaacatggcaattggcaattggttaacattgtaggataaatacacggctttccatttttaaaaaccactatggaggtatatttgtttagttgtggatgggtactacgaaaaccatttttcgtagcagccattttatattttcgctggcggaacttagtgctgccacagagcaaaggccagtgaagattaacatcttcgctagcggttatcgaccgcctgcgataattcattttcgctggcgatcgtcttaaactagccgccagcaaagatccattttcgctggcgattggcttaagacagccgctaacgtaaatgttttttcgctggccaagtattaaaaaaaacgacggatggagcgacaccgctccgtccgcttccgtcaacgctccaccatttagaaatttcacataaatttaccccaagtattaaaaaatccacagaaatttacatcaacaatttacagtcaactgttttcattcaccaaagcattcaagcatcacaaaaatcaacacggaggagcgagccaggcagcacggtcgacggcgtcgaggtcggagaggagggagccgggcagcacggttgacggcgtcgaggtcggtgccgtcctcaccgtggtccggcgggagcggatccggcttccctgcggcccggcggcggtggatccggcctctccgcctgcgcccgcgcgccaccgcccgccgcccgcgcccgcctggtccggcacgttgttgtcggcgtcagctccgccaccgcccatctgccgtcgctgccacggcggctgctgcccccttcctccggctagatctgggagagggagagggatgggaggggaggggagagaggtgagggcctcgtcgcccgcgcccgtcatggacgccgtcgtcgccgtcgtcaacaggacgaggaggaggtctgggagctccgggaggaagaggggagagaggtgggggaggacgaggaggtgagtggagaggagaaagagatagaggagagatgaatgcatgggtgggtgggtggcagcctctggcagtgggtgggtgggtgaaggaatctcgtgtgcatggttttaaatgccgccaaaattttttagtgaggctttgcttttcgttggcggatctgtttttttttctggcagatctctttagcagccaccagcgaaaatcggttttcactggcggcccgtgaccccccaccccccgattttctacgctggtgattttttctcgtagccgccataaaaaatattttccaaatgccataaaaaatcgtctttctagtagtgatgggggattggaagaaaccaatttcgaactaactttggcgagtgcatcagttaaattcgcacagtgaatgagtttgatcagagtaggcacacattttactacggcgtttggttgcaggcggaggttatggacgactgtaaaaataagttttgaacgcatgtaaaaatgctttttttagtagtggtcacaaatcctgctacaaatgaataatacccagatcctgacttatgagttgtaggaggttgatattgttgtattgtgttgcgatctgatctatataagtggaatgggtaagttttgttgcaaaatcatgcaaccacatcaacaaaacaacttttactggccagatttctactcttaatgttacgagctgttggatttacagcgtatgaaacctcttccatatcctatctctagtattgatagaatagtgcatacacattaccagaacatgatggaagtgatacatggatcttcttctattgtgttctaaatgtatattgggcaatgggcatggatacaaatacaatacactatgtgtgaactaattggagaataataattacatatgtttcatacactgctagtacaagatgtgaccgacttttccttgctggccgatggatggctttttgttgttgagtgtgatgggtggctcgacatgtgatacttctagttgctcattactcatgcttttgtcttgatttagtcctaaaatttaaatttaaaggtctaatgtggtactccctccgttcatctatagttgacagctattttgaaacaaataagtgagcttggcggttaaagtttgttacgtgttaatggttgttagacatgacacgagatttgcttggtacgtgttaatgcttgctacatgatatcaagaaatacggcgcattgcacatgccctacatgtaaactttgtgaaagctgttcagaactgatcgagtttgtttgcatgacttatatcatgctgctgcaggatggcaacgggcaacatgttataaataaacagtttctctaagttattggttgagaatgaaaattagcatatgtttttgttttagagggtataattagcgattggagagatattggaggaaaccaaatgttaaatttaaatttggggtgtgtaatagttggttagatagtcagcaactctctttaatgtcatctattgagttgctagtagatgataaaaaaagttacgttaatttcatctattgagttgctagtagatgatagaaatagttgcattggaggtgatttgggatcatctagtctagtacaaatgttgccatgaaagatgcggtcgctaagtatgcattcaataataatgaactagtgatctatccaaatgaggtaactcaccaagatcgctatgttggagtccgaggagcaccacttctagtcgagccatgtcagactccgaggagcaccacttcgagtcgaaggccgaggcccggaaccatccgcaagaatgggtagatcgttattaggtttctacctcgaatactggtaagcacggttgttggcggatggcatgaggcccttcgaccaaatctgccgaaacccgtggcgaagactatggagcaagaacggcgtgaggcaaagagtcgtacgagtgccttgccaggccagaggcgtcttaggcgaagggtgcaagacgaagactatctgccgaaggaagacgacttcgccatggcaagttcgcccccgcaagggccgaggaagcctttccggcccatcaagcctaggggctatagggccggcgatcgccagacggcccatcaggggcccatgagcccctataacattatgtacccctgtaaatgtccctttcgcaagggtaatcatgtaaattcccctgtacaacctaaaccctagtagtaagaacctataatgaggctataaatagtcccctagggccatgtaatggggggatcccgaagaagaaattttaaattcaatacacttcgtttctttccaaccattgttgagtaaccacgtccttcgacgtatgcggttgtcatttcgacaacagtggcgccgactgtggggacctccgagcgaaaccactgagagcgaatgccaccgaagagagtcgtgaaggagaaggttgctaggcggaaggaaagcgacgccggaccgggcatggccgttgaggaaggagcagagccatcggcgcccatggccgaagatggaggaggacaagcaccatcacaaccgccttcggcccctgcaacctccgtgcaagtgacgaacgcggccgacgtggtgaaggcggctgcggcggcaagggcactccagactagggcggagatcctttcgacaagccaactggtggtgccccaagccgctccatcgcagccggtagcggccccaactgcgctcgccgttgtgcaggcccaagacagccctgaccccgaagcacaagccgaagccgacatggaagccatgcggcagaacatgacacggctccaagacatgcttcgccaaatgcaagaacaacaataagcatacgaggcggcaaggcggaccaaggccacgtcgactccaatccttcagtattcggcaggatatgtcccatctcaagtccatccgcaagtgacgacccagccctttccgccacaagccgcacaggcaccggtgtacttcgacgggcagcaatcggccgcagcagtgtattcggcccctcacgtgcaactgcaagctccagtcgctgcccaagtacaccatcaaccacctggtcaagcgccacaaacagtggcagaagcggcttcggctctgcaggcgcaactccaagctttccttcagcaactcaaccaaccccactgcatttcaagtacaaccccatcggcccacccggaggagaatacaagtcaaggtgcgcctaattggttgccaccgattcagccgggcctgggagcttcgccatggaatcaaggaccgcagttcgacttcatcaatgctgctcagagaccaaccgttcggcagcaagctccaggcttcggaacaaaccaagcaccaatccaagctgccacgacgtggtcgcagccaatttttgacccatccatggcggctcagcaagtacctccagttggagccaggcagtcgaatgccatggcacaacctcacgcacaagatgcgattttgcccttcgccacaccgtacccgcagcaaagtgcagtaaacagggcgggaggcgaaaaggggctaccgctgagcgggggaatcaagactcgtccaatcccaccgcagttcaagttcccacccgtcccacgctattcaggcgaaactgacctgaaggagttcctctccatctacgagttagcgatcgaagcggctcatggtgacgaaaataccaaagcgaaggtaatacatctcgctctagacggcatcgcccgttcttggtatttcaatttaccagccaatagcatttactcatgggagcaattgcgtgatgtttttgtccttaactttcgaggcacctatgaggagccgaagacgcagcaacacctcctcggcattcgccaaaggccgggggagtccataagggagtacatgcatcgcttctcacaagcctggtgccaagttcaagacataaccgaggcgtcggttataaacgccgcttcggccggtctgctcgagggcgaactcacaagaaaaatcgccaacaaggagccacagacgcttgagcatctacttcgcatcattgacgggttcgcaagaggcgaggaggattccaaacgacgacaagctatacaagctgagtacgacaaagcctctgtcgccgctgctcaagctcaagcacaagttcaagttgccaaaccacctcccctctctgttcgccagtctcagccggcgatccaaggacagccgccaaagcaaggccaggcccccataacttggagaaaaagttcagaacagaccatgcgggcaaagctgtgatggcggtcgaagaagtgcaagccctccgcaaggagttcgacgcccagcaagcgagcaaccatcagcagccagcccgcaagaaggtccgaaaagacctctactgcgcctttcacggacgctcttcgcacaccacggagcaatgtcgaaacattaggcaacgtggcaatgggcaagacccaaggccgcagcagggaacaactgtcgaagcaccccgcgaagtagttcaggagcaaacacccccagccgaacaacgccaagatgtacagcgaagtgtaatccaagtgattacaagggctgacccgccaagccagttgtccaaacggcagaagaagatgcatatccgtatggtccacagcatcacttcggcgggtgaaggggcgccgcagtatctgaaccagctaatttcttttgggccggaagacgcagaaggagttatgtttccgcatcaagatcccctggtaatctcagctgagatagctggtttcgaagtccgacaaatcctggtcgacggagggagttcggctgatgttatcttcgccgaagcatatgccaagatggggttgcctacccaagcccttaccccagcaccagcatcgctccgcggtttcggcggagaagcagttcaagttctcggccaagcacttttgctgatagcctttggctcggggaagaacagacgcgaagagcaaatactgttcgacgtcgtcgacatcccgtacaactacaatgccatctttggccgtgcaaccctgaacaagttcgaagccatttcccaccacaattatctcaagctcaagatgcccagcccgacagtggtgatagtagtcatggggcttcagccttcggccgcttcaaaaggcgatctagccataatcaacagagcggtgcacagtgttgagaccgaaccgtatgaacggccgaagcacacgccaaagcccacccctcacggcaagataacaaaagtgcagattgatgacgccgaccctacaaagctcgtatcactggggggcgacatgggcgaagaagaagttgagagtatcctagaggtgctcaaaaagaacatcgatatcttcgcctggagccctgacgaggtggggggtgtcctggcggatctcatcatgcatcacctagcagtcaagccggacattaagccaaaaaaacaaaagctgcgcaagatgtctgccgattgccaagaagcggcgaaagccgaagtacaaaaattgctcagggcgggggttatccaagagattgatcatctggagtggttggcgaatccagtgctggtgcgaaagtcaaacggcaaatggcgcatgtgtgtcgatttcacagacctgaataaagcatgtccgaaagacgacttccccttgccgcgaatcgaccaactctgggggcgaagaggggcgcgaagtatcgctcgaactcttagaaggagtaagggtcgaagcgctcgagcacatgcacaagtacgccacaagcacttcggcaacttacaacaaaaaagttcgacccacgcagctgatgcctggtcatcttgtcctaaggaagaaggcgaatccagtagtggttggtaagcttgaatcaaagtgggaaggaccatacctcatcaaacacaagtctaggacgggatcttttcgcctagcgacactcgaaggcgaggagttcgaccattcctggaacgccgcctctctcaagcgcttctatgcctagaatgggtgtcacccaaatcgccaacttgtaaaaatgtacatacagttatgtaagcccttcggcaccatgtaagccattcggcactatgtaagcctttcggcaaaaaaaaaaaactggatgtagggctattatccaccatggaggcccaaaccagtataaattctctgtgccctccgccttctttttatttttcgtgtgattgataatttgtgaaaaaaccccaaggcaaacgcctgatcagcgaaaaaggccagggggagaaacgaatcggtcgaagcatcgctcgccgaacgttgaaaccgcaacagcttgtctcggaaaataactagccgaacgacgttacgattcgatcaacataaaagcaaaagtgtctctttcgacacagaatgctacaggtcgaaaacgaacgacaaaaagctgaaaagtcagtacacctatttcgctaatatgcgcataggggccggcatgttccgacctaacaaaagcacaaaatgtgacaatgcgaaaaatagcgaaaaggaaataaagcacgttctttattaacttcgaaaaaataatcgaagaatacaaggtctacaacacgatacaactcactttacaagtaaattacatcttcgcccccgtaatcattatccctccctaaggaatggacagatgaactaggttcgtcatcactactaatatcatacacaaccttaagaggagtagggggcgaaacgcagaccaaactgtaacgacgctgaaagatcatttcctgacgtttagttttctgatggtttcgccaaaagcgagccatatcctccaaacgtcttgaatgaataagatcgtaatcttctaaggttcgcccggggtgcgcccgcagccagtcggcaaccttgaaaaccttatagctgcgaccgtttatctccatttcgcgataaacagggagaaatggacatcgcacctttggtaggtccttcaatgccacaaatttctcgttttgacttcgccagctcccggaagggggccgaatgcacaactttcggtgaaccccctgatagacaacgcagaaaaagcaaaacacagcttacatagtaagaataggcggaaggagggggaggtatggcataatgcgagatgagcgaaataataatttgccaaagacctcgatcatcaaaaagcaattaagattgtgtcatatattccaaatgtacaaaaaagcctttttaaggttcggcggcagcctgccgaatgtacatcattcgccttctccaggcaaacgcaaaatcgggaggaaaactacaaaaatcaaaggaaagggcggagggcctcacacctctaggtgatcctgggcatcgcctccgaccccttcgcctaccgcgccctcttcttcgccccgatctgccgcctccgccttcgccagttgctccagaaagcgcgctttggcagcggaccggccatccttctgccagaactgttttcgccacgcgcgaagagcgggcgaaatgttctgcgcactaatctcccagtcccccttcgcataggtagggaactcggcgacgtgctcgcagccgaactgttgcaaaaggcctaaggtaaaggccgccgatacgcgtgcacagtaatcgccgtacgcggtggcacagtccgaaaccgatccgccagcctgctgggtccactcggagaagtcgaaggctgaggcatcctcggcagggaccccccgcaccttcgcgcccatgtcggtaagggcgaggcggagcgtttggcaagccgttctcgcggattcggtggtcttcgccatctcccgtgaaaaccgctaagactcctccgctgcgctcgcttcggccctgccagccttctggcgaagagcctccatcttcggctctgtaaggttgtagtaatcaatgagcaccgccgaatgggccttctccttctccagttcggccttgaggcgatcaacctcggcctaggcctctttccctttgtccaattcggactgaaggcgtttgatttcaattttcgcctccttgagggtgtgggccagggactccacctccaagttcttgcggcttatttcatcatccttggcccgaagacggctcttaaaatcgtcaaaacgggcccgcacggttcgctctatcgaacagtgagccgcaagaatctagatgaaagataggagcgggcgaaaagaacaaaaggttaattgcgaaacgtaaaaaaaagagggaagaggaaaacgaaggaagagaaggcatacccgaaccgccaaacttttaatggaggaacaccccttgttgaactcgttaagttcggtgaacaggctcggggtgccggcgggcaagataagattacttactccctccacaaagggaaaaaggttcgcccgggtctcgaagtcaccaggggcgaagtggggcgccgcgagggaatactctgaggcagatgcttcggcggccgcacacttccccttcgccttgaccagcggcgaaatagctggctcgcgcacagggctcccgaaaaccctcgccacagccgacacgatccgttcggcggaggcggaagccccggcggcggcgctacgcctgccccagcaacgctgagcggagcaaggggagcagtcgaaaaggtccaaactgcggccagcaggtgaagtcggagtctcgtcagaagactcgtcgttgctaaaaacgcgagcgatgtcgacgagtcccttcttttttgagatcttcttgaccagacctcctttcgccgccttgcccgacgagaacgcaactaaggccttcgccccttccaaatcctttcgtcgaaggggggagctgttcgactccaccccggtctcgttgtgacctggacttggggtaggagtgtagccgggggtgtcgacgtggtcttcgatcgcctcgttcacggccttatcagccacagcctccacctcctcttcttcctctccttcctcctcgccgtcacgttcttcggaatcatcctcatcatcggcatcagagtccgacgaagcaggaacccttcgcttcctgggggcaagcttcacttgtccacgcatctgctttcgcgaaggccctgcatcgtcgtcggctttttggggattcgctcggggaggcagttcgccgttgtaaacccggttcgcccgcccagccgcttgtcgtgttagcagctggctatactcgacgaccgaaacgtcgccgatcatcctgcgggcttcggcttaagcctggtcgagggtcgacactgcaaaagtaaagggtgtggctgcgttaaagatcagacaaggcaaaataacaaagcacaggagtgtatagcaaaagaacggtcttactattcgtcccctcaggaagaaccaagttcggcaaaccgtcaggctcttcgcattgctcgaccgtgacttgccatgactgggagaggggaaagatacgaagcatacaaaactcctccaccaagtcacggcagctaaggcgggagcaaaccttgcgcagtaggacgaaccgcgcctccatagcgccgtccacggcgatcttgggtttccggttcggcgcaatcgccctacgccggcaccggagggcttttgccgagttagaaccagccgcgaaggggatggtgtgatagaaccacctcgccatccaatggaggtcccacttcgacatggcagcgttcaccggccagagatcggaccgctcggggcgaacgttaaagttcacgctcccgaacactgtcttcttcgttccagccggggtaatcaccgtcttcgagttcacggtggtgaaaaatatggcgccaaagagctcggcgctgggctcaaacccggaagtccggcacgcccagtcaaagatggagatccgaactagcgccgacgggctcaactacggaagctccacctggaaaaggcgaaggatctccagcagcaacacgttgcacggaaaccatagccccacctcaaaaaagacggcgaacaccaccgtccgattgtcgataggcttcagcaccacggctttccccggggcgaaagcttgcccctcaaccaacaccctagagttgaccaacttcgccagctcgacatcgtccacgagagaaacccccaaaaaagcggtgctgtcatcatcgacctggccgggatctggtccttttgccgaagctgggtttggcttgcgaggagccatggcgaacggcgtgtatgcggtggcgaaggaagagaataggcgaaacacctaaggggtcaagaaatgctgtggaagagaggaatggaagaagagaacgcacgcggtaaaaatggcaagcgtaccggtgaaaaagaaagaggggtgggaatatatagctcacccgggcaaccgttcgcctactcaccagtaataaagcgccacgtgtcgcaagggtaggcgaaatggtaaattcccactgtctgagcggcacagtaaaaagcccacgatgggaaggcccaatactgttccgttcggcccgggaaaagaaaaatatataaccaccaatcgcaggaggcgaagcgtggcaaaataataccagccgcacaagtaacaaacttcattcgcaggaataatgtaggtttcggcacgagtatcggtcgaaagggggcgccgcataccataccacatggtttgcacggtctcggccgaagctccaatctcacccttgcccgtgaggggcttgttggcggatggcatgtggcccttcgaccaaatctgccgaaacccgtggcgaagactatggagcaagaacggcgtgaggcgaagagtcgtacgagtgccttgccaggccagaggcgtctcaggcgaagggtgcaaggcgaagactatttaccgaaggaagacgacttcgccatggcaagttcgcccctacgagggccgaggaagcctttccggcctatcaagcctaggggctatagggctggcgatcgccagacggcccatcaggggcccatgagcccctataacattatgtacccctgtaaatgtccctttcgtaagggtaatcatgtaaattcccctgtacaacctaaaccctagtagtaagaacctgtaatgaggctataaatagtcccctagagccatgtaatggggggatcccgaagaagaaattttaaattcaatacacttcgtttctttccaaccactgttaagtaaccacgtccttcgacgtatgcagttgtcattttgacaacaacggtcttgccaagtgtcactttgttgccaaggatattgttcattcatcccacaactgtgatgttccacatgaaccgtacaaattaccagctgattgacatatcagaggatggattattcgtgagccttcttactgagagcggtaacactaaggatgatcttggactcccaactgagacaatctcctggggcagatcaagactggatttggttaaggcaaggaaggaggaggagatctacgcgctgaaggacattggcaccaagtaacttcctcaagtgaaaggctacgaaacagagggatgcttatgtatcaaacctaaactaaaaaaacaacgatgaactagatctaaggagaggagttcactgacaaaggtctaatgctagtgtttaaggacaagacttcaccgacaaaggagatagaaataagcatcctactaatggctttaaggacagtcagtattcacaagttggcacaataatttaggtgatggtatgcgccatagtttcctatgttgatatttattcattagtttacataagttgacatataccagcctgtatgttgaagaagttaaacttcatcttgcaaataccgaaaatgatagggtacatgttgcaaatatacttatcactggcaaatatgctgaggacctatatgtgatttctgcaaacaatagtgctccgatgaaagattgaaagagtttcctaaatgacatttagacccagataccactatgtaatgtaaactagatggtacctcgcgcattgctacggaacacttaacatattgtcggattaggaaacaaattttttatataaaaaagccaatgaactgaagtaattctacaggttgatggggatataatatgccatataagcaatctaacatggccactgataacttgacaggcagctatattgttcagagactaaatcacatgttaggaaggaaaaatgtgataaattgtatagttgattttaatcataaattaaagaaaatgattctcactaatttggtaaacatcacattgctaggtaaagctataatcacttgaattgtttggataaacagatgtcaatccatcccatgactccatgagggagatccattagaccaaatgctgatggtccatgcagttgctgtaaccattgagaaaacatacatttactagctaaaatcaagtttacataccagcaagatcatgtaagatattaaagcccttccatagttccatcaaatgtaagtctgaagagcaagagactgactttggtttattccttccatctagtggtctggtgatgaactgaaccaattcaaattttagtgttttattatggaaaaacaaaatgcacctaatagatcatggcgatgaagggtttaattcacaaaatataagtatcaaagacatataaggaattgttttacaatatctctagctatctgaatatatgtagcaaaataatgatgggcagctttgcaatttcatatatacatatggatgaaaccaccctagtccctagagtaatgaattacttgatcaattgctccagaataacacaatgcctttcatagggatgattcttacacctgaaataaaaatggacattagaatttaccttgacgtcccccacacaggtagccaaatcaaaatgtacacagaaagtagagacagaatgataacaaaatttcatagctatagtcctacaatctgaagaaaaccaagattagaaaaggcaagaagcaattatgatttaatttaaaagggaggagagatgagggagatacacaaataacaaaggggcatgggaggaacaaaaatttcacaatagtactgcattctgaagtgaaccaaaattagagaaagcaagcaaggaggatgggaggaagatgcaaggcaaacagaagcatgagaggattttatagacgggtgtactatcggctaacattcgatcatagtggagttgatgatgaagcggactgaggatatgaagcggaccgaggcgatgctcttggctgttgattcccttgctcgggaacgggatgggacgggatggcgcgcgagtgttaacagtgaaatttggtaagcccccaaagtcatcatcggcctagagtcattatcggcttcagagtcctggaatcggccgatggaaattatcaagtcgccaatagtcgggttaatgctatattcagttaaggaaattaatcaattaaaggaagttcattcagaagagaccgagttcaaagaggatgcggtaaggtagtttatctattaattaggatgagtttgttagtttccttttatctttaggaaattatgtttagtgtccgataaggactttatgttttccttttatctttaggaaagtttctttctcgtctaacaaggaccaatatctacctatgggtataaatatgtacacccggggtgattgtaatttatctccacgatcaatacaaattcggcgcatcgccacctttttttacttttctactttttcaacgaatttattcttttcatcggcggggatagggcttcaacactctgatcttgtcaatgtaagcacctatctaccatatatctttgttaatctagtttggtagttcaatttacttgtatcggctaagattcgttttagggtttataccggaaccggctaaattgctttaccaaattagattagctaaagtatctaccaccctgaaaatcagtcaagagcatgattcactacaagatatcttatgatagatgacgcttcatttacgtcacaaacattgaatttttcgtcacgttttgtaatctgtgacgctcgtgtgacaaaaattcattcgtcacctatcatgcgtctctaatagcgttctatgacaaaaccttatttttttcgtcattaatctagtgacgatccttctgtcgtcataactttgtgacgcttatattcgtcattatctagcctaaaaaacgtcacaaaatatcagatagcccattaaaatccatgtattgagcaccctgtttatgggcttagcccaatggcatgcccaactagattttagcctgacccatctatgatgtagcatattttcagcccaattttattatatccatttgctttaatatcaaataataaataggccaagtccattgcaaaagcccatataagcccaaacattataccacaccattttcaacccatcatattagtatcaaataacaagtgggctaagcccatataggcctagcaatcaaacacaataacaacccatatagcacaaaggttacaacccatatagcaactggttcttctgataatgcaccattacagaagtcttacaaaccgaaaaaaacaaaggtttcaacaaactgcatgcaccatcaacaatcacctacaaggatatgttgtatcaaactagcaaagatatctgattctaaggttgccaaatgttcatagcatgtatttctgagatatttcaccactccagatggcaaaatcttcagctgcctccatcctgtacatttcttctcttgaaaatcaaccaatggcatcaatgtatctttaccctttacaagatcctacccaacagacatcattgtaagtacagagaaatgcagtactgaaatgcagtatacagaggagagaaatctaatctagttctcaacaagctgacatagtatacagtagagagagaagtacagagaaatgcagtactggatgcagctttatcactacaggaaagaaactcttaagttaattaatttcaggctaagttaaaactactggtggaactgggtaaatttggaccactcatccaaccaaggattggaatcaaaccagcaagctaaagtctaaagggtagcctctgatcaggatcagattcttcaccagctaattgaagcagaaatgctgaatgctaaattgcttgcttctgtaaagcgcactgaactgaactaaatgaattacagtgtgaaagaagatacagtagaagtagcagattacttctctgttttagcagattagctcatggcaagatgtttagataatggaatagatatctagtttgattgccagatgcaagttgatctctttgcccagaaattgagcatgaacatgcacagtgcatgatgcactcactctcattcatcagtcatcacctacatgaatgtaatttgtttacaggtggttcttaataactactaattaaagtattggtgtaagcatctaatgtatgcagactgcatgccaatattcttagggatcacatgaataaaaatcattttgaggtagcaaatgtttgtgttcaagaataggaaaaggtagtaagaaggtgggaaaatgacacttatctttctagtctatgggatctttgaacgcagtggcacacaaccttctgtagcttgcaattcatatctgcaacagagcaactgcaagcttgcatccttctcttttcatcagaaacttacagctccaaatgaatatgcaatgaaacaagttcagaatatttagtctctacctatgtagcgtggcaagaaagctctgctacataaattgatttactttctgtaggacaggggaataagacttaagtacacatgccaagaattaccattgctgagaggagttgcaactgtactttgatctaagtatcatcatacgcaagtaaatgcatccagaacttgcagatcgagggaacagtgctaccggatgaatcgtaggatcaaccatcattcaacagagacagatagagattaaagcttactgttgtggctcgatgatggcggatgagtgctcgacccatcggcgtgtcacgaccgcctctctgacagactctgaagctgcgacaatggacagggaacaggagaaggcgtaaagcttaaaggcgttaagcaatggaggaaagcgtaattatgtgggagaaagcgtatttatgtaataaaggagttggtgtgtgtgtcacatggtgtgtgggccctgcgtggtcagatcgggaggggaatataacctcaatgagctgtcccaaaacaactatgatgaaaaatagaaaaacaatccctcctaccaactctgtcttgtcttccttcctcctccgcttcccttctgttcttcccatcttccaagcaatcgatcggtccctcaactccggtgagcttcgccaacggatttgggtcgtgacacggcgctccacgggaagccacttgagcaccttcctgcccagcggctcgccgcgacgccgccgctgagtcaccgatgcggcaggggactgcgacgcggacgcactacctccggacctccctgctgcccccgaagagaaggcccgacctcgcctcctccagccatcgatggagggcaggccggtgatgcggctgctgcggcgtggatcggggatgtggctgcggcattgaggaggggggagggtcgccgccgccggccgtctccgtgcccgccgcgtgccgagctcctcggtagggcggcggatccggccctcccaaggacggcgccgccggatccgccgccacaggccgtcgccgagcccgccgcccgccgccgtcggggaagggaggccaccgccgcgcatgggaggtcggggaacgaaggccgccgccggtgccgagcgggtcgccgccgagcccgccacgccgcacagctcccgtcggtgagagagagaggagaggaggaaagagtgagaggctgataggagaggataggataggataaggacggtggaagttaaaatatcaggagaggaggggagatagaagaggagaggaaaaaaattgaatggaggagggaaaaaaataatttcaaaatattaaaatttctaatcgaattttatcatactaaataaacttatgtgaaaaagttgtcaaaaacaaagttgtataactcattgagatctaccaattttattttggtcatttcgccattcgattttgatttaactatataaaatttgaattttaaaatataagtaattcaagaaaacctttcaggtagtaaatgatttcaaatggaaaagttgtcaataacaaagttgtataacttatcaagatctacaacttttattttcatcatttttctatgactttgtatgcacaatttgaatttgaatttcaaattatgataacttcaaacgacattttacaagtactaaatgatttcaactaaaaagttatcaataacaaagtgctataactcatcaaggcctataacttttatttgggccatttcttcatccgacaaagtgatttataacattattcacaaaatgtacaaatctcttatatagtttataaactataggagagatatgtaaattttataaacaatgttactatcactttgtcggatgaagaaatgaccaaaataaaagttatagatactgatgagttatacaactttgatgttgatgaccttttcagttgaaatcatttagtatttgaaaatattgtttgaagttgtcataatttgaaattcaaattcaaattattgaaacagagtgatatagcaaaatgaccaaaacaaaagttgtagatattgatgatttgtacaactttgttgttgatgacttttttagttgaaatgatttagtatttgaaaatgttatttgaagttgtcataatttaaaattcaaattttatataggtcaatcaaacttagatggagaaataaccaaaataaaattggtagatctcaataagttatataactttttttttgacatttttttcacataagttcatttagtatgataaaattcgatttgaagttctaatattttgaaattaattgagaggagggaggcaaaatgaacttctggttggttggagcgcggcccaggaataagttcactttaggtccctcgatttgacgcccagtctgactttcgtccctgaaccacaaaaccaggtacaactcgtcccccaacatacgaaaaccggacaaacgagatccctctgtggttttgatagcggttttggttgacgtggcgcatatatggctaatttgactcggtcttcatctaacgtggcgcttacgtggcaattcattcccgaaaaataataaaacacatgggacccacatgtcagtttgacacacaaaataataaaaaacggtgggacccacatgggcccccacctgtcatcgtcactcctttcttcctcctctctccccatctcctcatcatatatgtcccctttcctctctcttctctctccagcaccaccaccacgactccgccgcaactgccgctaccaactccacctccaccaccaccctcgccacctccgccgctgccgcctgcgcctccaccatcgcctcgtagctctcctcttgcttctcagtggtcgtctccgccgtgggaggccgtggcgggcgatagcaggaggccgtctccaccgcggccaccttgacgccgaggagccctgcgatactcgatgggagatgtatttgacatcgattcttgttgccggtggctgcaccgtggtcggtgaggcagctatgacgggttctatggcggtcggcgacgtggttaaggcggcttttgcttatatcggcggtgcacaaatggcggctcctgcagccgtgactaggtgcggatgagcttcatgtgatttttgcattttgtgtcgtttgttgatttgagcattttaggtcgtttgttttttgtttttttttgcagttgatggagcatgtagcttgtggtgctagataggtttaagtttattttttgtatttgtctgaaatggatcggagcctgcaacctctcaccgttggccaagagcgtagcttgtgacttttctgggaggacggggaggtggcggatggcttgttattgagcttgaccttggcaaggagagccttgttctcctggtcaagtaggtgtgccttctttcgcagtggctcaatcttggcgtagaaggggaatgaggcgtgaccggaggagatgctcccgccgatgccgccgacgcccttctccacaaccactggcagtcgccgccgtctgcgctctatggccccgcgcaccgcagacttgacctagcccgccgtcagccgctgccccgccccgctccgccagccagccgctccgtcccgcccgttgcccgttcctgccggccggagagagagaagggatagagagaagaggggacagagaggatagagagagagaggagggaggagtgaggatgacaggtgggcccatgtgggtcccaccatttttttattattttgtgtgtgaactgacatgtgggtcccactggttttattatttttcgggaatgaattgccacgtcagtgccatgtcagatgaagaccgagtcaaattagccacgtaggcgccacattagctaaaaccgctatcaaaactgtcgagggacctagtttgcctggttttcgtaagttgggggacgagtcctacccggtttttcggttcaggaatgaaaatcagactaggcgtcaaatagagggacctaacgtgaacttattcccgcggcccatggaggagtagaggagggttgcacagcttgggccgaggtgggccgtgggagaaaggagggagagggaagggaatgggaggaggaaaaaggccgagcgggctggcgggaatttgaatcagactttggtacggatttggcccaaatgacaaaagaggattgtttttagtttttctttttaataaattctgttaattgtttttgttgcttagtaaatatttcggtgctttgaaaattcaagtaaacatccaggacatattttagaccgaggagaatttatgaaaaatactttgggccacaatcaaattttttcttacatgtattttagtgtttgccatttacttttaggattttagttaattatattattcattttagagaacaatttttaatttgggtgaatttatcaggatgtgacaattatttagggcgttacaaagggcagttcaagcattcatcaattttaaaaagaaaaaaacgtatgataaacgaacattgttaggaacttgtgacttttgttggttggtctctgatgacaaaataataacagtcacaatacaccattagacaagtttatgacgatctgtatttgatcttagtgacgaccaccccatttttgtcactaaccagcaccaccccctatcaaacgtcataaaacgaaatggcatagtgacgaaaagcaccattgtcacgaggaattcgtcacagaagatgacatttcttgtagtgattgtatattatgttttttttcatactttgcgctgcatcagccctagctatgattagaaccataatctctagcctgctttttgattgccaataagggtttcatcggggtttcagccgatgagttatctggacgttgcatcggcttataaggattacatacaagttggatttagtcgatcgcaacaaagattttactgtttatctagtcatttgtattttatgacatcgaacctccagccgaagtatgctttaacctttggatcaacacttgtactatcatgttattattagacaattggtttctactggattatattattgtttcattacattattatcagcagattgtatttataccattatttattcaagtatcataatctatattggacatatagccgatcgctcaaaaccatatcaacatcggctggtatcggcactgactagtatcggcatcgactgaaatgactctatcggcttgtcagccgattggctcattgttctgttatttgtatatcttgtcagttgcaggatcaaactgtcatggttatggatacaacatacccaattgtaatcaactaagctcagtggggcccaccatatgccaagtcttatacggaatcatacctcgtatgtagaaggggttccggataaggaaggacaagtagagttctatatggaaactataaggactacttggattgtatccatattggtctcactagttttacttggtcaagggaatatctatgggtataaatataagaccccgtagggggagagacacacaagccataacagaccaatactccgccaaacatcaacatcagagataagcctagacagatccaatctggtgcctacgaaggccgacaagagggatctagcgccacctcttatctctacgagtttgtattcaaggaggaagactaccctgtcatcgactatgtgttggtgatccatgccgccaagtcgatgacagctagataggttatcctaattattgtacttgtgtgattcagatgaataaagagtaacactggcttcgaccaacaggagtagggttgttaccttcctatgaaggggcccgaacctgtataaaaatccttgtctctatctctcttacctcaatctcgcatataccctggtgccagtgatccctatatcatacaaataccgtagtcgtgacctaaaatgacaacagtggcacgcctggtaggggattttggtgcttcaaggtttcagcgagatgagttcaagagatggattctccgacaacaaactacttgacgacttcggctgtacggggatacgactcgagcgaagtgcgttctccgacggattggagccctcatcacctcaagttgattttacgacaagggatacttcaatgacttcggctatagggggatacgacccgaacgaagtacttcccccgacgagatcggaatcatcatcatcaacaatttgatctatcaagaccatccaaacttcaagacacgtggcgtaacaaaagatatcaaattgtatgatgtcgaacggatacgcaacatggtaattggtagattggttttctaaattaatctgctaattttgtagatacatctagcatgtgtctacaaagaaaaaaattttcaggaacaattgagcactcgaataggttaaggtcaagtacaccccataatcgagaacgttctcgacaaaggccgagtggtcggaccaaacctaccaatgaagaccgacgacttatctcatgtatagcgtcggccatggctggactatttgagaataggttgttaacgaataattcctcgcaaatgttgtcggcttgatcacccgacataattgtgaacgcacatctagatatgctacaagttgggtatgttagtcatgctggccacatgagatgcacatgtaataaccaactctagcgcccctattggtgatcgagagatgcctactcctagttcttgaccagtagattgtagcgatctcttgccacctatcaattgccttcaggtgatcaagaaatgcctactcctggttaccgaccagtcgattacagcaatctctaatcacctaaaagttgccttcaggtggtcgagagatgcctacaactggtttccaaccagtcaactgtagcaatctctcgtcacctataagttgttttcaagtgatcgagatatgcctattcctggttattgaccagtcgattgtagcgatctctcgacgcataacacagcaaccgacgcagttgtgataacaacaaccaagaccgataggatcgccgtagtcaccaggacgacaacgtccaagtgtaggatcaaggaggccgactagaggggaggtgaataggcggtttttaaaacttttggctaaaaccgagttttgcatgcggaagcataaatcaaaatggttttgcacaattcaaaatctaaatcaactagtctcaagtaagtgcacaaagaagctagcctatgttgaggtttgcaccctaatagcacaaataaactctagtatgtaaacttgctcaaagtaaatttgcacaaaataaaggagacaagagacaaggaatttttcaccgaggttcggaaactcgccggtttcctaatccccgttgaggcgagcccaactctaccgctcaaccacgaagccatcgcacgccccctttgtcaaggggtgggcaagacgggagccagcccacggagaggactaccaaagcctcaatcactagggtagttcttcctacactccgaaggtggtaaactccaaaccactcacaatcggcgccgggcctcctccacaatctccttggagaggtcaccgggcaacacctccacaagccatctaggaggcggcaacctccaagagtaacaagtctaggatgcttgctgaggatgatcaagtgctgcactagctataacaatgaagcaatgcacttggattggcttaactcactctctaatatctcactagataaactaagtgcacaagggtatgagagctcttgcaagggttcaagataatgcaatggagtgccaaaaccttacccttgctgctggggagtgggtatatatacccccaaccaccaaaactagccgttggaactgaaatccccaactcagtgctctgccggtcagaccgccattgtgaggccggtcagaccggactactttttaacggctagaaaactagccgttacagggcaatcattgagcccactcaacctggtcggtctgaccgcagtatagtggccggtcagaccgtccacggctcggtcagaccgccgtcggcttggtctgaccggttgcggctctgatagatctgtatcgctaccaaaaaccagaccagtggggccggtcagaccggccttaccacgtaggtcagaccggctaacagccctggtcagactggcctaaggcccacggtcagaccgcatgtcacttttcagctcaaccgaccgttagtaaaacggcgatctctcttgactcgggtctcggaatttggcgttcttggactctatggaaagcttattcaaagggccatccaacccataaaaaaaccatccaagaaacacaacttaagacaaggataaagggctcacactccaaaggatatccaccggacatacccacaagaggctacccaaacctataggattttcccacttctctctttggttaggacttgagaaaactcaccacacttggctagacaagcccaccaaatacacctacatgcatatgaactaatatggtgcaagatcatccacatgctcgcttcatagacccctcttgatagtacggcatctatctagcaaatccggtctacaccaaacaccatgaacgggaaaagactaagaaaacattcttagctccattataccttttccttgcgccatccaacttggggtcaatgcttaagccaagatcaacacttgtgaccatccggttgaaccatgtttatgccgaggtctttaccatcctttgtcaagactttattctcatcacaattttgacttcattcttgccaacatgatgatgtccttggcttggtgaccattaacccatggtgtcattcattagcctcattatggtggaacctattccttttcacatctcaaaggagaacattagtctcaacaaatcggttgtcatccttcacttgatgatcaaccggttgcatatgaaagatatggatatatttgttgagtattcatttacaccacaagtgtcatatactcgtatgcaagctcaagtgcaaagatccaatatgaataataggtgaataacatggatctagaacatgcacaataaatgtataggattcactccccctaaacatatgcatacaaataaatttacaagagaggcgagtgtatgcataagtaatgaataaccaatggggtttatcctatacacatagagaaggcatgtagcaatgataaagataaacaaaaacacatacctacatgatctctatgttctcaatgtaaaggagactaaataagataaggctcaagaaaacattagtctcacacttatataacaatgacatggaaatcatatatatgaacctatcaaaatgaaagaaataagaggtagtacatatcgctttaatctccatgcatttcatccttgtcatgattaaggtcgatcaccaaagaatacatatctaccacatctcatcatcgggaaataacctagttgacaacttatgaaaaagagaggttaatcccataaacatcggtttatcatctatcaccaaagtaacaattacacaaattatttaatccaagatctttcaatcttttctttctttggtgacagaaaataaccggatataataacatagaaagatgacatgaacgataatttcaaatcaaactagagatcttataataaacaaaatatagaataagctcccctttaagatgtgcatatatatggatataaaggaacacatatgcacataatcaatcaagatcaatgagggagctcacgctatattttggatccacaagagagaccaagttagaatatgtgaagtttaatacatacctctcatcatttttattttcatatccaaatgagactagtcaaagaaaggctcataaaaacgttagtctcatataattagatttgtcattaatcaccaaaaccaaattaagggacttgaacttacaccaagactgatgacatcagagtgacaacagacgatgttaacgacatcacgacaacacccggtgaagacggaactcaagatccctagacttccagagggcccgaggacgaggccataggtccaggagccgaacccccgactactataatcccacatcgtcttcatcgtcgtcagaaggcggttctcgcaggtcacaaggacgccatccatctgtctcttcgaattctgttcgaatggtcgagagatgcctactcctggttgtccaccagttggttgtagcgatctcttgtacctcgacttctcatggtcgagagatgcctacttctggttctcaaccagtaggacgtagcgatctctctcaccttaatctctaattgtcgagagatgcctactcctggttgtccactagtaggatgtagtgatctctcgcaactcaatctctaacggtcgagagatgcctactcctggttgtccaccagtcggatgtagcgatctctcgcacctcaatctctaacggtcgagagatgcctactcctggttctcaaccaatcagatgtagtgatctctcgcacttcaatctctaatggtcgagagatgtctacttttggttgtccaccagtcggatgtagtgatctctcgcacctcaatctctaacggtcgagagatgcctactcctggttgtcaaccagtcggatgtagcgtctctcgcacctcaatttttcaagtggtcgaggaacaactacgtctggtctttggccaacagcgtagcgatcctagatacccacattctcgagtggtcgaggaacgactatgcctggttgttgaccaacagcgtagcgatcctagtacccacatcttgaatggtcagagtatggctgtatacctggttctcgaccaggngtcacaacgattctcccactgcttctgcaaagtgatggagaacaactacacactcggtcttcaccttgtgtggtagtcacctcatgaccccatatgcatcaacttctgtaagtgtttatatgtgtaatatttgtccgttgatccttttttcttctatcgcctcgtcttgaagttgatcatatcgtcctttacgctattctgacaaagcctcaagaaacctaaggggattccggctggggacgcccagagctgataaggccttgtcagatgctatagagccaaatgatcatgtcatatctagtcatgtcagagtgctccttggatgcgtattaactaagctgtgtaatcaggaattggttttcccaacttcatggccgggggcttcgatttcatcagctttagcttggtttgttataagatttaagctgcctttgtggaaaacgacttttccataaaaacggttgggggctaggaagggtaccatactccgaccactgagggcagctttagcgagaatactcttttattgtcacatgcaaattcaatttattcttaattttgaaatttatattatatcgtttaggggctatttgtatctaacaatctgttctgagttttgatttcaggaaagtcagacttcagggttttgtcgcagactctacaactacttgattactcgagaatggttagagtttgacaaggattacagaataaagcagaggtgtacccgccgagtccgaattttttaacttcaatccaaattctcaattacagtaagacaaggaatttagttgcatactccacaccttctcggtcatccgagaacggttaagcgagcatgacgacttttgttccatggtcttcggtcgagaacatcaactcgttcatttgcattgaagtcgggggctattgtcatggttatggatacatacccaatagtaatcgacaaagctcggtggggcccaccatatgtcgtcttatatggaatcatatctcgtatagaagggattccgaataaggaaggacaagtagagttttatatggaaactataaggactactcggattgtatccatattggtctccctagctttacttggacaagggaacatctatgggtattaatacaagaccccctaggaggagagaaacacaagccataacagaccaatactccgccaaacatcgatatcagagattagcctagacagacccaatatggtggctacggaggcagacaagagggatctggtgccacctcttatctcaacgagttcgtattcgaggaggaagactaccttgtcatcgattatgtgttggtgatccatgctgccaagtcaacaacagctagataggttaccccaattgttatacttgtgcgatttagatgaataaagagtaacaccggcttctgccaacaggagtaaggttgttaccttcctttgaaggggctgaacctgtataaaaatccttatctctatctctcttacctcaatctcgcatataccctggtaccaacaatcctcatgccatacaagtaccgtagtcgtgacctaaaacgacgacacaaactaattggcatgcttgcatctcatcaacctttggacctacactagagctaagcaaacctcccaggccgttgctgttgtcgatttagttcacgccaacatggttccggcaccatcagccaaatgcggatttttcgtcaacagcgggacgcgtcttttccgctggacacggttcggggagagagagggtggggctgaggcgccatgccggacaacggcacagtgcaagaggagtgcatgcgatggcgagcggtgcgtttcttgcggaagaccgagagactgaacatgctagggtagaaaagtgaggacgacggatggtatcctatggtactatacaagtgatccacactaactcaatttcctacaatcaatttcctacctatttctaactataggtgccggttttcgattaagaaccaatatctatagtataggtactagttttttgtgtaagccggcacctacgagtcgatacctatgtgggttttgtagaagtgagaactccgatacagtcttctacaaatgtatcaaatcgtagtaaaatctgttaaacatgccatgctcttggcagatcgggccaaaccgagacaattcttcttatgtttccgcttgcaccattaaatatgattttactatgccatccgagactacaatcaaagcttctaatgttgcaccagagagtgaggccaaggtagaagatgttaaatataagtcaaagccgaggacggctttgtttcaaggaagggaggatgatgagcccatgactcatcaagatgttcatggagacatgactagcgataattcaattattgtagctggtaattctctaatatcatctggttttcaatttaaagctatttattttgatgagaaatatggcaaaaatatggagaaatttactagcgctggtctatcatcaaatatattttttagaggagttaattttcacaagaaaagggaagaaaagaagcaaagaaaatatatccaaattggttgcattcaggtcgacgtcacatgagccatttttggggaccgaaaatgctgcatgcaagtgctagtacgaggtttataatgctaatgctaatggtgagatttgcatcgtggccggatagtttaatatatgtttctatctgttggtggtatcaataatgattagctatattttaattaatatgggtctggcatgtctgttatgggccagctatgcgctaattagagcctagttgggccatggtagagtcctgagtggtgtttttgtgcctgcgtgcatatatatggtctaggtctggccttgtaaaggggagattggttttttatggtggaattatttcttcgtcgagccgccgctcgggataccctagtggtttattgatccggatccttcggtggatttgcgtgaagtgcatgatcgagttgctacggctcgggtgcgtcgcttggaattatcggagttccccgtcttctgatcgtggttcgtcgtggccgcgggtggaaggattatcctaaggtttggtttgcatctattgtaagctgatccctctatctatcaataatattgctactgcttgtgtctggttgatcagttatcttggtcaatacgtgtgagattgatatacttggaatatttatcgtggtttcctgtggtcatcaagagggtcagtgcctatattgttgcattatctaattaaactaatgtccagcagccctgacctaattgaaggaggttgacatcgattctgctgctgctgctcatgctaatctaattgctgatttgctctgctgctgctcacgctaatctgagagaggattttagttgttgtttcagaaaaggttgtttgctgaatattttattgctgaaattttgtaccgtgaaagattgtgcaaaatattttggacatcgtaggcgtgtccttatcacagtgcaagttagatagcaagcttaatagatttattaaggtgtgatatgattgcataaatcgatagatataatagatcaggcaaagaaaaacatacaatcttaaaccaagaaggattatattaggtaggatcggctgaaactccgatacaacctttattggtaactatagggcaagtcagttcttacaattgtaactacaacttagtagatcaaacccaactgatgcagcaccaagttataattaaatttcataggtctaaacgagctgataagtgctatttagggtgatgggtacatcaatcaatctaagataacaatcttgtttagacagtatcagcctaatcataagtgaatcggctgactggaataaacaataatgttggcttagattaagcaatgtatatgataaataacgcttacactaactgggataaagtatcagacccaaccgagaaagccatagccccgctgatgcaagcgaaattgacagaactgaccttgtcatcggagatcgaactcaaccaatgcagcccaactcaaaaataaaaacatgttgagaaaaacctagaaaaactagggtggtgatgcgccgaaagttgtattattgaaccgttctttacaaaaaccttgggtatacatatttatacccgtaggcaaaatcaaatctgattctatcacgatcggatcaaactagaactccatctctaacttgaggaaactattacggagtccaactcctacacgacttgtattggataaacattaccaaaacatatctgagtccgattctaacacgactatattggctcagaaaacatagaaactaggatacattttccttaatcctgaagctagcttacccaaacttggatatttccgaaatcacggtgtgaaatcctcctttgacttgacctttgattaatgggagaatttactatttgccacactctcaaaatgccagtgctcaaa

SEQ ID NO: 39436 - DNA, 12667 bp, Oryza sativa
ccaaattttcattcccaaatgccacccgggcctacatgtcagcctcactctccattcaaacaaaagtgatgtgggacccgatgctgagtgaggctgatatgtgggctcgggtggtatttgggaatgaaaatttgggagagtggcatttgagcactggtatttttagagagtggcaaatagtaaattcctccctacttcgactacatcctcatcaccatggcttgtggcaacaatagcaatggcaacagcaccactgatggtgagaatggcaatgctagtggttctgcttccaataccaccgcaactaatgttgtagcaccgtatgtccgtattctcttatgtttaaatgtgttagatatgcttgtttcgatggtttacaattatatatagcatgtctattttgcgtaccactatcattgagagtaataagtttacggtttatgtttatatcattatggttcacattttttaatttctgaattaaatattatggcgaatttgtttggcagccactaggtgagagcaagaatattagttaactataatcaagctatatacttatgtggaagagagaggtaaagaaaaaagggagtgttggctctcatgcaagagctagctaaacacaagctccaaaaaatatatgtgagagaaaaagagatgatgacaaaaataaaactaaccttgtagctaccctattatacatatttgctctaatattgacttatagtaagtaatgagttctactattaaacttgctctgatcaggtacatcgctttttcttaggcttggcgctcatgttgaatgatgtcaggataaagattaagtgcgcacgtaaaacaagaaagccgttaacgcatgattaactgggtttttaattattacacacttaaaaatagatttatttgatatttagagcaacttctatatatagttttcacacgaaataaaccatttagcaatttaaaaagcatgttaataaaaattaagataaaatttgcatcttaattagaaaaggacgggccataatgtgttcattattgtatgaagtcctccgggcgctctgcattcaagtgaactgatagtttatctattcaaaacggtgtatacactgtgcacagccagaaaatccggccagtcactagaagggataccatcatctcaatcgagcagtaaaccccatctcaatcgggcacggcgtccgtcacaggctagaagttacagatgtgaagagttatctcaatcgggcaaacggccgtcacggatgaatctatctcaatcgggccctaattaaagcccgtcaccgatagctttgacccagacgaccagtcaaactatggcccgtcacagatgacccttatctgtgacgggcattaactatagcccgtcacagatgaccctcatctcaatcggacctaatttaatgccagtcacagatgagtataatccaaaaaaaactaaattatattttttggctagtctcaggcctcctaggttagtcttttttttttgtcctcacttgaaattcaaacttcccgatcggtcacccttcccgaaattgctccaagccaaacatgtttaacatcaaagttatttggagattggcttccaaaaaagtagttgtaacttgttggtatgagtattctattaatcttattaagtcctaggccaggatgtcaaattggggttattaaatgatttcaaatggaaaagtcaccaaaaccaaagttgtagaactcatcgaggtgcaaaatttttattttggtcatttctccatatggctctatttaaacaatttgaaattcaaagtttgaaaagttcaaatagaattttagatcagtgaacggcttcaactgaaaaagtcataaacaacaaagttgtataactcatcaagatctataacttttattttggtcatttttctatataacatttttttgaaccgtttgaatttgaatttgaaaatatgataacttcaaacaatattttcaaatactaaacgatatcaactgaaaaagtcatcaacaacaaagttgaataactcatcaatatctaaaacttttattttggtcatttcttcatacgacaaagtgatagtaacattgttcacaaaattgacatatctcttatttggttttataaactataacacatatatgtaaaatttgtgaataatattactaacatttcgtcagatgaagaaataacaaaagtaaaagttttagatcttgatgagttattcaactttgttgttgatgaccttttcaattgaaatcatttagtatttgaaaatgttgtttgaatttgttatattttcaaattcaaattcaaactgttcaaaaaaaatgttatatagaaaaatgaccaaactaaaagttgtaaatcttgataagttatacaactttattgttgacattttttctatttgaaatcatttactacctgtaaaattattttgactcataaaatgaattattatactgcacttaattattttgctatagttcaacttacaaatataaacatttcatatgaaaaatgaaaaaatagttatcggtgacgggctttagttaatgcccgatagagattaactatatagcccgtcactgatgattcatctgtgacgggcctagttgctatctcaaacgggcctcaagttggtgcacgtcacggatgatggtcatctgtgacaggccacaacttgaggcccgtttaagatatgaaatattatctcaatcggatataaagttagcgcctgtcacagatgatggtcatctgtgacgggccacatctttaggcccgtttgagatatggaatgttatctcaatcgggcctaaactgataggtgtcatccgtgacgggtttaagttttatatccatctaatatgtctgtgcgaccatatctcaatcgggtattttttggcccgattgagatgacttctttgtgacggcccgctatttctaggcatatcagagcccgtcacagatagatgtttggacactttacctagacaagtctatgtgcagattggcattttatttcatgggctttaccattacacgggcacacacggccagtttttttttattttcatttcagcccaccattataatccatgggctttgaatagtctaattcttcctgcaggattacacctgtaatttatttgaactaatggtgacgtgttcactagctttggcaggcaagtggattttatcctggcatacgtgtatactaggaaatccgcgcggcagttggggcgctgaaaatttatagctcatgtatgttttttttttccatactgcacgtaagacatacacagacacacacattacatgtaacattacattcacatcctcgcaaatacatcccttaacatatactctaacagacataaacgaatagtacatctttgatttcacttaaagttatgtacctaatgtccacctgcacgtgcctaatattcgtgaatattaggatttgaaccctggtgggtggtgtcaaacacccacgactcaactaccacaccactgatgcttatctatcaatcatcttgaacatagaaatttgtataatttttacatgatttagttatatatatatattagtttttgttaaagggcatggagcctagtggttgcagtgacctgagtagcaccctaaggtcgattgggttatttagggctaagttccctatttgatgggctaagttcctaattaaaaaaaatgttatatatatccggttggatatagaggccgggtaaaaaaaaaaccttctctgaataaaaaaaatatgggttagtttaatcaattcatgcacaaatcatatattcaaaaggatctttagtggattttaattttacgtatgtttgtcgaagtttgagatggatcaaagtagattagtgatttatgcgtcagtaattatccgggtagagattgtgctgtttaacttaatgagtatacaggtgcgggaaaattagcaagtatatatgttttcttaaattgcagtgatttcataaaacttgtaagttcgacatattcataggaaactagcagtaaataaatatttagaaatgtagtttataagaatgcaaaaaactttgatccaatattttacattatttacgttatttatgttagtttctttattaccttttttcttttctaaaaatatacgatatcaatgtagagtactcgcatcaattataacttaatcgtagttatattttatttatcttctgacatacgctgagttcggtagagtatttggcttttgcaattttctcatttaccataagcacgcttcctattcctttgcaaaacccaaatgctctctatttcatctccaattttctcctttgcattatttagtctcgggggtatgaaagtgattgagtgagtttttataggtgcacagggaatttactctaaattattaaataatatgttcttttgcaaaaactttttacatagaagatcttttaaataccaaataagaccgattaaatttataataatcaataatggttgccttgtattgtgtgccatggaaactccaaatttcgaactgaacgtagcctaatccgtatattgtatttatttaagtattattttgaaaattagttgtacttttctttgtttaaaataattgctcgaccaagttttcttaaggtgtattccacattagttctacccgttttactatagcacactttctaaactgctaaacaatttatttttacataaaatttctatagaatattctcaaagttctactcatttatttttagatttattttagctaatacttaattatacgttaatactaatgattcgtcccctctccattgacttgcctacaagcctttttttcacgaagcaatctttaatttttctccacgtccattcacgattttgtatggtctatttcggtatttatgcctatgatctactcggtcgtttgacacaactttaactctcaactccaacttacttagagttggccacgaaattgtactagggagtggagctggctttctgccgctctactgtcccactccacccaaaagacccatcgcctctttaatattttcatgtatttacgtgatatgttactaaaataccccttcacacccatctcctccggttctgtctctccttcccatgattcttcctcccttgatcagctagggctattttcatgtatttacgtgatatgttactgaaataccccttcacacccatctcctcccgttctgtctctccttcccatgattcttcctcccttgatcagctagggctaggacggctgggcggcgatcggtagaggcgactgatggcggcggttgggtggtgtggctgctgggcgattgggcaacgcgcgagggcagcaaggcagtggcggtggcgtgtgggctaaacgtcgatggcgtcggtagggtgacaatgcgcgggctgagcgacgacaatgttgatgtcgacagggtggcgcgcgggctgagcacggtatagtgcaaaccgtgggacccaaaaccatgtgttcgatgaattggagacgcaggacatggtggcgtggagctgaccaatctagccaaacacttttatgagctacggtgtgactagcttgagctcgagccaagcataggcttacgtgacttagggccgaacggcccatcagctggttggttttttttctcccgtagcacaacgcacgttagctcgattgattaagagggtgatgaggcacacagcacacacgttcttcaattcgcttgcaaattcactgcgccacgtagaccaatcaaaatctcaaagaacggctagctttagataattagatatgcccccacgttgttcaatagctatataaaatataaataaataaacaatatttcttagttgtatttcttttatttttatctgtgttcttagttattgaaatttgacactatgttacctttaaaaatgaattttaacattgcattattgtgactttgaaggaccatgtgaaacaataatacatgtttagttttttttttctcattgcttccatctccttgaacttgaagatgtgtgagggacacattcgtagttatatatgtgtggatgtacgccttcgatttattcgtgaaaattaaggttgatatggcccatcgatttatttgcggattgacacacttacacctagtgtagcaatagaacagattgtccgactgtttaatgtcgtgggcaggcaatacatagtaaaatgtgtggaactaaaagtaagtgatgaactagaataaccacatttaaacgaaatcgaattatatcgtcttcatatccccccggccccgccgcagacacacactgcaaacagagtactccatccgtcacacaatataagtgatttagaaaggatgtgacatatcctagcactacgaatctagacaggaagcctctctagattcgtagtcctaggatatatcacatctctctagaatcccttatatttttggacggagggagtagaacataaggtagataaaaatactacatataataataatcaagcggtaccattcatccctagatacaatatttctagagctttgcttaacactaacacacagctatataacctagctagcttcatgatgacttcaatatttctcgaccttacttaatactaacacacagctataacctagctatagcttcatgacttgatctaccaagctaggcatgcatatgcaagaacaagaaacagattagtcacaccataatgactaactaattatagattcatatcagctagtaatatagttcttctaggccctgatcagatcatgcaaaattaaattacttacctagtttggttccatgcatgcatgatacacacaacatatataacactcttctagttctaggattctagattgatttttcttcttcttttccccatgaagccatgcaccatccatgcattgacccattctgcatatgcctcatgacttgagtcatcacagtatatttccagacgttgacaagtcaaacgccggcaggtcggaccacccgccgccgccgccgccgggagcagcactgccgccggcaccatcaccaccgccacggtggccgccgccgcctccccagaactgcaagcttccacggagaccgaggaactcaatcggcgagctcgccgtcgtcgttgccgcagacggtggtgggtggttgtcgatgtcgtccatcttcaccgaggccatctgcgtgatgagcccggcggagccggcgacgctggcggcgttggccggcatgtcgccgccaaggccgcccgccgcgacgtcgccaaatggatacgataccccggcggcggtggacatcagcggcggtggatggactgcggcgttggatcgggctaagaacgggaagtgcgggaggcgctgccgttcgagcccgaggccgtcgccgccgccgccgccgccgagctggtagtcgacggcggcagccgcgtgcagcgagctgagctccggaaaccctaacctcgacgcgccaccaccaccaccaccaccgatgatactaccatggccaccgccgccgccgccatcaaacccgaaagggagctgcagctgcgcatgcggcggcgccatgacgccgccggcgacggcggcggcgggcttcttggagttagagggcttggttccgcgcttgttgcggcggaagccgccgccgacggggacgttgcggagggcgccgccgcgggtccagtagcggcggcaagccttgcagaagtggcggggctgggtgagggagtagttgttgaagtagcagaacttggtgttggtggagtcgcagcgcggacacttgagccccggctccggctgcgggatcttcgccatcctggcgcgctccgccatcgacaccggccgcgccgaggaggcgccgccgccaccactcaccggaaggatcccggcggcggccatgtctggcgaccgaggagcaagcagcaagctggccgaggtcatcggcagctgattcgcctccacactttggtgaagctgatgatggccatggtgagcttgatgctgctagtaacatgaatgaatagatataagaagtaattagataggaaaacaaaaggatgatagtagctaagactacaaccatatgagctagggtttgtgcaagagtagcatgagaatatattggcttgtaactttctatctatcataaattgataagaacatatatttgttttgcatattcttcccttttgctttacacatgaaaagaagtagctaagcaacaagctaatttttcacaaagaaacaaactttaattagggagtaataaggagttcagcactctctcaagaagggtaaagttcttatgtacctgattccacatgatggatcaagagaggtagtggagttgatcccccttttgatctttttctaacccctggattctccttttatgatcttcttctttaattttcttttttggtcctcccttgcttctttgtgagatatgtatgtcagggtgtatgatgagaatgctttaagggttcatgaatgcatgggggaggttcaattgttcaaaggagtggagaatgacatccactataaggtgatgaagaaggggatgagaacagagagagctagtgaaagggtaagatttggacaagggaactattctctctctctctagctttctacctcctttcccccccccccttagtgctgtgtgcttgtgcatcttttacatgcatcaggtgagagagatagagagggcaagaagagttccttagcttgtaagaatatgtacggcttctgccttcggcaccatagggttctgctagctatctttgtggataaagatggaaaccctagaagtatattgcctccattatagatgaatgatactagatgccatggtgcgtgtttctaaggaacactagttaaggttgtgttctttagcaggggtttctaactccccaccctcgtttttccgtgcacacgcttttcaaactgctaaacggtgtatttttttacaaaaagtttctatacaaaagttgcttaaaaaaatcatattaatccatttttgaaaaaaaagcaaatacttaattaatcacgtgctaatcgctgctccgtttttcgtgccgggtcccgaaggctctctttagtacctttacggtgctctccactggtattagaatactacaagattataagtagtattacactaatagaatttatctcaaccattgatttatacatatgagtagtgtaccatcaataatgcgataatataaatagatataatccattagatagaaaacaaaaatggtctagattggttataccaccagtagaaaacgttgtataacacccccccttagagaataccatagtaacatctcaccatcctcaagtaggttaattagatagccataatataactagatgatatcccacacgtttatgcgagaacttgtacaaaatgactgggataagatgtttttttcaacaatcagcaagaataattggcaataactaagtttatagtgggtcctaaataagctaagattgtaggtttataaaaattaatggagaatataataattgcacgcaacacacgttaacggttgtgattgagcataagagagatctaatggttagcttgttgtggctcactcatgtttagcatttggttgactatgtaaaagaaattattatgaataattacacgaaaataccattttttgccctcgcagtaccaaaaagacatagtaaaaaaaatatctatatatatttacgatggaaaaattgcccacacataaaaatttaataaactactccgtcctaaaatataagggattttggagggatgtgacacttcctattactgcgaatctggacaagagtctattcagatttgttactaggaagtgtcacgtcacttcaaaatctcttatattatggacagatggagtagaaaaaatgcccgtgcattgtaacgggtaaatgttattttaattttataattgttatacggtttagctagggtaaaattcactgtggggattcgcttgaatatatttttttagaaaatcataagctgcaattaggagtccacatttcatctcaagttagcatgatttttttaaagagatttcttatacgactcctttgtatttctaaaagcaaacgagcttaaaatccaactcaaacacgaatttgtatttccaaaagcaaacaaacttaaaaattgactcaaacacggataacgtaccaaaatactggcaaaaatatcttcagtttttataatagtagagattagggtaggcaaagttcgtggatacttgatcaacaacaagcagcggtagatgtgggggcaaaataagagaccagtagccccataaccaatagtccaattaatagtatctccggcctaaaatataaacaaatcatattagtatttgtattggcaaaactattttagttttgattgccaatatgtacagaattacatttgtatatgattgatattactaggttcacaatgaaaaatagtactttcgtaacatgtatattctttcaaataacatatttttcatagaaatcaaagcgttatcttggagagcatggtatgcctggaacgacttatattttatatcagagcgagtaagatgtcaaaactagataggaaaaaaatggttattgcagtagttggtctatggtgaaggttgtatccacatatgtgattggcaactaatgatagtggggatggtgccagcagcataattgcagcatatatatgtgagaaatcgcgtataagtacgaagaactttttttttggggggtgtctaccatgcaggtgcaaagaggagcaacatatatatatatatatatatatatatatatatatatatatatatatatatatatatatatgtatgtatgtatgtatgtatgtatgtatgtatgtatgtatgtatgtatgtatgtatgtatgtatgtatatatatatgtatgtgtgtgtgtgtgtgtgtgtatatatatatattttgaagttaggccgtgtttagtttccccatatttccaactttccatcacatcatatcacattaaaaacttttctacacacataaactttcaacttttttttaggaactaaacacacccttatttaaagaatcaaactggtaaactttttattgtcgatcgtgcaaaaaaaaacatgtggttgactattaattaccaggaagtcccatatatgaaaacaacaacttaatttatatatggccatatccacaatcacctgtactaatatataataaatctggcttagttactagtatattctaagaccctgcagctttctctgatcaaagtgaacaagatacacagtcttatgtatgctggtatatctaaccacatgtaacttttttcctttgatacgactattagcttttgtaacaaagcgataaagctggtatgagtaacttagctagatgctagatcgatctcttgggctcttgcactacgcaggtacaagcacaatgtataattcgaatcgttttgtaggtaaaatatatacatgctgactcacctgacctacatacatcctgggctgcgagcagagtctatctttagttctgtggtaaaaacttgttctaaaaaaaagttttgtggtaaattaaaactggtccttgttggtttgtccaaaaccaagaaaaaccattaaaagcgaccacttacgatcaactctgtaaaatttaaaatagctaaaatcgcttggtttttacaaaccaatcctactgtggtttcacgaaaagcgctcggttttcgtggaaacagatcagaaagctaaaccatgggtgtagtgccaggaagcatcttggtagcacatgttcccaacaaacgtatggaacacgcagagaggcaccatgaaattccttagtactaaccatcaatttaggtgattaaatttaatttgtaaatattttaaatattgttcaaagtttttgagatgattttgaaattttggatgattcccttccatgcagaaactataaaatcctattcctgatgatagagacttcacttgctcttccttattacataaccttttgggtgagttggctggtggctaaaaatcattacaacacatgtgatctattttaatataacatctggtacacgattcacctcgtcattttacttatccgagcatactacttaattaattaaggaggagcacgtgtgtataacatgtagcatcgagagagacttatatatatagcgatcgcaacacacatgtgcttttctttcttttctttttgcaagagaagagcatattgcatagattttttttaagggaaaaaggaacatttgatgttacagcaccacatttctatcaagaaaatttcatatactttccaaaaatacaaaaacttagaatgccacagattggcactggcgatatatggtactagtcgagagaaaaataccctgcaccattatttgttcctaacggcccgtgcaacacttctccctctttggatacataatcaaccattcatatggtagcagcgagcgacatacatatcaggaattcgttagcaagaaatccatcttgagaccccattaatttcgaaaatcctttattagatcggtcgccccggggga

SEQ ID NO: 39437 - DNA, 8872 bp, Oryza sativa
  unsure (1)..(8872): unsure at all n locations
tggaaacctctattaagggaatccgtttcattttttgttccaccaaaaatgttttaactagtgtactcacaatgtttcactatgtatagatctaatgttacagtaaattgaaacattcttttgcaacaaatcacccacatattatagaaaccctctattaagggaattcgtttcattttttgttctaccaaaaatgtttcatctagtgtacttataatgttttactatgtatggatcaaatattgcagtgacttgaaacattctttcactatctgctgaaacattgtttttatataaggtgaaacaacgtccgatttaaacgattgaaacattttcgatctacttagtgaaacaattccgatatacttggtggaacagcgtgcaacatttaaaaataattcaataataagctaaatttttttcatcggaatatatccatgcgtggtcttgttttaaagatttaattgcaacggatttaatggtgcaatctaatcatgatttggataaataatttaagagaaaaaaatagtgtaaaatagttttgcatacatgcttgcttgataacgtcatgctgacgtgggcacctgatttttcccacccccgatcgggcgcccggcgcgtagtcgtctcgcattaatttcttctccttcgaatcatatagctcttcttgtactttctcttctttctcaatttgtcttgaaaattagaggcgtatgtttctgttacttgcccgactatttccttctagttttgtggtatttccaaatgcattgggaccatatcgcagtattttttgaaaggtgggatgtttttgtggtatttattggcactagctgaaattcttctattgatgataaatttaccctttctatatatgtacactagctaagagaaggaaacttataccgctgccatgtttataatgtgtggtagctagctattccttgacacttattgttctgatgtaacggtgtaagtgttaacactttcaggccaagccatatatgcaacttgttgaacgccttcattttccaaaacacaatcatacacatacacattataaccaagtgtaaattaaaccgtttgaatgcgtccgagagttttcatttccgacaaaataacatctgaaacaattaaaagctgctgcttcgatcttttcagcactagatcgatcaagctccgtatcatggagtcactgctagtctcttctactgcttgccaacaaccacatcaacctgagcaacaacacactagtcatgaagcgtcctattcttcttttcacatctcaaagacgagctaagctagctctctgatccattgcactgtatatatatatatatatacatacatacatatatatatatatatatatatatatatatatatatatatatatatatatatatatatatatgattgccatggtgattgggaggctacgacattattgaataaagcagaaaaagatggatggatagatggtaagataggatgcatccatgaaggaaacacaaaagcctgtacacgtccccatgtccagatactcctatcagacacagctaagtatgagacgatatgcatgctttccttttcgctcggagtgagaggagagattctagcagcttagctttggtagcaatgtagtacggtgatcacatgcaaagcaccgaccaatgttgtctaaggcaagtactataccattttagcattgcaagctagctcttgcaagtaaagctagaaggtcaacccaccaaaggcgcacagtgtacactaatgcagaactgatcttttatcgtggtacccaaaacacaaatatcttggttagatttagaaccggtactaaagatatttttagtaccggttctaaaagtccaagtcctaaaaacatctttagttccagttggtaacaccaaccggtactaaaaatacatctttagtaccggttgggtaacaccaactgagactaaagatggaggatctttaggtactaaagatgcctataggggttagttcaaaacaaaagtatctctatccaagtgatatgtgtagtaggtgggatggtaacgcctgtggccaaagtaagagatcttaagttcgaatcccacatcccacatatttttttttgacttcgtatgcatctttagtaccgattatttcaaccggtactaaagattgagatctttagtctcgatttgctacaaccggtacttaaaagggttctcaaccggtgttaaaatcagttctgcactagtggtaccagttcaaccattcgatcaccaaggagtttcccctattgccatcactagtgaaaatgtacacatttgtgataaaatattatcatcatggcagatgctaattctatcgtaaagaacttcccgtgatgaaatggtgatgaatttgggttcgtaaaaaataaagcgtcacattggtttcatcatgacaaatcgtcaaatttcgtcatagaactcagctcattttatgacaaaactatgttggtcgtagaacctaccccttctatgatgaaagctactatcgcagaaattttggcatcacatcatagaaaaaaggaagatatcatcatagaacggcttgttggtgtgacgtggctaagttccactccgcatcatccatgcgtgtaactgtttattaataatatgtacaaattttgctatagcaggctactctagttttatacctttatggcatttgtagtactaaaaatgcatctagaagtcctaagtgggttttggctaattgatgctaaagcgattaagggactaatgtggttttcaagtacatgagtaggcattagcttcattggagaaataatcaataacacttggtaaaaccctcaaaacaaatgaaaaggcaacacatgaagtttaattcattttatcttttgaaatagagttcaggggcacacatacgaaagacttgctagctagcatttcagtgctcaaaataatcctttgatctttagatgagagacttgcacaacacaaacatggggttaaaagttttctctaggtatggagaccaaaaatttaaggtaaatgttctcggctgcaagtactactggcagggttttcaatctcctgctatagctgccgctatctcccgctatagttgttttagaaaggttccagctatttgctctcatgtacaatttagccactatagctctatttagcccgctacagatgccgctatagctgtttgacaagctaaccgctaaatgccttagcctgctatttaaaacggtgactactggaagccctgatatggagaatgttttaattatgtaagggtcttctgttcagccttgtgccttagacaagtttcgagtgtcaagatcggaaattctagtcatatgcactctttgtttggttgagaggacctgaagttttgggcttgaatcgaaagtttcggtcaagggttctcattttggccgaggaggcttgacggggtgtttttgttcttctagctggaaggttttcaaatatgtgagtaatgatttgttttttagggctggggttggctgctttccaaagttgaaccctagctcatagcattctagctctctcatttcttctctctttgcatctagtgcttctagtgagagttggattgggagattttgggggatttgtgcttgtgagatccaattgagtacttgagaatgtttttttgtgtttgttactcttagaggatctcatcctagatggttagctgttacccatcgattggtgagaattatggttgagatacctggcacttgagagtccctcaatagagatataagatctatggatccaaacttcagtaaacaaattagttgtctcatctccctctttactttgagcctttgtcgcttttgtgcaatttcactcattctaatatgtgtgcttggttgaactagtcaatgactttgattcatgcttgtatacattttttctgtgggttgtttgcagcagcgacaaaaaatatactaggctacaggcttgctcctaagtctggtagtgtcaatttgtcaccttaatgttctttgagatactttgtgaggttgagtgaattttggagatttaggtacatttcatctagagcttcattcttgagcatttgagttcaacgccaagctcgtgttcgtgtttgttactcttagaggtattcctcataggcggctaagcgttgcgagcaaacttccaagtcatgtggagagctcgggaaagtttgtgaaggttctattttgcttccacaaagaaaaggggtaaattgagttgaaactgagcttgatttttgtggtcccttggtgaggttgatggttaaacgtgaccgagcccctcaatagagaagtaggatcgatgatcccaacttgggtgaaaaatccttgtgtgttctatctttttaccattcttacttttcttttgtatcgatctatgcatgtggtagcttgaactaacttgtagctttgcttttacaagttcctaacatgctagttaccttttggttctagtagttttagggtttgtgtttggtttagctcgagctagcttgtacctgctttctatgcaccggcagaacatctggaggaatgatgcctggaagtattgaccgattgaacaaaagttccaacaagtttaatccactgcgaaaagaattttctggtcaagcctattcacccctcccatcctctaggttatccaagtaactttcacatataatcctctaatattgttactaaaacaaactacatcattatttcaataataaatcatggtcaattggagaatctaatacttgaaacattagactccaggcggatctcgtcatcaaatgtgcggtcccaaaattgtggaaggttaatttgtggatgccttaggcaccggaggacacatttctacaaacatgtagggtgcaacttgtaaatgcctcagtctccactcctactcacttggggatgaattgatttagtttattttacggatatcataggttcatctaaatgcaccccctcaattattgaaatcatcaaaaatacctccttaagggcaatacaacccaattttaacaagtattttcatgcttttgaaacaaaataatagttttcctccttgtatgaaacctagttagcaagagattaaaagtagttaactaaatataagttgaaaacatatatttggatgtcaaaatcatgaaaacccctattaaaaccaggttgtattgcacttagggggtatcttgatagttaatgggtgtaaagtgtttgggtttaatagttgacagatgttttatagacaagcacaatagttgagaggagtaatgctgacttacccctattttaaaatgggatcatcgatctatatttcaagtgatttattttttttctcatctataaatgaatcattgatatgcatttttctttctgtgaacaaagaatgttggaaaaaaaatacttttgtgtttatccttttcaatttgaaagggaaaggtgcgattaaatggatctagattaatccaagaagtaaaaaactcgcaatatatttatactaaatggcatcaccattcatggtcaacaaaaaatattacaaaacaagtttttataggtcaacttttgggttatttcttgctcaagtttaagtatctgaggtgagttaaaatcagacaaccaataaataacaacgtactattttgggtcctattttagaattagagtaaattacacacacggtgtatcaacttggcatgtgggtgcaatttggtgtaagaacttgagaaatgagtgttctaatgcaacaacttggtaggtatgtgcaatttagtataagaactttataagtgatcgtataaatgcaacaacttgtgagatatgtactattttgatacagtaaactaagaagttatgcgacaacttaattatttagagcatttttatatagattcaattttgaagcaattattttgacaatatactagcgtggatttgtataagcatatttatatttttatcctaataactaataactgaaagtcaattaaactggatataaaaattattatatttcggttgatatttgagaaggtgaagaaaataaaaaaaaatctgaaagggatgtaaactgtatgtgcagtataaatattaaagattaaattcaatatttaaggtaatatccgtaggattactatgtaatggcatattgacatcgtgaaaaagactcaccttttagccaagttgatgcaccaaaatactaaattaccaagttcttgtactagaacgcatccacttgtcaagttgttacacttggacgttcaattctcaaattcttgcactatatcacacccacctgccaagttgttgtaccatttgtacaatttactcttagaattaagtccactgttaatgttccttgggcgactctcaactattattgacccactgacagaaagggtgcggctcatgcatgtatgcaattgcagctttcattcaaggttattgatgtaaacaaagttcaaacacagtcataccttcgttcacatttcatacacatgttcatggcttgattgatcatgtaaacgaaggtgcacagttgcacacatcaatccacaggagaactgtagtactgtaggatgaatatggtgcttctttttttttttgaattatttgcatccctcttatgaaagtacgatttctgcaaatacttcttatatcagcattgcttaattacagcacttgttctgtttgtttgcttaattcaatagcttctctatgcatttgtttctcctctaattcaaatggagtcaacatattacaagatattggacggctcgaagcttctctacatttgttttctttactctttatcgatgaataggatggcaattgatcatgatactaagtaaatactctctgtatttaatattacaagtcactttagatttattataaatcaaatatcttttaagtttgactaggtttgtagaaaagtatactaacatctaaaccactaaattagtttcattaaatttaacattgaatatttattatagcatttatattttgtgttaaaaatgttgctatatttctttgtaaatagatgtttcacttgggataaatctaaatagacttataatattaaatggatggagtagcttaattaatttctattatgaaaaagatagcgtctgtgatgatcccacttgtagaatcttagctgtccaagcaaaggaacattgattggaacagctaaagagcggacattagaagtgggaagccgcatccagtcttagcccagggaaactggctcaattacctttgatagttaaggggtgtagagtttttgggtttcataattgatgggtgttttatatacaagcacaatagttgagagtagtaaatatatgctgacttacccctattttaaaatgggatcacctaagttccaagtgattttctttcttatttaccaaccactcttgatatgcatttttttcttgttgaaaaacaaataatgttactaaattatatttttgtgttgatacttcttaatttgaaaaaaaaaatttagcattaaatggatatagattaatccaagaaacaaaaaacaagtcgcatgcaatacatgtatactaaatggcatcacaattcacagtaaaaaaaatattacatcacagttttttatagttcaaccttttgggttatgtcttgttcaggttcaggtcactgaggtgagtaaaaaatcagagaacctagggtgtgtttagttcatgctaaaattggaagtttggttgaaattagaacaatgtgatggaaagttggaagtttactccctccgtccttaaaaaaaaaggcaaaccctgagtttccttgtccaacgtttgactgtccatcttatatgaatttttttataattagtattttcattattgttatatgataaaacatgattaatactttatgtgtgacttatctttttaatttttttcataattttttcaaataagatggacggtcaaacgttagacacggaaactcagggtttgtctttttttttgggatggagagagagtatgtgtgtaggaaagttatgatgtgatgaaaaagttaaaagtttgaagtaactaaacaagcccctagaactaacaaaactaatttggacctgctttagaataaagtcagctgttaatttatgctgactgaccccactgacagaaagtgtgcggctcaggtatgtatgcgattgcagcttttatgcaaggttactgatgtaaacaaaattcaaacgcagtcataccttcgttcacattccaaacgatgtaaacgaaggtgcacatgtcgagccagacatttggttattagttttatcgcaaggaaaattgtagtaatgcgaaaaatctattcatcccttaatccccttgtttttcatgtcatgtaaaaagtcatcaaaaaaattttaaaaaaatttagtatgatagatcaatatgtgatgtgtcactttcacagacatgcatattcaaattcaactaattatataagtagaaacaaaaataacaaatttgactatgaatagaacgtgtaattcacggtcaaatttgttatttttgtttcgaattgtataagtcaaattttaacttgtatatttgcgaaaagatatatcatatattgatttatattgacaatttgttttaaatttttttgataactttttgaacaccatgcacgaaacaaggggatgtcccctcaagggacgaaaatctacttccgcagtaatgtaggttgtatggcgtgatttttcaggattgcaagcatattgttttgaannnnnnnnnnnnnnnnnnnnnnnnnnnnnnnnnnnnnnnnnnnnnnnnnnnnnnnnnn

SEQ ID NO: 39438 - DNA, 1241 bp, Oryza sativa
  unsure (1)..(1241): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaagaaccgcanaaagctcttgttcnnncctcatgacatgaatctgagtggaaacatattgcaacaaggtgctataatggccaatgcactcatcgtcaacgaggaggatgaggcatgtcgctgggagatcctagctgaggtgtgggctcacttgattgtgcacattgctcccagttccagaatagaagctcatgccgagaacctcaagtctggtagcgagttcataaccgtcatctgggctttgttttcccactgtggcatcgagaagagcgaattatggcagtagcagaaaaagggtgcagagtctgggaacagcacttttctggattggctaaccagagcagtgatgtagcagatacccatgttcaggaggctggtcctgattctggcatgtcctgaaacctgaattgctgatggctgatgctcttctcccctcgtgttttcagttttcaataatgggtgtgtttcacgccaaaattagaagtttggttgaaattggaaagatgtgacggaaaagttgaaagtttgtgtgtgtaggaaagttttgatgtaatggaaaaattgaaagtttgaagaaaaagtttggaactaaactcggccaaaatctgcatctcatcaaaccgattcctattggctgtagctctttttgagtaaaggctgggatgttatattccattatcttaaaaaaaatcaaaccaagatcatgttcttcttccaggaagaagaccacatcataaaatgataaaatactggcaaagacatcatgaaatgcattatgcatgtgaagatgtgcttccaggaaaaagaccacattagctctttcctcttcatcttttattatcgagataatccattaaatactatcgacaagtgtctaagtcccagaaataccatcgataagtgtgagttccaagaaatgccatcgtac

SEQ ID NO: 39439 - DNA, 9677 bp, Oryza sativa
tttggaactcacacttgtcgatagcatttctaggaattagacgcttgccaatggcattttatggattatctctctattatcagcaagcagttagcatgtactattatgttaaaggacttggattcaaaggctatattcaatgactctccagccttcagatcatatgattatactattataaatgccttcaatcagtctagtgtgaatttggtagcgtgtacttcagaatatatatagctattgcagcaagttgatgggggactatgaattatgtaatgcctgttgatgtcagaccactccaaatgctgatcatccaacttgtttagcttcaacatcatatcatattagtcaaaagattaaaaaaaatagcaagttgatcatatcaggaccaaagaatcacaagttttttcctcaaatgtgttgcaccttccatccaacactccaccagcctattttgtagcttactgctaaaacaaggccgcagcattgagccattaaccaactactgtgtacaacctgaagaatgcctctactacctcccatcctaattcctaaaatacatttgttttttcttttccgaacaaaaacacttttaacatttaaaagacaaattaacagaaaagaaaatgatctacattcccctcatcaaacgaggggtgattggcaacaagataaagagaaatttgaatgaacacgggcggccgatcagtgacagtctgacagacaattcagagtgaacaacattctgcgtgcgtgcagttgtagcagctcaggtaaaagagagtgcggttgggtccccaactccccatccaccgtccgatcaatcttgcatggcacagatcgtgtccacaaaaataaagtagtattttttttctcgaacgcgcagtagggttgtacatcaatatattggaaaaaaagaatatttgttagacaacgcaatttgctagaccgacttatgcagcgggaaggggcagagcccactactctcccaataaaaccccaaaattagtaatgccagctaacgaccataaatggctctctgaaaggatagactgtaggacctccgagaccgaagataacgcagagtctagagtcaaaaaccttggagttccgttccttccacaattgccatgagaccaggagaatcagagaattgaagccggcatggtgatgctcagaccaagtatgtcctagacgatggccaccaatcttagaggcaactacaacggggaggagaaaataaagtagtactatccaagtgaaaattttgataacaagcccttgagttgcttatatttacagaaacaaaggaccaaagtgaaaatattcaccgccgccgttgttctggctgtgggtgtgcctccggcctccccggaggaggagatgggccgtcgggcggcggaggagcgtcggcggcggagaaccatggcgtcgcggctgccccgtccctgagatcaccggtacgcctcctgccctgacccacaattttactctcttgtcgtgggggtgcattaacatgtcatgtctcttgcacgctgtatgttcgacggaagtcctgaaccaaaaacttctttgcttgtgttatgtggcactagttgctgagcaggtgaggtgagcttcatgccctcagagttcaaatgctgtccatgtgtgcccactggtcccggaggaggaggagattagccgccgagcagcggcggcggagacgcatggagtcgcggctacccgtccctgagaatgagatcactggtgcggcttctaccctgatcctccattttactcttttgtcttgggggtcgtatctgtgtgtcatgtctcttgcacgttgtatgttcgacggaaatcctgaaccaagaacttctcgattgcttgtgtccagtctgtgtagatatagtttggttcgcaattgagcttcacacccaccgagtccagatgctttccatttgtgcccaatggtcagcatgtagtggcgcagttggtgagcctgataagaactaatacacttcaagagtatttcataggataactaactaaaggaaagacaaatcagttccatgtagcagcaaagcttgtccttgtcctgcaccgagcatattctgccctttgacagttggttaatcaaatgctatgttttctgtggtctatttgtaaaacaagtttttgagaagggctagaaatgtaaaaacttcagttgaaaagttttagtcttataaaactaaaaacgtaaacttcaatgctactactggaccgatttcatttctcaagagccattttcatgaaactgcaccttgattgtttagatgttaaggacaatttgcaagcggtaggttggcgtgttgactctgagttagtcaggacaacaaaaccaacaaggcaacaagacattccctgttcagttgttcctttaatcccatcatctacttcgctctatcaatccgaggctgcaaacaagaagctagctgtatcttttctctgaaatctgatggagaaggcggcggcagcgatggtggtagcggcagcggcgacggcggtggcggttgcgcatacccttgtattttggctcaaccgcaactcacaggttgctttcctaagtccctacctcctcaagagtcaagaccttgtaaaagttcaaaccgtgatacaaattaggaatgcttagctatgattaatcgcaggctgaaaggattctttcactggaggcagacctcaaccggcaatctgagaatacagtaagctcttacggacaaattatcactacttttatatttttattacagttcatctagttaacgtatcttccggttcatcaaagcaactctattatgggtttttagcttcaaatagttgtttttgacaagttagtgtgcgtgaaactaatgcaaatgttacccctcctctgttgaacgcctgataattttaccaagatatttacatgttactttgtcaaaaagaaaaattgcagattcaaactagtaaaaactcatgataaggtcttctatttattgcagctcaaagaaaaagaagagcatgagaaaacgagaactgagcttgaagtaaaggagaagcaacttgaagaagagagacaaaaccacacattgactgtccaaagacatggtgaagaactcgaaaggcagagcagagaattggaaagacagcgcgaagaactagaaagacagggcagagaactcaaaatgaaggacggaaaactcaataggatgaaaaccttgacaatagtttatgagaaattccgtcaatggattgagggtgaagcttcaaactccagtagtggcttcactgagttcagtcactcagaggtagacgattcaatcccaaaggaccaaaaatatcatctcgggaaaggcagttatggcatcgtttacaaggcagaacctcggggcaagactgttgctatgaagattcttgataagagtagctggcaaggagagcgggagttcaagcaagaggtgagtagccccagaaaaggtcaaatactttgtgagttagtattctatcattactactttgtgaactggaagtgggagggagtataggagaaagggcagacagagattattgggacttctttgactcatcaatttattcttgcttcatggtaatagcactaacctcattgtacagaggattctaccaaatacgggtaagatcaatctaaacaataagatgtcaaacacctaacccttatcctagaaaactaatcaaactatttaggaaataggtgacattcagaaaagggtatccttagagttgagcctgctgctgcagtaccagcgtatactgcttttgtgaggtacttatgcacagtctactttaataactgaaatgaatcacttccaattgaggtagaccatagacactgtctccaatagctcaaaaaagacgggtccaacagtttagattgcagagttcacctttttctccctggcttcacccttccaagcaaagattctagcaccatttaacttcttgcattaccttttaacaaacctaatatttatccaacgaataaatctaacatgcattattattcttaacaacaaaaattctggaaatgcaggtggggatactcaaaaggatcagacacccaaacctggtcattctcctgggagcatgcagtgagaaatttgcactcatgtatgagtttttaccttctggcacccttgaagattgcctcagtaaagaagaacgcaaggaatcattctcatgggaagagagtcagagtggcaaccagcatatgctctgctcttgtattcctccacaataccaagcctaatccaatagctcacggtgatcttaaaccaagcaacatcctcttcgatgcagaaaatgtatgcaagctcagtgattttggaatttcccgtctgttacagcacagcactgacacagtaatacctaaccatattacagaagtgccaaagggtagcggcccctatatggatcctgaattcatgagtacaggcaaactgactcctcagtcagatgtattcgctttgggtatcatattgctgcagctagtcacaggccaaagtgcaaccggcctaagaaagcatatggttgataaattggaaaggcaaaatttggggaaaatggacacacgcaggcaaaagatgatccttgagaaacttcaaatcttggatgataaattgaagttggacgacaagtttatacaggattctataaggatgctgtccctgggcctaagatgcagctataacgaaaggaaacggcgtccaaacttggaagctgaagtttggcctgagattgagtcaatgaataaatcagaatgcctctagcggtaagatgaagttgattgactggtgtccattgaaacaagtaattgctaagaagcatagcagataaatcagttcttttggttgcaaatttatatattctaaatgtgtgctggaactaactctgtactcgataaaatctccctatatgttagctgaggttcattaattatatgcagctatgcagatgaaacctcaagcctggactgtttattttgtttatgcttaatccgccggagtctgattgtccctatatgttttctgtagtcgacttacttttgtcccaactgttgattggattatttgtttatcttttttgttgttgattttcctgtttaaaaatttattttcatatgatattgcttgtcaaaacttcatatttgatcaatatagaaatttgttattgaattccagttcatgccatgcaaacaccacattttgcagagcgcatggaaccaccttgatctgtactaccaactatttcaagaatttcaataattatatgcaccgttgatcttctagctctagtaagcaccgagtgatacaataatcatcaaggaacataatacaatctcaaatgagtaaaatggatatcacctccaccattgaggtttgctgaggttcatttgatgtcgcgattccggtatttgcaaagtatggagatcgttggtactaggatatatgcgagactgaggtaaaagagacagagacgaggatttttatatagattggccgaagccggtgttgctctttattcatcataatgacaccagtacaatatttggggtagcttatctaagtgttcgacatggcggtctgaaggtctgactcgtagtcgacaacagggtagccttcctcttcgaatccgcatccggcgagatcagagacagcgctatatctctcctgacggtatccgtaggcaccgtaggggactagccatgcctatctttgaagtcgatatccggcgtcttgtcttggcgaatgttggcttgtatgttgtggcttctgttgttccgtgtatgttgattgtgtcccctctcctcctagggggtcttgtatttatacccatatgtgtccctttgtccaagtagaactagggataaggaaaccaatatggatataatccgaatagtccttgtcgtttccatgtagaactctggttgtctttccttatccggaacttcatctatatccgaggtcagtgtccctataagacatggtatgtggtgggtcctaccgagatttaatcaactactattaggtatgtggtatctataactctgacacattatatgcaactatgcagatgcttaatctagcaaaataaacaaattttggcacaatctattactaagaatctggacatgcatgcctcctgtccaattcgtacctatccagaattccagattcatagcagatatgtgatgtcccatacttttttttattataggtttgtttatttccaaactattttctgtagtaaaggtttgtttatttgagacagaggaaagactacctccatcccaaaataagtttatttttggatttctatatccaacgtttgaccgttcatattatttgaaaaaaaataaaacaatcagtcgcacacaaagcgctattcatgttttatcatctaataataataataataataatcatatttttttaaaaaataaaacaaagagtcaaactcaaacattgtatcaaaaattgaaaaataaactttttatgggacgaaggtagtaggtaataagacaagttttgatttctgggcccagagccatctttttctatctgggcctaaaagcagaagtgggccgaccaagtggtgttgttagtactgggctgcaatttgcagaggcaccggaatggtcgaggccggcggcgcagatccggcgagcggcggcggcggaagctgatggctcccttcctccggtctcccagttgcttttcccccattttctccgctgtatccgccgctcgccggcggggagggaggtccggaggaagtgaaatggcggcagtcgcagcggtagcgatgggggtcaagtcggggatagtactgcggcggcggcggcggcggcggcggtggtgagcgtggccggcactcgaggagggcgctccacgggggcatgcttgctgggtcggccatggccttggcgtctcgctcaatgggactccatggtgcgatgtggagctctctgtttctctgattcatcgcggtaaaattttcgcagctcagtccgatctcctcttttttttttcaaaaaaatatatattccggtgcatttctcctcaaatcatgaaataatgggatagggacagtaatcctagattatcgaatggagtaatggacaaacaaatcatggaagggaacagcagttttgacttttgattcaatggttttcttttttatgtaactcgaatagttttctggtatatccagatggatgagcaagtacagatccgacacctatacctgccatattcagtctgctcatgtgaaagctggacatatgattttttttttctgtgattgcttccaacaccattgcagtattacattaaaactgctttggtcatagatgcagagtgtagcaagacagctctgccagaattttttattccgtggcaaacgccatattttaggaagtgtgttaaaaataaagactcatcattcatcaaggcctctaccgcgggatgcgtggttcaattttataatcgctatatcgaattggaggtaatggaggaacttggcctatgacaacttgccagtttccagatcccagtgctgccttctcggctcaaggtcttgcctagagttctctccatctgcccgagctgtggataatacgccatgagaagctgctgaattctgaatgggtaagattgactccttttcgccatactaccgcagtttctgatgcatctgtattgcatgcttgaatcacccgctgcctggatttttcttgtagctgccagcaacagattgcatgaaaaatataacatgcttgcttttcactggctctgtttgtgcagtcagagttcgaaatagcagctgcttggttactggttaggaagagttttcttagtagttacagttttttgcaggtcaaaagcagagcacacattgtcaacaccattttaactgacacaagattgtcaggaaatcataacaaggtccaaatagatagataaacattgctgtggaccgcagcaaggttgccaagcacaagctgaagcaggtacacccatcgtttgctctactcattggctaattggctagaaagtgctacatagatttgtgtagattgtgtcatcataagctaatttgtccattctatccaaagaattgtagcttactgttactgactactgatcaagagaaggatcaaaccgtatagtgaatgaaatgcacaagcaagaagcctcactgtatataaatatttttaaatatggccactaatatattttcagatttctagggcaggtcatggaaaacctcactgtatttatcttctacctagaaaagcagttatattttgggacggagagagtatttcactaatcaataataagttgaactataaaggtaactatattttgggacgaagagaatatttcattaagcaataataagttctccactttcaaatattgattattcgttagcaccaccacccatctcatcccatacaggcctgtgaagcatgtaaatcttgttacaatggtccagtatagcattgtcagcataagttcatgacccttcattgcacttgttatatattgtgtaacctatatttctgatgaagtttctctataagtttaatttgccagggtctgcggttaattttgactacacacttttctgtgggaaaactaaaaatgagtcctggtgctcttattgcaaactttcttatcaaatggaatctggagagctatgtcttgcttcgcatccgagtcataatgggaatcctcaccatcctctatctgatgttcttcttctcaagccttttcttcacccgtatatacagatccatggtgaacttcctggatcctgtggctgacgccacccttgtatacattatgggggctatgcaagctgcacctttaaataaccagctgttcccagtctgggcccttatactggttggtctccgctctagcatccatggccgctctagttctggaatgttttttgagctgagaaatgtgttgaagcttttagttgtggcatacatgaatttaacacgtggctccaaattgtggcgttttccattttggttcttttggggtcttctggtacttcagtgcttctacaagattctggtgcgccatatagcatccaagtccttgtggaatggtcgtagttcagaacttcttcaggagtacatgggtgccaatggtaacaagagcaactttaatcctgaaatatgcaacccagagactatggaaggatacaagtacttggtttatggagagttacagaaaagccgaaagagtgcacacattctaaaagttgaagacttgaagtccctagttaccttggacaagatttggcgatgtgatagtgccttgctgctaacctccatcaacatgcaggggaacaacatgaaggacatggccctggcatttgcattatctcggttgctccggtgtaggctggaaggagcaacgttgcatgaagctactgtttccatgacccgaaagctaatcagcaagatgatcctctcagatagtgctgacaaggtactgttcggtatcctggagctggatgtcaggttcctccgggattccctccactccagttatcctatggtcttctgcagagggcttctttcgctcttcttcactcttctgctgtctttg

SEQ ID NO: 39440 - DNA, 1891 bp, Oryza sativa
  unsure (1)..(1891): unsure at all n locations
ggtgagcttcaaaaggcatacacagtgtcaaattgcttatcatggtactgtatgtacctgctggcttcaaagcccaaactgctcccagaaaccattttgatgtccaagaaggcctttcaagatgctgttcagtgtgctcatgaaatgctcagtgattgtcactcctggcagagcatatacaacaagcttatgaaagaggcgcagaaagctcttgttcaaggtacgcatggtctaaatctgagtggaaacatattgcaacaaggtgctatactggctaatgaactcatcaagaaggaggaccaaaaatgtcgttgggagatcctatctgatgtgtgggttcacttgcttgtgcacattgctcccagttctgacgcagcagctcttgccgaggacctcaaatccggtgtcgagttcgtaaccgtcatctgggctttgttttgccactgtggcatcgagaagagcaaattatggcaacagcagaagagtgcaaatttcaggaacagcactcctggaccatctaatcagagcagtgatgtgtctacccatgttcaggacacagtcagctctagtccacctgctgctcgatcttcagaaattcatgtagaggctagtcctacttctggtatgtcctgaaacctgaattgctgatggctgatgctctgctcccctcatggtttcagttttgtcggtaaaatttgcatctcatcatgacatttgaacactagtatttgtttcttgtgtgaatgttttctgtgttgtgattgtaacaggggaatgctcttgatgcaatattatgtgttatgcactttttagagcgccatattattgtgtgtgttgtgattgaattactctggaaataatttgtgtagttgacgtgcactcgttatttggaaataaattgttttttttttttgagcaaagggcgatgccctccatttccattaaagaaatgtaaagattcttacaagaaacagagtctgaaaagcaaaaaagacatcatgcctaaagcacaagctagagttttcctaaagagaggcctccacttctaccacacagagccaaacagaagatcaaactacctagtaagacaaaagcccataattgactatctccagtaaacgccatcagccattgagcagtcttctctgtccaagacgccacccaaattgcgatttaaaaacttcacttgctatttgctttagcaattgtactccccattgcaactttccttgcctttcctccgaactctgcaaaatggcccaatccaacattagagagcaggcattatacaagatatcaacaaggctatttggtaaaatatgatcaaagcaggctttatttcttgctttccaaatagcccaggataacagctgccacacccactaacatcagttgttttgttgttttatcacaagtttgaatccaatagcttgaaaataaattgtttagttgatatttctttcctccaacatattacataatatttcttgtcatattgggcactaatctacccacaatctaacccanaagttaattttcctgtagaactcaacttttcaggaaatgatcatatcaggaaactttccatccagtctgtttgtagcatagatggcaaccatactgtacgaccagtagaatgccatttaccatcgtagacctaattgctaaaacaaaaggagaagatctgcatgttcctctccggtcaggcttggctgattatcatggccaatccgccaccggcggccggctgcagcatcagcatgcatttcatcagtaagcctgagaggaagcattccctatcaaagtattgtagtatgtcaatatcaacagtatctattgccgtttggaccattttttattgtcaaagtttcactttggaccagtttactct

SEQ ID NO: 39441 - DNA, 1013 bp, Oryza sativa
attacgttcttccgggttcctgcacgcggccacaggcaatacttgtatatatcaacctggatgttaatttagatactagtagtccataacccatgcattcgtatatgatgaaggcttatctactttgtatctcagttttgttgaatttcagtttataactagtatggcggtccgtacatattgccggttaatattgttctattttatttctcaccgaatagcatatatgggttaattcacgaattcatttataggccaaataaatgaataaccttatttggcctatcttacaccgttaggtgcagcccgtcgggtgaggatggcacaaaccacaaaggtacgttggcacgtaggtcggcaaggctctggcggcgtggcgcccgggcctatcgcacgatgcgacatgttccacagaagaggaaagtcttgatgacccagcaacgataccagtatttgtgctagggatcgataacttgtgatgggccaataatgtgtagtgagccttgcattttcaggtggaataagtccattgtgactcctttaattaagtagtggaatcagccatgcggcgatagcggaggggaggcggatgcaatggcaggagagaacgggcagcacggggaggtggcacgagatgagacggagcggggtggccgccagggccacgacaatgcaccggtggcggagcaggtgcagaggctttcatcacgcggggttgagggcagtagctgagggaaggcagaggcagtggtgggagggacaatggcgtgggatgagatagaacggggcggccgctgggggggggggggggggcgacgacggcacgccgctggcagagcaggcgcggcggctttccccatgcggggttgaggatggtagcagtggaggggaggctgtagcaggagggacggcggcgtgacgacgacctccccaccgctgccaccatccttgctcgcactccctccttctcaatggcaacaagcggaagggggcaccggaggcaactactggaa

SEQ ID NO: 39442 - DNA, 2913 bp, Oryza sativa
tgaaaataatgacagcaataatttgacattgcatgtataacattcaatatgcaatagctgtatatcttcatgcaagttatagatattatatattcttctgtttttctgactatatctctgaaaatgcagcttgaaatcttcagaagcatccagcacaagaacctggcaaaccttgtaggagcatgctcaccaaggcgtgcacttgtctacgagcttttacctgacacactggaagatcgcctcactgacatcaagaaatcttttacgtttagaggaaagaaatcttttacttggagagacagggttacaacagcagccagcatatgctcagctctcgattacctccacagaaataatcacaagccaatcattcacggtgaccttaaaccaagaaacgtccacttcactgcagataatatatgcaagctcagaaactttggaatttccactctgttacatccaacaaaacatgtaccatccgccattgaggaagttattcagggaatgcccggtgaaaaagttattcagggaatctttcggactttcatggacattgatgactgcaagattcagattcagacagatgtatcagctctgggtatcatactacttcagctagttacagggcattcagatgcaaagagtctgagagattttgtggcacagaaactgggagatgatagtgaattccaaaggaagagcattctgcagaagagagaaatcctgaaagggattgtggatcctgagctgaaaaggtgtcaaacaccagtggaaggtgcagctaggatgctgttcttgggcttgagattcagtgatccaccagggaaacagtgtcctcaattagccagtgaagtgctgcctcagattcaatcgatgcatagtacgacttactctcagatggtttgggttcatcgctccttcttttgagccggttaagttggttgatggtttgtctgttcatgaaagaaaaacctcaaatttattcgatttgtttggtgtgaaaatggtaatatgatatgtagtaggcatacagcttcctctgtcccctaagaacatacttaacctgtgtgtaacagtttcaatatgctgcattgttttgatgttcagttgtcaaaaataaaatgctgttgtcccattttctaccttgagtttttgttccgagtatattaactttgagatgcttatggctgctaatcacttgtcaatcaagcagtactatgctgataacttgtacatattcttttgcctattgctgtccagtgaggcaatgaagcttacagtgttttcagatataaaatagacgactacttaggtggtgacatggacaaatctcatacatccatttctattatcttacgatagttttcagatatacaagtatggagtttatacttcatattttccctgatcatctaacatgttctttacccaaaaaaaaaaaaaacaaggaaaaagttcaaataccctcctaaattttagatagaagtctgtctagcaccctaaactgtaaaaccggacatccaactctcggaactttgcaaaaccattcatattactctctaaggtggttttgtataatgatttttatctttgtatataaattggataagtttgatcacatggcatatacattgaacatatatattacaatctccacttaaatctttcttttaccacttgttagctcttacttacaaacaagtaccaatataataataggatggtatcactgtatatatataaattgatgacttacaactaatgatatgcaaatatgatatattagttatttaaagttgtgagtttaagctttcaaaatatgtaaaaccatcatccagaaccactttagtgggtaatatgaacgattttacagagttcaggaggttagatgttcagttttaaagtttacggtgttagatgaactttcattcaaagtttacgggggtatttggactttttcaaaaaaacaaaatgctaacagtttcaaagatgacaattggtgggcctcccatattgagctgggccggctcgcggcgaacaaagtagcccattaggccctttgctataatgacactggacccacatttcatagacacagatgggcccatttgtcatccgctcagagtgtcaaaacagtaaatccccaatgtttgctatcccaatattgcaattttctcgcaaatatgcccttctaatgatcgccaccattgaaattttgtgaatccaacggagcatttgtggtctgcaacctcttcctcccgctagcgaggcagcggcggcggccggtctcgcgtcgccaatgggcaatggcgggcattgccacgtcaccgatccccgccggccggactcgccgtccctcgccgccttccgttcgctggaagtgcaacttttccgatcgaacagagcacgggaagccggaagcaaatgcatatggttggtaatggtcgccacggcgcgcgaactgcagcagcgccgtcgtaagacggcgtggccggccgccggccggtgcgccgccgcctcccgggtgcacggggtgcaagctactccatcgcccagccaccgatctagttggcctcctcttgactctgcttggctggtcaatctctcgacggagcatttctggtctgcaacctgctcgacgaaatgcctctctgctgcgctgcgtttcgttgcttgttaagagtcatcaaagttgtgttttgaagccttgccatcagcataaagaatttgcatcgagcgaggtaatgttacattgtcttttttttttttccagtttgtcaggctcgagtgatctttacattcttaattgcattgctggaattcaaaaaccattggaaattgagagcagaaaagtggtgatgtttattgcgactcgtcagcagtaaaaggtacaaactcctccatgatcactga

SEQ ID NO: 39443 - DNA, 2145 bp, Oryza sativa
acaatgactattctaccagataaccactccaacatccaaatcatctcacgcgtttagccccagtattataaccaaagacacagatcaagttgacggaaagcaatgcacaggagactcctgacgtgtatgccttccatcacccactacaaaaactaatttaaaagtgaaacagcatgctgcattgatcaacttcaacctgaagaatgtgccgtataccactgcagaaacacgaacaaaaagacctcgtacctcccatcagtcaagctgctttggcagcgcctgttgtttatcacggacaaccttctggttctggcttctgcccatggcatatatataaccagcgaccggcaacaccagcattgctcgctcataaccagttacttttcatctcatacctgcagtcatttgattgacctgctatccagttactcaatctaaaatctgcagagatcaagcgtttgcaacctgtttaccagccatggttggaggaggaggccaccaaaatcctgcagctgctcaaccagtaaaaaggtaaggtgaatctggagaatgttttttttttttaaagaaccggcacaagatggtgccaatctggactctttcattcttgtttcacttgaacacttcgtttggccatgtttgctgaaatctacgatcatggttggtgacaagggagaaagcgaaggttcaaaagaatcctcatcagcaagcagaggaaaagcctatggacgttgctgttggcattgttgtcgtcgttgttggcgccatcagtgctgttgcgaccttcatccttcttggtgctgtcatggtcaccttggcgattgttacaatcattgtcgtttgtgtagtcactgctgcacaagtaagtattgctcttcaaacgatgatgttacattgtaatataccttgctcatgcatcagacactatcagtcggcaatattaagaaagaaaatgatgttcaattgttcatcaatgttccttgttctaacatggtccttgcagcaataccttgaacaggcgaacaagaacaaagcttctcgctcaagtggcggaaataagttcattgtgttcaaaccttcagaaatagatgctgcagtcagcaaacgagcgaagtggctccgtggaacagctacatataatgtgtatcggtcagattttgatgaatggatattgctacaactgttcccaaaggaacactaccagaatggattttgatgcaagagtttcatcaagcggtaagtttcgttgaacacataactttctctgcactatgttcaaacataagttcatcaaacaccaccaaaagcgactgaagttttgcattccaaagtatagaaaaccaatgacaccattaatacattatacaccctgttgatttctaacagtacctctgaaaatgcaagatagaaccactgtgtattgcttcatttctcacactagttctgaaaatgcagattgaaatcctcagaaatatcagtcatccgaatgtggttcctttcttaggagcatgcatagagaaaagggcaatcgtttaccgattcagagaaaacaacacactggaaagtcacctcaagtatctcacatgggaaatcagagtgaaatccgccgccagtatatgctccggcctcatgttcctccatagcagaaagcccaagccgatcattcacggtgacctgaaaccaagcaacatcatattcaggccaggaaatgcatgcatgctcagcgatttcggaatgtgttatctgtattcgaaagaatttggacggcttatcactgacccttgcaagattcagttggatgtatctgctctgggcatcgtgttgcttcagctagttacagggaaactagatgcaaatggtttaagagaacgtgtgatctactatctgggagatgctaaggggttctacaagaaaacttcatcgcagcaaagaaaaatcctagagaagattgtgaatcttgagttgaaaacagacagaacatcagaagatgttgccaggatgttattcttgggattgaggtgcagcgatccaatatcgaaaaatcatccaagcctcgccacagaagttttgccccagattgagtcaatgaagaagtagtgcctctcatacttaagtggtgacggcttcaagtactgtgtgatgagg

SEQ ID NO: 39444 - DNA, 1424 bp, Oryza sativa
aaaataatagatgatctcagttagaacagtcaatagtgtatgaatcatgaagcacattagaatttggaaggaaataaaaattttctatgttaccttcctcaagcaaagccatttgttcgctgtcctcttcaacactaacatagtttcctccacgaagccaatcattagcacaaacaagacgctcaaccattcttgggggttagtgaggtcctaaagtcatctagagttcgcccaccagcactgaaggctgattcagaggcaactgaggtgataggaattgccaaaagatcacgggccaaatgagataatattgggaatcttgttgaattggccttccaccactttagaatgtcaaattttggtgtgtcggctcattatcttctgatagatacttgtctacctcagatttgatagttccacttccaccctcactgttaagttgctgagtaattactgacatccacctacaactcactcttttgctggtttcagctgtagattcagattcagtaggttgcggtgccttatcttttggggtatacatttccttgtactcttcaaacaaagcacgaaaataggtattcactgtttcccatactttttctcctactgtatccccaaacatcaccttaattcccattctaatgcaatttgatagtttgtatctaggatcaatagcaacacagaagaagacagtgaagttgagtagttgatcccccttatctttctctcctctcttctctctgtccccctgcctctcaccatacttctctccccaatacttgtagtacttcattagcattcttgtacccatttccttgctcaacttgtcttcactatgagaccattctctcaacagaagtaatacatcagcaatctcatggaaataagtgtgagatgttgtacgactttgtacagaaacacggagagtgaggtcataaaagtgttcaagaaaatcagccatcttcctagccttctcccaatctgctcttgttggtacccctggaccattctctccttctaattctaatttgtagtatgggtcttcatcactatatctttcaaatgctttttggtacttctcagcagcatttaacataagataggttgagttccatctagtgcaaatatctaagtttagaaatgctttgctctgtaccttggctaactcagcacatttcttaaattttaccaacctagatgttccacatctgataaacttaacagcagcacggacacgttgaattgatgtaccaatttccttcaagccatcacctactattaggttgataatatgagcagcacagcgcatatgaatgtactctccttcagcaacacaaccttttgactcattcaagacccttctcatatacttaattgcattattgtttgcactagcattgtctactgttattgtaaaaacc

SEQ ID NO: 39445 - DNA, 1826 bp, Oryza sativa
gttcccaaccaggaggagcgaacacatcctaggtgattgcgataatatcctcatcttccttcttatttcaccttttgaattttctctgcatatttttcttactatatttatttttttttgttctcttcttcctttttcttccttttttatccttttatccttatttctatccccttttcctgtttcttgacattgttccattttgactcaccattaatacaatggttataaggtagagcctctctaccttttcggtaaaaaaaaaaccatgtaatcactactcagaaatccccgcaaaaaaatcactactcagaaataagcacggccctccctctccttttgtgcagcagcaatcctttcctccttttccaggtgccctctcccccctctctcgcatgtgttgctttgtttatacggtttgattctatcatctgttcatttcaattcttttatctcgttacctttaattgctgtcctgtttgggggcatgtgtgtcatgtgatggttcaatttggttggacgacaagggttaagtttaacggtaacctatagaaaataattcaactactaggttggtccatcaatcatgttcatagagtgaggctgcttacaaaaagatgtacaccaatcatgcaatttgtaatcaacacatattataaactagggacaatatgattgaagagtggcttgccttagttcatgatcttcaaatcttcgagagaatccgcatccattgaaccccaaaacatccactacgcacttgaaaagagagaaccattcaaaaccctataaagtagataataactattataaactaattgtgccgttggacagatctcaattttagaaaaattatggaaattgaacggagtcgaacagagttacgatttgcaagatatgaaattttaaagattaaataaatttttgagcaaaggaaaaagagtttctttcatggggaaaaaatattccgaaggaatattcctttgtgggcccactcacagtggcaccggggggtcggcgcacggtagaccgtgaggtgaggtggtggaccggctcacggtccatggtcagtgcgtgtggggcccaagggtcagtgacaaggagcatgtctgcatgtggaccgggtgcgcaaatggttaaggaatcgtggtcccacatgtaagtgactcaagagttaaaagggagtttagttagagattaagtacaaccgggcccacatgtcattgagacagtagaagcggattaagatggcgatgattactgtgtaggattaattaaggaatcattaagccctcgatggtcccacctgtcagtgtcgcatctcctcttttcctttctttctctccccctcctcctcgatttctcctcttctcgttctttacccgatccgcttttctttctccacgcgcgcgcgcccgagcggaagagagcgaggcgtggctcggggcggcggcggagggcggctggacggaggagccggagtgaggagacggagaggcccggcgggtgtcgtccgaggggaggtgcgcaagcgggcgtctcccgacgcggcgcgacggcggcccggagcaagatgaagacggcggcggcggcggcggcttcggtggctctccggccaagcggaggcggaggcggctggggaagctccgccgatggagcgccggggttcaaggcgacgggcgagcaatcggccgtagggcggcgctcgcgcgggggccggcttggccgaacgcggcggcaccctggccgacggcgaagagggtgatggcggccagagaattagccagaaggcgctggcatggcggggtgagtgatggcagcactgg

SEQ ID NO: 39446 - DNA, 3868 bp, Oryza sativa
ggcagcgtcggcatgcatgaggccgacgcgatgacgcctgccacagtggccggttctgtacgaggtacggggagggcgaggaagtcttcgttggggcccacatggccagcgaagaacgcggggaggaggtgggggggcccacgtggtctcctaggtgtaaaaaaaaactcacggcccagcacatttataaacgagaagtaatttgtgaataaaatttttatataattgttcttagcgacctaaaagtaaaggttgaaaaataaattttgatgaaaaaacatcaaaatcagcttcaattttaaggatagggccgttaaattctaccaatcgaaagaaggggcaacaattgtgtaggacttcaagtaaagtaggaacaaatgaaagggcgcctgccacaatggttggcttctatatatgcgaggtacagggagggcaaggaagtcttcgtcgggggcgtggcacgtggggaggagatggaggggcccacatggtctcctaggtgtcacaaaaactcaaattctacccgacgaaagaaggtgcagcagtcatgcaggactacatgtaaatcaggaacaaatgaaagggacgcctgacacagcggatgattctatgtgaagtacggggagggcgaggaagtcttcgtcgggggcccacatggccagcggggaacgtggaggggcccacatggtctcctaggtgtcacaaaaactcaaattctaccatacgaaagaaggtgcggcagtcgtgcaggactataggtaaatcaagaacaaatgaaagggacgcctgccacagtggccgactctgtgcgaggtacatggagggcgaggaagtcttcgtcggggcccacatggccagcggggaacgcggggaggaggtggaggggcccacatggtctcctaggtgttaaaaaactcaaattctactagctagatgaaagaaggtgcagcagccgtgcaggattgcaggtaaagtaggaacaaatgaaaaggagaatcgaagagggtcaaaaggaaagaggaaagccgcacagccaacctgacatgtagccagcaagcatcagtgtattttggatgggctggtccgggctagattagtagagtgatggaccaatgggagctgatgatgaagatttgccaagcataaagcctagaaatatcagattgacaaacagttcaaaactacagcagcaaacatgtacttttgtcacaaatctgcagagctgacatctttactcactgcattttccatttttcaccagaaatctgagcgtagcagatatatcaatcattggctgttctatttatcagatcaaaatattggtagtattgggtattatatttatcagatcaaattatggggttagggctagaatcttaattgttcttcaagatcacaatcagtcataattgagtcctagttacaaggtttcaggtctgatgtaagtcgaaattattaactggtggtgcacgaggtacaggaaatgtccattcaagagttgaacttaaatcctttcaaaaaaaaagagagaagaattgaacttaaacagattacaacagaagtccgataatatatatgttcttccctttgttgaacaaactatattttggccaacctacacacacagtgaacccatcacctctaagtatgagagtgagcacatcattgtattaagaaggaataaatgacggacagaattgttggacagcagactgccttcaacgggatcagcggattgccttcggagtcgtggtttgtcgcacccggatcgctgtgttctttgtgatcaatgcgaggaaacgattgatcatctcttggtcgcatgcccggagtctcgacaactttggtggattgctcttagagctattgggcattccgagtgtttaccgctcaatgagccctcttttcattcttggttgtgtgacagccgtaagaagatggtcaaggaacatcgccggggattcaacatcatcgcaacactagtagcgtggacgatttggaaggaaagaaacaatcaggtcttcaactagaagagcggaacatgggcggagattgtaagggttatgacgggtgaagcagagctttggaagagcggaacatgggcggagattgtaagggttatgacgggtgaagcagagctttggcggctggctagagccgcaatccccgttatggtagtccctgactccctgtgaatggagaagggtcgccaaatttagtatgagattaggcttttgtccttcgtttccccctccagtatctttgtcccattcgttttttatttttggcccgctttgtacatacatttattccttcttagagtcactactcttcattgaattaatctggggcataatttctgtggcgaggattggatgattcttcactattggatcactgcatctcaatcccaagaataacatcctggcaacatcttctgatcttgatctgtctgttttcagcctgggcattttttagccgcaaaccgaaccgaaccgcaccgaaccgaaccgaattgttggttttttcggttttcggttgtcagttcggtttctgtttttgtgctattcggtgtacggcttcggcttcggttttatagagaaaccgaaccgaacaaccgattaaaccgacatatcccgcggcggcggttttatagagaaaccgaaccgaacaaccgattaaaccgacatatctcgcggcggcgcagcccacggcccaccagttcgcagcccatcaggccatcaagggcaaggccaaccctacgccacgcccccgactcgtcagtcgtcacgcccccgactcgtcactcggcgcagccgctagcccggccgccagccgcgcagggtgccgccgcagcgctgccgctgccctacctcgccgtcgcgggctcgaggcggcacgccgcacggccgcagcgccacactcccctcccctgagcagcagctgtaggccccggcgagccgcccgcgagcacaccgccccctgcgcccaaagacccaaaccctaactcggcggccggcaaacgggctgctggcggcgggccggcaacaccctcgtggagttctccgaccaagacaacggcggcgcggaccgagcagtcctcctatgtaagttcttcacttcttgttcgtttgttctagttgagtccatgttgagtgaatgagtgttgtattgctgttctatgttggtaagttctgatttagtgatttgaaacatttgatctagatgggggacacagatgaaactgttgcttgtgagattaatcacactcaatctcaagacactgaaaccggagtgtcaactactggagtggtagatgcaagcaaggacaaggaggagcagcagcagtccaaggatggagagaaagctgatgaagaatccagaaaaagaaaaccaatggctctaagatctgatgtatgggaaagtttcagcaaggtcaaacttgctaatggggacgagagggccaagtgcaagtggtgtaccaagctatttcattgcggctcaagaacaaatggtacgtcatccttgaaagctcatctgaagatttgcaaaaagaatcctaacaaaccagtagttgataatcaaggaactttgcaactgacaccatgtgatggcaatagtactcttggtactgtgaccacttggaaatttgatccagataaacttagaaggtgttttgctgagatgataattgaagatgaacaaccatttgtcctatctgagcgttctggtcttaggaaatttatgactttagcatgtccacgatttgttctgccatctagaagaacaatcactagagcttgtgttaaagtatatgaagatgagaaagaaaagcttaagaaattttttaaggacaattgtgtaagag

SEQ ID NO: 39447 - DNA, 1010 bp, Oryza sativa
gcttgcttaaggatttgatatatctataatatcatatatgctgttgcttgtgttcatttttatgtaattctgtattgttgtggctggtggtagtaacttttggttaattcggctaaaaccgaaaccaaaattaaaaaaccgaaaccgaattttgcggttttcagttttttggagaaccgatcgggtggtgaagcctgtaaaccgaattttatagcaaccgaataaaccgaaccgaattgtcggtttaaaccgaacgcccaggttgagtctgttttcaactcagaatccataatatttctcaggatttcactttgctgcgatggagttctcttgtagaaccacttagcatctcccagatagtagagcacacgttttcttaagccctttgcatctagatccccagtaactagctgcagcaatacgatgcccaaagctgctacatatccaactgaatcttgcaaggctcagtgataagccgtccaaattctttcgaatacagataacacattccgagatcactgagtaagcacgcatttcctggcctgaagatgatgttgcttggtttcaggtccccgtgaatgatcggcttgggctttctgctgtggaggaacatgaggccggagcatatactgacggcggcaaaagcaatggcaaagccagcctgagtgcctgacgtccagccaccagctcgctgaagcagcagcaaggcaagtatcaacgaatttggatgggctgagctaggctagtagagtgatggcccaatgggggctgatggtgtagatgagccaagcgcatggctagaaaaatcagattaaagaacaattcgaaaacacagcagcaaacatgtatttttgtcacaaatctgtagagcaggaatcttaacaaacctccttttaaatttttcactagaaaactaagcacaatagatatatcaatcattatatttatcaaatcaaattattggttgtattgggtgttatatttttcgccgggcgtgttggctgttatat

SEQ ID NO: 39448 - DNA, 36679 bp, Oryza sativa
ctattgcaattctatggggtttatatttatacccccgagtatatgcaagaatttaatttaataattcggaattaataagcctcccgtatagctcttttcatgatttactcattctaaactaaaataatatagtgttgtattcggtgagtggtgatgggctacaatttattcatgatttactaattaattccaaaatttatatttaataatgttgaattgtacttggtttggagtctgaatatctcattgatttagtaattacaaatttcaaaataaagatatttatatgattttcagaaccactacagctatttgtactcatgttggagtcttaattcaatattttacttaatttattaactctaatatttgaaataaataattgtgagttgtacttggtctggagtcttgttattagatgttcagcgacacgttttatcaatcacgtaaattggacatatgctctaaaagtggccagatagctgtagtaggcatagcaaatgttaaatgattgaagtgcctcacaatgtcaaatttgaatagatttcaatcttaaaagggaaaattctgaagtttttaaattatatttgtcaacggaattatttattggctgaaacataacatatataattttttgcatgaaacatgcaactgatttattagtgtgattactcgtatggaaaaatgacatatgtggacaaaaacgcaacgacacgatcatcatcggtaaattttgctacactgctattttatggttttagctctaggacaccatctgaatcacttttggggaaaacacttcataaacgtggtaatttgccaatagacaccgtgccgattagaataataatttccggtggaagagaagagagaaatcgcgtgaaatgtcaaaaatgcccttgagcccacatgtcagctctccatctctcttctctcttaatcccctccttccagcgccgcaacgcatgccaccgcttcgaaacacctccttctcctccacgctccagtcccaggcgacgcggacgacgacgacagggaacggtggcggcggcacgctccaaatctgaccggcacagcttcggcgacgccgccctcgtcattctcctcctacggccgaccttctcggacctgctccatcgtgggcggctcgcgcccttccttactctgctccgctgcgctgcgcgcacgccagcctcaccgtctcattcgtcgtctcgagctcgtcgcggcggaggagatggcgaggacggcgaggagagtcgcatcgtcgtcgccaactgcggccactcccacagcggaggacggccaggacggcgggggcggcggagaacgtggagaaggagacggcgaggatggcaagagcggccgccatggcactcgcggcgggagcggcaaaggatggcgaggagaaaagccgcgtcaaagtcgccaactgcggccactcccgcggcggaatgtctccatggtgctcgacaccagcttcacctctgccgccatccgcgatgttgacttgtaccgcgccgagccctgggacctcctaccgccgcgttagtccatcgtcatgcacgctttggcctgagatcgactgcgacgacattgcttgcacgaggagcttcgggtgcccatcgggaatgaggacgaacagggccacgacgacatgaacaggggcacctttccttcatctcccaaggtgtgacatgtgagagaggagagatagcaatgctgacatgtgggcccaaaggcatttttgaaatttcacgcgatttctctcttctcttcaaccggaaattattattctaattggcgcgatgtccatcggcaaattaccacgtttatagagtgttttcccccaaaagtgagctcgggcggtgtccttgggctaaaaccacacaatagcagtatcctgtagcaaaatttgccatcatctaaaatggacaatacatgttctcagcttaaaagtgaacatatcttatgcatacatgtagatggtatataatatgatacatactacatattacatatgaggtttagattttattacatgtaggtgtccaactatttgcaaatgctccctccgttctataaaaaaaaatcaacttttggatatgaatcacgtcatgtctggattcgtaatcagaagtaagtctattatgggactgaggcagtacatgaacaattttcttcatataactctttaatgacatttgctagttgatggacgacaaaatgtgcacgcaaagcttagttgtatgcacgaagtgtgcaacaaaaaagggcatcggttcatttgtgcccaagagtcagaagaaaactagagaatccctttgatagaatatttgaaagatcctagtcttagggttgatcaaaaaattcggcggcaagtattcaaatatactttgcttgatgggagttgtatcgtcgaaatataagttgggtgttgttaaagtgcttagataatgatcaatccaaggttgctatgggagaagtgtgtgaagggatttgtggaacttatcaatcagcccataagatgaattgattacttaggagagcgggattttattggccgaaaatgattgatgattatttcaaatattataggggatgcgaagcttgtcaatggttcggcactgttcaatcggcacttgccgttgtattgaatcctatcatcaaaccatggccgttccgaggttaggctttggatttcgtgctagtcgcaacggattatttcactaagtgggccgaagccgtgccactcaagaatatgacttatacagaggtaattgactttatcttgaagcatattgttcatagattcagtattcctcaaactttgactacaaatcaaggaccttctttcatatccaaggaggtgaaaagttttgccaaatcttatggtattaagtagttgagttcttctccttactatgctcgggctaatgaacaagccgagtcgagtaacaagacattgttgaaattggtcaagaaggagattgaagaacatccaaagaggtggcatgaggtgctttccgaagcattataggctcataagatatccaaatatggtgctaccaaagttatccttttttgagttggtttatggacaagaagccgttttgtcggtagaggtgaatctcggatatcttagatatataaagcaagacgatttgtcgattgaagaatacaagaccttgatgggaggcaatcttgatgatgtgatcgataagcgtttaaaggctttggaagaaatagagaaagagaaaaagagagtagctaaggcttacaacaaattggtgaaagcaaagttgtttcaaataggagatttagtacggaagacaattttgcctttgggttctcgatctaaggagttcaataagtgatcacctagttgggaaggtccttatcgagtatatggaattgttcgagcaaatacatactttttggagacacttcaaggatagcgtttttagagagcaatcaatgggaaaatacttgaaaaaatatttcccaagcgtttggcaagacgcttaggaggtcctatggtcgttaattggattatcgtcataagatatcatgttctatgcttttaggttcacaatgttcaccaaaaaggcagcggggcatgtgtttacacccaaatttggcacctaggttcaaaataaggaaaatcgccaagatttgggaaagtcgtcagtttcctctacagggccgatctgaccaccgtgtattgcccggtcagatcgttgcttgaggaccggtttgaccggtggcatgtggccggtcagaccggcagtccgaaaccgactctgttttcgtcgggtcttgggatttcttgcttgggaaggcatgtggactggtaggaggcaagaccaacccctatttaagggccaaggccgattcgattaatccctctcccccaaacacaatcaaaacgttcttttatctctacttttagccatgttttctactttactctagttttagtctatctttatcgatttgtgccgtaaatcgtccgccgtcgctgcaagggtgtgattacccctttgtaagtttatcccgtaaaccttccgtttgctcacgagatgtgtagttatcctcatataaaactaaatcggcttagaggctgattttgatctctaaatcggctccgctagccggtttagccgttttctagaaaacccaccttgatttgtccctttggctagatcggggtgattggtgattccatattaccacaaggtgtttaggtgtcctgatcgtgattgtcttcttgtcagaaaagttgccaacaaaaatctcaagatccttaaatcaggtggtggccatgtcttcaaggaagtgatctctgttgatgtcaaaaacatcaactccttacttttagtttgaagagaaggtgggccatggttgaaggagtttgaccaccacacttctattgccttgtactgttcatggatcaggacaggattcaagttgatgctcagcactgacacctttgcaaatggctccagggagagatggcccatatcatgagatcttcaccactacgcttccactgccttgagtaaaccatggatcaggccatggcaagggctgagaacctaagaagacttgatctttgtatcatagaactgccactccatggtggtaccagttgagagctagctatgcatactgagcccaatacaaatgcaacagtagagtacttccaacttacatgaaatgaaggagaggccgataacaccaaggtcacggctcaagcaccaaatcaagttcctgggaggaattgcattgagggctaaccatggatctctgcagcataattacacaggggtgaacctggtatcaagttcaatgagctcaatccactcatcgtcggccatgtttttgccatcatcatcaaccaactagttcttacacttcattgaacaatcgatggttgtccccatgccaagcttgacagagtcaatatggttggttgagtcggcctcagcactgacctccaatgcgatggaagttggatcagtgttagtgctcaatgttgccacatctctagtggaatccttgctcacgggtgaatccaaccttggtgtcgtgacatgcctccagcactcgatcgatcatggccatcatcttgatgcacaggtcttgaatgatcttgtctgagttctccaccgccttgtccatttcagtgtcggccttcatggcctcgatgagagaagccgaagtcgttgtggccgctgatgtggttggggctgtagatggactcagtggttgggaacacatgttctggtgtggtaggagtgctctcggcattagactttgtggtggcacatcttggtaccagtgtcaaacacttggtaggcgcagtgtcggctctgtctccgagcatggtcggcacatgttgcacatccagcacgcagcccccatcatagatgttgtggccgtggaggtcaaactgagccctccccacgtcgcaggtcgcccgaaaccaaatgattgcctccacacgccatgcatcaaccataagcatctgcaccgccactactccataggggttgaagacttggtgcatcacgtcggtagaaacagggtagatgaggtggctcacttggacatggagtgcagcacttgcaccacatcccagccggctcggtttcatcgaacacttggtaggtgcctccatcactgacgcctccatgacccaaatcccactcccagatgttgccactaccatcacgcatcgcccacctcgtctccttgctcggaataccatggatcggtggttctgatcccatattgtcacgaaccaagcaccacccaaccaattctcaacgcacagaggcctcaatagattgcaaccactccaaatacaagtgttttgggatacaaattgaggggaatgagaggtatagactaggaagcgaaatcagacaaagaggaagcaggagattgggactagagaaaagtaatttagaggggaggcggcagcaaggaggaagaagccattttcatccaattatgttcgatccttctccaactacagttgcctcttatatcagcttcccttccagccatttgggcctaggcatgcccttgatgctccgcccaggaaccctgttaggcccatatcgtgacagaggtactgtaatatacggacgtattacaggaatgtgtgtttgtcactaggaggataatatagctagtgcatgcgatgtgaatttatttttcctttttttgcggggagcttgtgaactcagcgaatcatactccttttttttttgtcgaggagcacgtgattttattttattttatttttttgccgggagaatttatctgactagggttactaatcactcgatccaaaattcgttcctgacagctagcacgagggagccgcggcacggtggtggggcaaaagtaaagatgttagacgctggtgctgtgatctcagatttcttcttcaaatggggtcaagagaaatacatcttgcttcgcttccgagtcatagtgccaaccctcattgttgtgtgcccgttggtgcagtttggcttaatagatgacttaaacaatactatcgatccggccatgaagagcttcttgtatgctgtgtctgatggcatactgatgtatgttctaggggccatgcaagcctctcctgtaaaatatgcgctgtttccagtgtgggctcttgctctagtcggcttccgttctatcttggtaggcctccacgggaagtacgacatgcaggcggagctgggaaatgtggccaaacttttgatcgtggcgtatatgaatgtaacacacggctgcgagattgggcgtgtccctttctggatctactggagcattttggtcgtcaagtgcatgtacaggattgtgatacgccatcaagcatccaagaccttatggcatagccggagttcagagcttcttcaggcgtacatgggtcccaaccagccccagagcaactttgttgacaacaattcaagcccaaatggcgccatggaagggtgcaaatacttggtctttggagagtcagagcaagaacaatgctcctgcagaattagccctacgagacatgtaaatattaataaattgaggtctctagttacattacaaaacatttgtcaatgccttaaggaggacaacatcgtgaagaagcaagctgaagtattgaaggatgtgtgcctgtcctttgcattgtctcggttactacggtgtaggctggaaggagcaagattacatgcaggcatagattccattaaccggaagctactgattggcagttataaggaacgtctcgaccgactattcaaagtcctgtatagggatgttaagtttttcaaggactgcctcttcagcaattacccgatgatcttctcggaagggtttctctcactcaggtttgcttttgcgcagcttatgatcaagttacctgtgggcttatggctttccagtgatctcttttgggcagcaaggcacctgtcccaaaacaggcataatttatctgctaccgatctgaacatcgctggggctgccatcctcatcgtagtaaatgtggatgattatggaatgggcatcaactttgtaaactggacgagcttgtctgctgtgtgctggttggttcattgcagaaacaggagaaagagattgaggcttgttaggtggtttcttggtaggttaaattcgcaagaggtgagaggtggtgcatttagaggccctcttgataagttaataaattcgcaagaggtgagaagtggtggatgtagaggccagtatgccttcctgcaatcatacaaatacagtgcgtggaagcgtaggctgttgcactcacttactatgggaatgatcgcaagtaaggacgatggcacaaactttgccacctccctgactacgcctgagaaagtacgtactaccgtactctctcaagaactccaaggactagatctacaccacgatttttctagcagcgtcgacgacaaccattccctaccaagagacttctttgcaacagtgcagcacgacgccaacaaaccagcagaagcggaggagcagtactggtccgagatcatccaaagtggggcacccagatgctcccatgttattctgatctggcacattgcaacaagcttatgtgagatcaagcttgcccaagaacatgatcattgcaatggcagccctggattcctgcactctgccttgtcatgctatcgccgtaggcgcaatccttacagaggataccttgtggataagttgctggatggtgacctatgggagacctacatggtagcgaattggttgtcgcggtactgtgcgtacctgctggtcgcaaagcctgacctgctgcccgggagcatttgggttatcaagaaggacttccaacaaacaattcagtgtgctcgtcagatgctccatggttgtacctcactcaagagcatctatgacaagctcatcgcgacaataccatcccagttggacaaggctggacgtccgattcccttaagaagaggtgcatcttatgtcgagagacagtgcactgatagactacaatctccactatgaatacaaaatgaatcaatgggagatcatagccaaggtgtgggctctcttgcttgtgcatctttcacctagctgcgatgcacaagtgcatgccaagcatctcaggtccaacatggagtttatcaccatcatctgggcactcttctcacactgtggcatcgacaagagtgaattgtgggattatgtgtcaaaacatccaagcaagatgcccaccttgacaacatccgtccagatagtgatggagaaatacaagaaactagtggagcatccgagcaagacgcccacatacgaacatccgcctccggtccacctgccaccaacccactggcggtgaccttgaggatggtggtggagaaattcaggaaatgaaccatggtaactagtcgtcctactccctctgccacatcctcaaactcccctggtgcataagctctgatcccactaagctttcagcaataaactttttttttcgagaagttttgggtaacactttcatcccatatttcatttcattcagacaatttgtgtttgtcttactgtgacgagtgaaagtgtggttgctgcttgaagaacatggtgtgtgattgtagtgaactgaactatattgttgtgtgtggattgctattgaatccattactgtgagttcaaaaccctttggatttgaataataatggtatgcacgatattagtttcttggtatatataatttatcattgttacattctagggttttttagataatggatttaaataaaacccggcatctacatcccaagagatgtacacagccattgttacattctagtatatccttgtgcatcagattagttgttcacttgccctccatcctatgaggaggttaattaggatgggcactaaggactgttctctgtgtcttttctctgagtcaatgtgtgtaaactgtaaaatactgatggttggcctttcagtcaggtggagtaaagggctcatgacatggcctacactgtggtagtttgatttttattcatagacaaaaatcagttacaccccgcaaataattagctagcctacgcaattcagaaatattgagctgcgtcctcttaccacttgggaggagcaagcagcagcagctgacccaaaaaaaaaaacattactgtgcatggttgctttgccttgtcctggagaagcagttttcattttgtaatcatttcaacctggttatatccagataacaatctaaaaccacatgtttcatcaatttgggttatgaaaggcctcgcatagattagtgattccaaggattacactcagttgatgtggacccccgtttttataacaggaatcaatcgtgtaaatagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacattccaaaaacagaagtaggtaaggcagcggagttaaggcagcggcactccattgccacaggcaacgaccgtaactaagacctactgggcgccatcgtcttcatcaccctcctggtagtaagcgtagggattctccgaagcttcatctccgacctctgattaagtttgtatattgcaagagtgagtaccaaccgtactcagcaagccaccacagcaacaatgcacatgacaagggtattcaaaggatggctaaggttcttttgcgcaaagcaagttttgtaattcttgtcacaagcctaagacttagcacagactgatcaaattttagtaccagtgttttcattaaacaacgacggttctgtccaccatccattgtgatcccaaggatagcttcccgccattgagtcgtcatggttttctgaggacgtccacattcccgcctctcaggaagtggctccatcagcataaaaatcatcatgtaatatcccatcccacacaagttaaagaatttagagtctagccaagtgtaatacatgtcccagtgctcaataaccgcgagcacagctattcgaatatatttagtttactcacactgcagtggatgtacactctacccgtactccgcgactgcccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgctcgactatctaatccgctaggtctatacccatacgagaagtacggttgtacgggggtcgtttcatgcttaacttcatggctcggtccttaattgaccggggacggtactagccttttccagataccacccaaatcctctatccgccccagtcgaaaacaattgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattttagaataacatttctaagcaattgtcataattgactagggactcatacgtaaacatggttacgaaggaataaaagacaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcggttcttggtccttgcttggatccgtaactccctcgggctctaaaattacgtgcgaagaaacgatttgaattcggttaaaattcaaataaagatccaataaatccaaatggaagtcgaatgcgaaagttgattcttttatattaactttactattcgcgaactagggcaaatccaatttcgatttatacatcctaaactattttgcgggtataaatattttgttagcataagcttttaatttaatctacccgagcattatatccatataataggttagaaattttctatcgcgagctaaatatcggacggaatccaaaaattatcttataatattatatgatttaatttagcctatgactaaccgattaaatataatatacgtctaaaattcctagtgattaaatccgaacttctaccgtgaatcgattacttatagagattatccaaaactaatctgtaatagtctataaaaattcatctaattgtttagtcgttaattacatctaaactactaccgcgaattgatttcttttagaaattaccaagaataatctataatttatattaaattttgcaattctatgaccataattaatctataattaaattctaattattttagatttttcttaaactattaacctccttaatttcttcctaattttctatttatttatccttttctttttctccattctctcttctctttttctttctttttctttcttctctctttttctttcttttctttcttttctctctctctctttttctttcttttctctctttctctctttttctctctggcggcctctcttttcctctccctctctctctcggctctctcccacccgagcggcggcggcggtggacgcgagggggaaggagggcggctcaccggcggcggcagcggcgacgacggcggcagcgacggtggcgcacggtggcgcgggagcggcgacgacggcggcagagcggcgcggcggcacgagagcggtggcgcagtggagagggaagaggggaggaagggtgagatggggtgggggaaaatggagagagggggggtatttgtagagaggggagaaggagagggggaggggctgcggcgtaatggcgacgcgacagcgacgctcggggcgggacgacggcgacgcgcgggcggcgacgcgatggcggcgcggggctcggagcgacaatgcgacgggcggcggtgcggggctcgagacgggcgacgcgacgggtggcgtgaggctcgacgcggcgatggtgacggcacgcggcgatgggacggcgacgcggcgatgggacggcgacgcggcgagtggcgagtgagcggcgtgacaggcgaggcgacgtgacgcgcgcggcggcacggggctcggcgcgatggaatgggcggcgcggcagcggcgcagggcgacggcgaggggacgggcgcgcggcggctcaaggcgcgatgccgacagcgacgcgacggtgacggcgcggtagcggcggcggcacgcgcgacgggcaggtgacgcggcgcacgcggcatgaaaggggacggggccagggggaccacgatcgaacatctatgccgcaatgaacagtaactttttcctatttatcccgattttagcccattttctatttaaatatagccctataaattctaatttttgcataaataaagtttactccatatttgtgttatcctaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccaacttgatttttagggtttattcctagttagttattcattattcgcgattaataaattccgagatcaaaatccaatgaaatagatgaataaaatcggcatgatgcaatttattacttaaaaagtttttgaaaatccatatttttggtgttttgatttcgttggtcgaattttcagggtgttacagttgatgagttgcaacttaagctgtactaaaattcctcacctgtgctccgtggattttgcaagcaatttctagtagggggcaactacaaactacaaacccaactacatccatcctactgttcgtcgcataaccgcaaatcaaactaactaagaatcatatactagcctagcctgcatctttttcgtcccatcaagagagcatccattagggggaaggatttagccagatcaggagacgcacctgactgattcgccgccccggaatggcagccgcggcggtcatccgtgatgcggccgagctgcgccgcgccgcgccgcgctgcctctgctccgtccgcggatcgagctagggctgcccccgacggaaggtggcccccggagaagaagcctctgcgaggggagcccctctggccggagcaagggcacgtacggcgagagtgatggccggaactggagcgggatccctcctccccctccgcctcgcccccatcgccgccgcccgccggtcaccggcacggcggcgcctccggcgatgaaggaagtataggacccacgttggcagccaatccaggcccatattttttggtggaaaggcgggttttccatatccaacccaactcaggcccatttcaagcacacgtgaagatttgtagggtggattaggttcactaccttaactagtggcctaatttaattcatatccctaaaccacagtaccggatattatatttcgacacctatatatgcacctgcactcatgtgtccctgtcaaggtcactgacaaggaggctgtcaagaaggcgacatccatcagagagaccggtgcagaacagaagcaaaagaccgtgccggttgatgaacaggagggagcaggaaagaacttgaagccttcaagactcgttaagcccaatcgtcgttttgttgggccagaatgggccgtgtgaacttgtaagctggcgtgagctggcagctatcttgagagaggggtaagaactgagagagagagagagagtataagaactctgtatccgaattgaatggtgaattttggcaatccggtggcgaatggcggcggcagctcaatcctgttggattggagtagtaataccatagtggagattgcctaagttcctcgtgttcttctgtgtgttcttccttgttcgattcttccagttcctctccctgtgttctcgttcaaggtcgttaacagtcccaccttccgcatgagcgtgacctggatgaggagcgaagctcaacactggtgtttccctcgcgtttggctcaggaggctgttttacacgcatggagtcgggcccgacagctgtgcaggtaaccaaacgaccacctcctgcacccgcacatgtgagccaccctcccatgtagatgaccaaacaaatccattatgctagctaagttctcgcttcccttgcgtatttcggatgtagattttcatccctcgtggatatgtcctcttgttgcttgtatgtcattaaaaatattaaaaaattaaaaaataacaagataaattaatatgaaacatatcactacacaaacatgcagggtcaaattcaatttctacaagttacaacaaaaaaaattaattaaactaaaaatagttatcatactttagcagatatatttgttatttttgttacaacttgtagaagttgaatttgcctttacatgtttgtggagtgatatatttcatattaatatatcttgtattttcttttttaaatttttttaataactatttaggtaatatgaatgaaacgatgggatatcccctcgagggatgaaatcattttttagtgtatttctgtattatggtgaggtgttgctgcctagcttgggtataatgtaaatggtgggaaattgtaatttccgaaattgctgagctagcatacatttacttttagcattcaaagtgatgttgcttgagcaataccatctaagaaaatggagataaacccaggaacaaaatatgaatacgatttttttccaatctttatcactacatacatgaacaatcctgatacctcctaaatatataatacgtactccggttaccagagggtagttgtgttacataaatacagaatcttgggctttcatatagctggaatgtacaggacatcgttgaggtcagctgggtctagcatttgctcgccgtggctaccgcttccaaggaatcctgcgtgggacagcaaagcccacaggtgcgtcgtgagttcacctggcccacggagatgcacgtcgtgcttggccgccttggtggacgcggcaaggtgaagcaggaaccccctccaaaacctgctcaggtctctccacagcgcgacctgctcgtcgtcgccgtacgccagcctcagttgctccgccagctgcgcgcccatcttgactatcgacctgccttcactcccgtccggagttcttgccatccttgtcaggtttctgtagatgtctgccatggatttgcaaccagaaatggcactgctggcctctttctgcacaacctcgtagaccttgttcatgacgaggccattgtccggcaccagtgactgagtgaccaagtatgcgcagtgattggacaaggtgactgcagctatgtaatgttcccacagatcatctgcgataattgccgttttcttcacaagaggtcttgttattattccgaagctgtagatcgtccgcgccgatgcctgatcggagaggttgatctcacacaggcaggtggcgatgtgccagacgagtatcctgtgggtgtcggcctcaagctcatcccctgcccacgagatatcgctgacaatgtcctgttggttggttctaaatgcaagcggaaagtaggattccagatcattgtcattcgcgtttcgcagtgcactgaatgactcgaacaaggcgctcttaacctctccctgcagctttatcttcacagggagaaatctccctttgagatgacgatatgcgaacaggacgcttctttcttgaagaacatccaccaagatgttgtactggccgattcgctgattccatttggcattggtgattagtctgcagaaaaaccccaatgcacactcaaacagcggatgacgcaaccttgagtccttgacgtacttgcacagcaccagtactttggtccactgcgaaagaacgtaaattgcaatctcccagacctctttgatgacgacaaggacgatgatacagtaagtcacgaacaacttgctgtccgtgtccgggctcttggataagcgatgaacaacaaatccaagatacatgactgcactaaccagagatcctgccaggagcatcctccaacccgggaaccccttggcgaacatgattgcgtgtttgctatagtggaagtctctgagaaaccgcagctccacctcggtgacgcggaacgccctctcgtagtttttgctacctctttgcaggatgtaatcgaagacgagtctcttcgtcttgggttgccgggcctcgtgtatgggcaggttgccgaacctacgccggagaagcttgtacagcgcaaacgagagacaaacgtccttgagccggttgtcttgatccactcctccaccaccgagaaaccggctgccgcgaagactccataccctctcaacggtgaccatctcatcagggttcgtcacgtccagctcgagcttgaatactggaggctcgaccttcatctcctgcttgccttctcctaggaccaaatacctgtaccctgccatggtggctggatccacatcctcggggttgccaagttcatgctcgtatctcatgtagttgcttacgagcctcatgttgttggtgtggatatcaaatgcgctattggaggagatgaagaaggcgatgatccgcagcgcgttgacggaccagatgaaccagagagggatcttcaggctcagcacggtctgggatctgatgaggttggctgcccacagggacatgagcaggtcgatgagggacatgtccttgctcttcctgtacgggatgccgatcctcacgctgtactgcagagtgaccaagaggacagcccatacctggaagaagtcatctggtttttcgtcggacgatgagagctgcatgagtcccagggtgtagtgcaccaaggagtagttcaacagcaggatagctcggccggcgttgttcagtggcctcaaggagtagtacagtggcgcgatggcgccgacggcaaacttgagccgcaaggtcaccatggtcaccaccacccagaactccacaccaatcgtgccagtgctctcatcttgcttgaagatccctcggatggtttccacaaccatctgtctgaagatgtaaacagcaaacatcactattgatattgatcctatcagtaatttgggggatataattcggcccgatttgcacttcggatcagcctttcgatcggtttgggtggaaggagtactacgcttctagctttgggctctgccgggagatgagagagggataggacttgtatgaggatgcttgcaggaacgatatgtactggacgaagggcagaagcaaatatgcaaatactaattgtcttacgagaacatctatctatctatctatctatctatcttctatctattactccctccgtttcaaaatgtttgataccgttaactttctagtacatgtttgaccattcgtcttattcaaaaaaattaattatttatttattcttttcatatcatttaatttattgttaaatatactttcatgtacacatatagttttacatatttcacaaatttttttaataagacgaacggtcaaacatgtgctaaaaagttaacggtgtcaaacattttgaaacggagggagtatatactaaaagttcattaaacatcctataaacactcctagattgccatgtggcactctacaaacgctcttaaatcgccatgtgtcattctaataaattaaaaggaaattcaagaaaaaacaaaatatctaaccgtagatttttattaaatctggtggacccattatttacaaccgttagatctattttaagaaaataaatatatgcctcccaaacctggccccacccagagcctatacttggacgtacgtacgtacatcacgtacgcccctatccctcaatccctttctcctattttccttcaattatctctcctattttcatgctatattaagttaaaaagcataatttgtgttaaaaattaaacatatctgaaaataaaaatttgtacaatatattgaaattcctacaatatattcatagtagatacttaaaaatatgaataaataatagcttcatgactaacctaataatgttattttgacttatcataatttcagaatggggagtgtaatttttttaaacataattttactttcattatcattacaggactaattaattgttgtgaagctatatatgtaggatgataaaataatatcaattttttatatttttatataattgtttgaatgacacgtaaaaatcaacaaatataacccaaaagtaacacatttctttgaatgttaacatatagtgaatatgggcctttaactataaatttagacatagataatataatttaacaaaataagtggataaaaagtagttgtataatttcattcctattgtttttatgaatttttattatcacaaattttgctttccaattgtataataagaaaataggatagggaatagaacatacagataaacgacatgaataagggggaggggcggacaatgggactaagcatgaccacgcgccatgtatagtcctgtgtagggttttagatgtggattttttttaatctattggttgaaaataatggatttatcatagtattaaattaaaattgatgcctagatgtgttttcatataattcgtagaaatatctcataatatattgaagtatagtatcaggtggtggatgtgaaattaattatgaagtaaattatttttgcaaggttattaatttttatgtggtggctaagtatactaattttgaattatgcagcaaattcttaggttaataataataatacatcaatttttaagttaaaatacatctcaatatgggtcttaaattgcatcgtggacaaagacaaagttaattaggtaattatgcctctctgcggcaagcttgcaattgcaccaatctccagtagtcataattttctatgatgaattacgtcagctatcaatcgattatgtctgctagtaaataataaattaattattgattttttacacgaattggtagaacaattaattacatatggttgcatacccaatatcttttatagcaaagttttctctcttttcaatagaaattcaagagtcagatgtcataggtaccataaaacccaatttccagtagataattttataaatggcataattgaattcatcatgcaatactaacagagagaacagagacaaatcgtacttttgaaatgtgttaggtattattccgttagtatactactaagtttctgaaatgctatctacgatatatgcccgcacgaatgcgtgggccacttttctagttttcttaattatggctagcagacagaactcttttgcagttgacttgatttttttttactatttatagtcccgtgagtcgttataacggtttctttattcagtttagctaaacgatttggatagagttgatttattggttttctataccatggttggtctttttaattaagaaattggttgttatggtatgaaggtagtttttaggagaaagtgggcgccgcagagtttctccctgtggaaggagaacgactttgcttcttgaacttgatacatatatactactggttatcgtcggtaacagcgctataggtagactgatatttatgtagcggtttcgcaggagacgctccgtgcagttctcctttgacgcgtcctatccagggctttccatttcggaaagcaagaaaatttcagtgggcactgaaattccaaagtttcggaaatttttaaaagaatcgtatattttgaacgagtttttttgaaattgtaacacatttttactgaatttgaaaaaattataaccaaaatcacaaatatttaaaaattttcaaaaaattcgctcaaaatatttgcttgctggaggggttcgaaatttcgaaccaaaaattccatccttggtcctatccggctcatgtttgacggtgcaaactgtgcaaggaccgagcatggaaagatactacttcttccgtattttattttaatgtatgacggcattgactttataaccaacgtttaaccacttgttttatttaaaatttttatataaatataaaaatacttatgtcatgcttaaagaacatttaatgataaatcaagttataataaaataaattataattacataatttttttaataagacgaaaggtcaattgtttattaaaaaattaacgggtatcatacattaaaataggagggagtaaaaagtactacaagcattatatacatcacgtaacacgctatctcaataccggggccatcgtcatcggctcggcgtaaacttacagtcacagagtatcattgccgcttcaccgtcattttccttttcatcaaaggggagaagccctccatttccattaatagaagtgtagaagtgattacaacaaaaaaaaaaagaagcgacccaggtccaaaccgataatgaaaccgatcaaaccgtggcactaattaagaactatagttgaccatccgtccatgtctcaattaccatcatgattaggtcaatggaatcgttgcacatccaggtttgacaaaaaaaaacaaacatgattcagagccaacagtaatccattatctatgaaacaacagaacatggggaccacaaaaaaaagcatgttgcacgctgcaaattgcatgatcacttctatagtaaactgcaaattgcaaacaaaaagtctttaaaaaaatgaataaataaactaaaccaaatgtcagcttccacaaattgaaaacaaattaaggttgtgtttcagaagagaggaaggacaagattgaaaagatacgtatgagttaagccattagcattagcatatgattaacgagtattaattattttaaacttaaaaatagattaatataatttttaaagcaacttccctattgtcacatcacaatctggcaccgccgtacaacggcacctgataggagcgtgttgtaggaaaaacgacgcgaaccgctttctacgaaaccgcgatctcagtaccagtcccaggacatagtgctggtacccacagtgacaaatatgaatcattgcaatccttaaaataaatagaggacttatttaccttaacttagattgcagctcagaacagccagagaatgcaaccgacgacacgaacgaggaaacaccaacaacagcagcagcagcagcggaaccaacgaactaacacccaacaccacaggcgacggctgggaaccaggacgaaaccctaatcttcacttcacttcacgacggaggaactatatatatttatatagagcaaggatgagtactttcgtacttagcaagtcacgagaatttaggtgtttaatgcaagcttagaagagaggcaaggttgttttgcaaatcctttatttgaaatccattttgaaaccactaagtgatttatttctttttaagtttgggtcgaaaagagacttgcgtctcaactcgacttaagagatgcttttcaacaactcaattggtaatgtaccgacctcccgggtcagatcattacttctcggctcccagagccatttcacttgattaatcggctcccagagccttttcattttctcggactcccaaagtccagctgcccagcagcacaacaatctgcttccactcgggaagcctagtctatgatgcccgtagacatcccgaatcacatagattcgttccttgaccactcaagtcatccatctgccacataggctgattctggtaacgattcccaaaccacaacaacttttcacaaagcattggcaaacaaatctacgctacaggaaacacctcacatccgcccatgaccgtgggcacggctgttcgaacagttagttaacctctgcagagggggtacactttacccacacgacattactaacccggatcacccagcccgtgagatcaaccacatcgggagaccttaaggctttcatgacaaggcatttcgaaagccgacacaggtttaccatacgccgacaagaggggtcccagaccaacaacaggttaggtcccagaccatactgtgccaggaagcccaggggtcctacccgacaccaccctggagaatccacttctctcggcatcaaggctcccctgattagctacttacttagccaggggtgtcccatttcacccatgtggtcgcacttgttatatgctcggatgaattccccacaggaatcggtccttatatgcgaatacgggacagtgccacacaggcacaacccccgcatcgcgagttttcataatttattttattttcaaacacgccgacaccacatgtcgagttttcaaggcttcttaaacccatttcccaagttttcgacaatcaacggtgtatgtgggatatttggtatacgcgctcagagagcacggataccgaagtaccacaagggtggagcgacaaggaaattagggtatattagcctataggaagtagtgcgactactgggtaggtccatcggtttggcacgcaaaccaaggccaagcatgttatgagtgtgttgctaattgttgtcgaaacgacaaccgcatacgtcaaaagacatggtcacccaacagtggttggaaaagaagtaaagtgtattaatttgagaatttttcttcggatccccctattacatggccctatgagactatttatagcccccattacagattcttactactagggttttggttatacagtggaatttacatggttgcccttataaagggacatttacatgggtacatagtgtaattgaggttcatgggcccctgatgggccgtcgggcgatcatcggcccaatagcccctaggcttgatgggccggaaaagcttcttcggtcctcgctggggcgaacttgctatggcgaagtcgtctcccttcggcatatattcttcgccctgcatccttcgcccaagaggcctctggcttggcaaagcacccgcgcaatccctcgcctctcgccgtccctgttccatagtcttcgccatggggggacttcgccctgactaactttgacgtctcgggcttgaatccccactcttcgcatggtttcggtaggtttggtcgaagggcctcatgccataccgccaacaagcccctcatgggcaagggtgagattggagcttcggccgagaccatgcaaaccatgtggtatggtatgtggcgccccctttcgaccgatgctcctgccgaaacctacattgttcctgcaaatagagtttgttgtctgtgcggctggtatcgttttgccgctcttcgcctcctgcggacggtggtatattatttttatttttcccgggccgaaaggaacagtaatgggccctccctttgtggctttttactgtgcaacttggtcgatgggaatttactgtttcacctaccctcgcgacacgtggcgctttattactggtgggtaggcgaaacgtcacctgggtgggctatatattctctccccgttcccttttcaccgctagacccgtcactttcaccgctcacgcgctcttcctccgtttttgctttcacggcaccccttggccctttagacccttctctcgccccctttgttcgccactgcacacacccttcgtcactgcatatatccttcgtcatggctccccgcaagcctaacccctctttggcgaaagggccctaccccggtcggattgacgacgacaccaccgcctatttagggatttcactcatagacgacagcgagttggcgaagttggtcagctctggggcattagtcgaggggtaggctttcgccccggggaaagctgttgtaccgaagcccgtcgacaaccggacggtggtgttcgccgtgttttttgaggcggggctccggtttccgtgcaacgagttgttgccaaagatccttcgccttttccatgtggagctcccatagttgagcccgccggcgctggttcggatcgctatctttgactaggcgtgccggacttccgggtttgagcctagcgccgaactcttcggtgccatatttttcgccaccgtgaattcgaagacggtgattaccccggctagaacgaagaaaacagtgtttgggagtgtgaactttaatgttcgccccgagcggtccgatctctggccggtgaacgccgccatgtcgaagtgggaccaccattgatggcgaggtggttttaccacaccatccccttcgaggctggttctgactcagcgaaggccctccggtgccggcgcagggcgattgcgccgaaccgaaaacccaagatcgccgtggacgccgctatggaggcacgattcgctctgctgcgtaaggattgctcccgccttagctgtcgcgacttggtggaggaattttgtatgcttcgcatctttcccctctcccagtcgtggcaagtcgcagttgatcaaggcgaagaggttgatggtttgccgaagttggttctccctgagggaacgaacggtaagactgctctttcgctatgcactcttgcgctttgttattttgctttgttcgacgcttaatgtggctacaccctttatttttgcagtgttgaccctcgaccaggttgacgctgaagctcgtaggatgatcggcgacgtgtcggtcgtcgagtatagccagctgctaacacgacaaccagctggccaggcgaaccgagtttacaacggcgaattgcctccccgggcgaacccccacaaagccgacgacgatgcagggccttcgcgaaagcgaacacacggacaagtgaagcttgcccctaggaaacgaagggttcctacttcctccgattccgacgccgacgacgaggacgacgtcgaagagcgtgacggcgaggacgaaggagaggaagaagaggaggcggaggtcgcagccgaaaaggccgcggacgaggcggtcgaaaaccacgtcgacacccctggctatactcctactccaagtccaggtcacaacaagaccggggtggagtcgaacagctccccccttcgtcgaaaggatttggagggggcgaaagcgctagttgcattttcggcaggcaatgcggcgaagggaggtccgatcaaaaagatctccaaaaagaaaggactcgtcgacgtcgctcacgttttcagcgatgacgagtcctctaacgagactccgacttcgcccgctggccgcagcctggatctttcgaccgcccccattctttcactcggcgctgatggggcaggtggtagcgccgccgcctgggcttcggcctccgcagaacggatcgtgacagctgcggcgatggtcttcggtagccctcagcgtcagccggttgtttcgccgctagtcaaggcgaaggggaagggtgcggccgtcgaaacttctgcctcggaatattcccttgcggcgccccacttcgcccctggcgatttcgagacccgggcggaccttattccctttgtcgagggagtaagcaatcttgtcttacctgccagcaccccaagcctattcaccgaattgaatgagttcgattaggggtgttttgctattaaaagcttagcagttcgggtatgctttttctctcttcttgattttcctcttctttttacatgtctcataattaacatttgctctcttcgcctgctcctatcttgcacctagattcttgcggctcactgttcgacagagcgaaccgtgcgggcccgtcttgacggatttaagaaccgtcttcgggccaaggatgacgaaataggccgcaagaacttggagatggaagccctcgccaacaccctgaaagaggcaaaagccgaaaacaagcagctccaatccgagttggagaaaggaaaagaggcgagggccgaggttgatcgcctcaaggccgagcgggagaaagaaaaggctcattccgccatgctgaccgattattataacctcactgagccgaagatggaggctcttcgcctggaggtcagcaaggctaaagcgagcgctgtggaagagtcgcagcggttttcgcgggagatggcaaaaaccaccgaatccgcgagaacggcgtgccaaactctccgcctcgccattactgacatgggtgcaaaggtgagcggggtccctgccgaagatgcctcggccttcgacttctccgagtggacccagcaggctggtggttcgatttcgaactgcgccactgtgtacagcgattgttgtgcgtgcatatcggcgacctttactatgggccttctacaacagtttggctgcgagcacgtcgccgagttccccaactatgcgaagggggactgggagatcagtgtgcagaacatttcgcgcgcgcttcgtgcgtggcgaaaacagttctggcagaaagacgccggtccgctgacaaggcgcaccttttggagcaactggcgaaggcagaggcggcagaccagtgcgaagaagaggacgcggcagccgaagggggtggaggcgatgcccaggatcacccagaggtgtgaggccatccgcccttttcttagattttcctagtttcccttcttcttttgtgtttgccgatagtggcgaacgatgtatattcggcaagccaccgctaaccccccttattgtagccgaaaaagggccccttggatatttggaatatatgactcacttttagccacctttttgtggttgaagtctttggcgcattatgattacgcccatttcacattgtgcagtactttctcttttttttttctttcgcctattcttactatgcaaatcgtcttttgccctttttgcattgtctatcagggtgttcgccgaaagttgtgcattcagcctccttccgggagttggcgaagccaaaacgagaaatttgtggcactgaaggatttgtcgaaggtacgatgcccatttcggcctgtttatcacaaaatggtgataaacggccgcagctataaggtttttaaggttgccgggtggctgcgggcgcaccccgggcgaaccttagaagactacgagcttgttcattcaagacgtttcgaggatatggctcgcttttggcgaaaccatcggaagactgatcggcaggaggtgatctcccagcgtcgttacagtctagtctgtgtttcgcccccttctcctcttagggttgtgtatgatattagtagcgatgacgaacctagttcgcctgatcattccttagagagagagtgatcgcaggggcgaagatgtaatttatctgtaagctgagttgtaacgccattgctcttttcttatcacttgtaccattgtgatgggtttgtattcttcgatacatttttattcaaaatcaataaaggtgcgttttattttcttttcgctatttttgcattgtcacttcgcgtgcttttcgttgggtcagaacgtgtcggcccctttgcatatattagcgaaataggttttgacttttcagctttcggcttccatttttgatcatttttgtaagcacgagtgctttccttttgatcgagtgtaacggtgttcggctagttgttctccgaaacaagctgttgcggtttcaaagtttggcgagcgatgcttcggccgattcgtttcgccccctggcctttttcgctgatcaggcgtttgccttggggtttttccacaaattatcaatcatacaaacaaacaaaaagaaggcggaggacacagagattttatactggttcgggcctccgtggtggataatagccctacatccagttttttttgtcttttttcatttttcctcttttttttttcttttcttgacggaaggcttacatagtgccgaagggcttacattgtgctgaagggcttacataatgatatatacatttttacaagttggcgatttgggtgccacccgttctagacatagaaatgcttgaaagagacagtgttccaggaatggtcgaactcttcgccttccagtgtcgccagtcgaaaggaccccatccgggacttgtgcttgatgaggtacggtccttcccacttcgattcaagcttgccaacggctaccgggttcgccttcttccttaggacaagatgaccaggcaacagctccatcggtcgaacttttttgttgtaagttgccgaagtgcctgtggcgtacttgcgtatgtgctcgagtgcttcgactcttaccccctccaagagttcgagcgacacctcgcgcccctcttcgtccccagagaacatcacccttggtgagttagcccctagctctgtcggggtcattgcctcatcgccataaataagcatgaacgggctgaacttggttggtcttgtgggggtcgttcgaagggcccagagaacagatagcatctcctctggccatttgcccttcgctgccccctcaagcctttttttagtgcttctaggatcttaccgtttgtgtgttcagccgccccatttgactgtgggtgcgcgaccgatgcgaacctgatttccaggttaagcccttcgcacatttctctgaacttgtcagagtcgaattgcttgccattgtcagtgatgaactcttttggcaccccaaaacggcaaacaatgtttttccatacaaacttctgtactgctgccgaagtgatcgctccgaggggttcggcctcaatccattgagagaagtactcgacggccacaattgcgaacttgtacccgtttcacgccaccgggaacagcccaatgatgtccagtccccatctggcgaagggccagattggtgcgatgggctgcaactcatactggggcgatgtttggcttcggccatggcgctggcagctttcgcacttcttgacttgctcaacacagactttcaacacagtgggccagtaaactccttgtctaaacactttggaagcaactgttcttgcggcttggtgtgcgccacatagcccctggtgtatctccctggccatttcctcgccttcggcaaaagagatgcagcgaagcaagggttgaagtaccccggagcgatagagctggcctgagaccatcttatattttgtggctctgagttgcaggcgctttgcttctgcttcgtcttccggaagccagccagtttcaaggtgttttacgaacggggttcgccagtcgtatggatcttcgcccagtttctcctagtcgattgccatgacctccaagctctccacaggcacgcttggtgcaaacaggacttcaaaaaaggtgccaggcgaatgcggtccaccacaagcagcagattttgccaaggtgtgcttcctcgttctggcctctaggtaaatgttcgaccgttatgccggtgaaacacttttccatagaccgaacgacctccaaatacctcttcattccttcttcttttgcctcaaaggacttgtcgacatggcccgccaccagcttagagtcggttcggattagcaagcgccgaacccctaatgctttcgcctttcttaggcccagaagaatggcttcgtattctgctgcgttgttggtcgtgtcgaactgcagccttgcggcataccgaatcggcacaccacttggcgaaatgagcactgccgcaatgcccgcccccttgtgcgaccacgaaccgtcagagtacatcacccagggctgtttgacgggctcgggctcgggggcgagtgccggtgtccattcggccacgaagtcagctagcacttgggacttgatagcagtgcgggcaacaaaatgcaagtcaaaaggggatagctctgctgcccacttgctaagccggccggtaacttctttgccccagagtatttcgcccaaagggtactgcgatggcactatgactttgtgggtctggaagtaatgcttaagcttgcacgaagccatcaccagggcataagcgagcttttccatttcaatgtatcttgtcttcgctccttgcaatgctttggagatgaaatagaccggtttctgccctgaatctatttcttggacaagggcagcactgactgccactggcgaagctgccaggtatagtagcagttcgcttcctggtgctaggctgatcagagctggcgggctttgtaggtattgcttcagctcgccgaacgctgcttggcattcgggtgtccagtggaatttttccacgccccggagggtcttgaagaagggcaaacctctttcggctgcctttgagaggaatcgattgagtgccgcaattcggcctgcgagcttttgtacttcacgtacgctcaacggaggcttcatttgctgaatggcatcaattttctcgggattcgcctcgatgcctctttcagaaactaggaaacccaacaacttgccggcgcgaacaccgaaaacgcacttctcaggattcagtttcgtacccgccgcgcgcaagttgtcgaaggtctcctgcaagtcggacgcgtggtcgaaagccttgcggctttttacgacgacatcgtcgacataagcctccacatttcgccccaactgcttgtaaaggaccttgtacaccagcctcgcgaaggttgctccggcattcctcaggccaaaaggcatcctgaggtgacaaaaggtgccaaatggtgtgatgaaggctgtcttggggatgtctgccgggttcatgtggatctggtgatagccggaatatgcatccaggaagctcatgagttcgcagctagctgtcaaatccacaagctggtcgatccgtggcaagaggaaatcgtccttcggacatgctttgtttaggtctgtgaagtcgacacacatgcgccattttccgtttgacttccgcacaagcactggattcgccagccactcaggatggtcgatctcttgaatgactccagccttgagcaatttttggacttcggcttttgctgcctgttggcgatcagcagacatcttgcgtagcttctgtttccttggcttagcatctggcttgactgccaggtgatgcatgatgagatctgtcgaaacacctcccacttcatcagagccccaggcaaagatatcaatgttcttcttgagtgcctctaggatgttctcagcttcttctttgcccatgtcgccccccaacgatacgagctttgcggggtcggcatcatcaatctatatcttgattatcttgctgtgaggggcgggctttggcacatgcttcgcccggtcatgcggttcggcctcaacattgtgcactgctctgttgattatggccagatctccttttgaagcagccaaaggctgaagccccttgaccacgatcactcctgccgggccgggcatcttgagcttgagataattgtgatgagaaatggcttcgaacttgttcaacgttgcacggccgaagatggcattttagttgtatgggatgtcgacaatgtcaaacaatacttgctctgcgcgtctgttttcccccgtgccgaaggctaccatcaactgtgcttggccgagaacttgaactgcttctccgccgaatcctcggagcgatgctggtgctggggtaaaggcttgggtagtcaaccccatcttggcatatgcttcggcaaagatgacatcggccgaacttcctccgttgaccaggactcgccggacctcgaaaccagctatatcggctgagatcactagaggatcttgatgcgggaacattaatccttcggcatcttctggctcaaaagagatttgctggttcagatactgcggagcccctgccgaagcgatattgtggaccgttcgcaggtgcatcttcttctgtcgcttcgacagttgtatcagtgggtcggcccttgtaatcacttggatcactctgcgctgcgcatcatggcgttgttcggccgggggtgcttgttcttgagctacttcacgagttgcttcgaccgctgctccctgttgcgtccttggatcttgcgcgttgctacgttgccgaatgtttcggcattgcttcgtggtgtgtgaagagcgtccatggaaggcgcagtagaggtcttttcagaccttcttgcggacaggttgttgatggttgcttgcttgctgggcgtcaaactccttgcgaagggcttgcactccttcgacagccatcacagccttgcccgcatggttggttctgaacttcctccaggtcatgggggcttgaccttgccttggcagttgtccttagatcgccggctggggctggcgaaccacgagaggaggtggttcggcaacttgaacttgttgttgggcttgagcagcggcgacggaggccttatcgtactcggcttgtattgcttgccgtcgcttgcaatcctccttgccccttgcgaacccgtcaatgatgtgaagtaggtgctcaagcgtttgcggctccttgttggcaatttttcttgtgagttcgccctcgagtagaccagctgaagcggcgtttatgatagacgcatcggttatgtcttgaacttggcaccgggcttgcgagaagcgacgcatgtactcccttatcgactcccccggcctctggcgaatgctgagtagatgctgctgcgtcttcggcttctcataggtgcctcgaaagttaaggacaaagacatcgcgcaattgctcccatcagtaaatactattggttggcaaattgaaataccaagagcgggcgatgccgtctagggcgagatgtattacctttgccttggtattttcgtcgccatgagccgcttcgatcgcggattcataaatggagaggaattcctttgggtcagtttcgcctaagtagcgtgggacgggtgagaacttgaactggggtgggattggatgggtcttgattcccccactgagcggtagccccttttcgccccctgccctgttcacggcaccttgctgcgggtacggtgtggcgaagggcaaaatcacgacttgcgcgtgtggttgggccatggcattcggctgcccggccccgattggtgatgtttgctgagccgccatggatgggtcgaaagttggttgtgaccatgtcatggtgacctggtttggtgcttgctttgctccgaagcctggcgttggtgtttgcagccgaacggttggcgcctgagcaacattgatggagtcgaactgcagtccttgactccacggcgaagcccccagacctggctgattcgaaggcaaccaactaggtgcaccatgacttgtattcccctccgggtgagccgaaggggcagtacttgaaatgttgtggggttggctgagctgttgaaggaaagcttggagctgcgcctgcagagccgaagccccttctgccattgtatgtggcacttggccaggcggttgaggatgtacttgggcagcaaccggttgagcttgcagttgcacgtgaggggccggatgcgctgctgcggtcgatggctgcccggcgaagtacattggcgcttgtgcggcttgtggcggaaggggctgggtcggcacttgtggatagacttggggtgggacatagcctgccgaatactggaggattggtgccgaagtgaccttggaccgccttgccgcctcgtacgcttgctgctgttcctgcatttggcgaagcatgtcttggagtcgtctcatgttctgtcgcatggcttccatgtcggcttcggtttgtgtctcggggtcaaggttgacttgggcttgcgcagcggcgagcgcagttggggccactgccggctacgatggggcggcttggggcaccagcaattggcttgtcgaaaggatctccgtcctggtttggagtgccctcgccaccgcagccaccttcgccatgtcagccgcgttcggcacctgcacagaggcagtaggggccgaaggcggtagtgatggcgcaggtgcggaagcagatggcgctcctccatcttcggcgacaggcgccgaaggctctgctccctcttcggcggccatatccgtcccggcgtcgctttcctttcgcctcgtaaccttctccttcacaaccttcttcggtggcattcgctctcagtggtttcgctcggaggtccccacggtcggcgccagctgttgtcgaaacgacaaccgcatacgtcaaagacgtggtcacccaacagtggttggaaaagaagtaaaatgtattaatttgagaatttttcttcggatccccctattacatggccctatgagactatttatagcccccattacagattcttactactatggttttggttatacaggggaatttacatggttgcccttagaaagggacatttacatgggtacatagtgtaattgaggttcatgggcccctgatggccgttgggcaatcgtcggcccaatagcccctaggcttgatgggccggaaaagcttcttcggtcctcgcgggggagaacttgctatggcgaagtcgtctcccttcggcatatattcttcgccctgcatccttcgcccaagaggcctttggcttggcaaagcacccacgtgatccctcacctctcgccgtccctgttccatagtcttcgccatggggggacttcgccctgactaactttgacgtctcgggcttgaatccccactcttcgcatggtttcagcaggtttggtcgaagggcctcatgccataccgccaacactaataatgcgagttgcaaacaaattaataatgattttctaattataggagcaattggttaaagggtgacttgccttgctcaagatcttcacgaagcttcacgaatcttcgagaaatcccacgatcgacaaaaatccggtaaccgcaactatacgcaaacaatcaaaacctaaacaaaagaccaagagaagatcctatttagactaaataatagtgacattagatagatctcaaatttacggaattattggaagtggaacggaggttaatcggagttacggatcgagagatatgatttttggaagtttaattggattttctggacatggggatatatttgtggaataaggaaaattgatttatggaagggaaaaaaggatttattaaatttatggaagagaatatttgtggattattggaaaagatattctcgagaatattttgactcattgacaagtggggcaaacaagaaggtgagagcgtaaattgagagggagcagatatggactttagctcatgagggatggacactgggcttggagggagggactagaagtggacttttcttgtttccttaagccgagaagggaggccggccaatgggccaagcccacgagcgcggagagagagaaggggacggctgactgggcaggggttgactcggtctggtggggtcggcagatgaggtggcgtccacgtggatgccacgcaagcgcaagggaaagaggaggccggagaccgcatcggacggccggcggcgcgcggagcgtcccggcgaacggcggcgagacggagcgaggcgcggacacctgtggcgagaggaggagatggggaatcggttcaccggcacggattagagagaggaggcacgacggcggccggcggcggcagcgaagctcgccggatgtccgacgtggatgcgcgagggaagggccaagagcgcgcggggccaggcttagccgaaacgattcggcattgcgacgcacacgcgacggcacggagaccgatggttgccggacttgggctcgcggtggcgctccgcggcggcggaaggggcgacgcggcgaaaagggggagagaggagggagcggccaaggcgatgtcccggggaggctgctagggacgcggggagggtgatggcgatgggattcgtagggagaaggaccgacggcggcgggagactgcacacggcggcggcgagaggggaggcacggcgccggagcggaaggggaggtcggcggccgagggaaaggtttggggaggtcgagggggtcccgaggaaggcgatggcgagccggtttgaagagagggagaccgacggcagcacgcggccatgcgcggcggcggcgagt

SEQ ID NO: 39449 - DNA, 6682 bp, Oryza sativa
cggcgacggcgagatcgggtcgagcggcaacaaggcggcgacggtggttcggcggcaatggcgcggtgggtgcgaggcgagtgaaaacgagagaggaaggggtttggggcggcttgggttttatagtggaggaatgtctgtttgtggagggaggaaaccgacctcgtgcgctgtcaaggatgcaagggcggcaagctggcggtcgacgcgtgcggccaaggaggcggcaggtgatgacgccggcggtgtcgggcaaaggtggaaaaaggagaggagaaaggggctctgttctttgccgttttttttaggagagacgaaggagggggagggcacgagagagacgctgcctccgtgatttggatggttgcggcgtggggttgcagggccaggcagcgcaggcgctgacggcggcgggcgaccgggcggtcggccttgaccggtcgcgggcgcccaaagcaatggcggtggcgggaggatttgcaaggcggcggcggaaatcggttggcgagagagggaagccgagagagagagagagctcggctcggcgatggttcatgcgcacgcgcgtgcgccgcacgtgcggagcgagggaggggaaggcggagagagagaacgggccgagagagagaacgggccgagagagagatgggccaaaggaggacatcggtccatccaaaagcagaggaaggcacaatagactttttcagaggggttgaattgttgaggtttagggtttagattcgaattcaaatttgatattcgaactcgagggtttagggaggaatcaagggagactcgaggagaagtcaaggaagagattcaaaatgagattttgatatttttgggaacggggacaagtatttggcgatgagttcaaaggaggaggttgaatttcggaaatatatttcggaaggttgaaatggaagatggattccgaggaggcgatttttgatggcgatgagagggatcaaggacggatttaaattgagatcttggcacgacttagacttacactcaaagaacgaaaattttcgagaatagggttttgccgaattagtttttaacgtcatacgaaaagcggagcgttacacctatagaatttgttggttgaaaacagtttgatagttcggaaaacgtgcgcgcgtgaaaaacgagataaatctttagcctttcctaagtggccgaaccgtgcctaaggtcctgtttagattacactccaaaactttacaccctgtcatatcaaacatttgaacacctgcataaagtattaaatatagtctaaaaaataactaattgcacagattacgactaatttatgagacgaatcttttaagcctaattgctccatgatttgacaatgtagtgctaagtaaacatgtgttaatgatagattaattatgcttaataaatttgtctcgcggtttacttacggattctgtaattagttttttattagtgctcgaacactccatgcgataccctatataatatccgatgtgacaagagccaaaattttatacccttgagtgtaagcgcccggtaaatattttgttcctccaaaactttcccttgcaagacaagtttaaggtggttgaggaaaaagacgttttgtacagttttcaatcaaattggcagcagttcgctagctgttatggaatcggtggtggaataggagaagatgagaaagaggaaggggaacgactttgcctctcttaagccttgaagtgctcgatagttccttatgtagcgagcatgcatgcgtcaaatagacacatgatgaaaacggtatggaaacgaatggaaactacctctatcgattccattttcatttttcggggggaattaattggaaccagaaaccttggatgttgagacggaatcaaatattgtcgaaaccgaaaacatagagaatactaactgacacggatactgtaacgaaaatttattgaaatacaaccccccccctcacctcaaactgagcttcaaactttatcaagtccaattacaatctcaagtctcaacattcaacggtacatcacaaaacacaattaattagaatgctaacgtgaattgggttgggctattattagggtatatggacatggtatggaccttttctcctatttgggagagtttctagctgctatagcttcttcaagaagttccagctcctaaacagtttaaattctcctagattctaaaaatttggagttataaaatctagaaaataaactagaagtcggatttctcagctttatgggtatgatccgactagtcaactcaagtcggaatatgactctgcttcttttttcttatttggagctctttctttatttattcagaacttttgccatatgtataaggcttgattcaatattggacttggtatatagtgggtcgcgttgtacacaagtatagggtatcccatatttagaacactaacctatacaataactgaacatctaattttattatagcactttttaggattagtctatatatattgttttagtgtattcaaactaaatatttttgaaatgattgatagtcaaagttgtaatagtttgatcccaacaacatcaagaattgtgaaattggaaggagtataaaaaataagaaatgaggaatctgggggtagaattaaatttatccacttgatggattgatggatgcttcttagataatgagcttgatgccaactgtctgaaacatgtgttaagcttctctatttaatttgatggtcaagctggtggcttcaaaggtacaacctctaactctatttatatgtcacggtgtttcttattgtatacctcctccgttccttaatacaagggattttatcattttgcttgtactgtttgatcactcgtcttatttaaaaattttgtgcaactgtagaaaacgaaaagttgtgcttaaagtactttggataataaaataagtcacaaataaaataaataataattctaattttttttgaataagatgaatagttaaacagtgtaagtaaaatgtcaaaatccctcgtattaagggacggagggagtatgttcaagtgattggctaagtctgtcaaagctacggtgtttcttgttgtatatatatagattcatatgtcaacttacaatgtgttccgcttcgagtcgagctaatttctggccagagtacgcaagtgcgcggggtctcgagcagagatcaaagtggtgccatctggaggtcgatcatcgctgtaagcttgctcggtctcgatcggcttaacttcgtattgaggtacgtatacgctctgatcagcctttatactcttatatatgtctatcgacatggattgctggtgcctcatctggagatgtaaaagatcttcgagtttatctcttatgaaacagctgagattaatcaaagtcttcagacttcagagaaccattaggccataaatttatcttctgcttgctctcgctcgatcgagaaatgtactatcctgccaagctctttcagaataccaagataaatcacatccccagttctctcacatcttaaatgttgacgttcgttcgttgactcctttatggaaggtgcatgtcatcagcgatttcttcttcaaggcgttctgtcgtcggctatttttttttaacgaatcacacaagacggtgcgatgttttattaaaattataagattacaaccaggaaggtcgtaaccagaaaaaaaaaaagtataccaccatcacccacacatcaacagcgccaacacacagaaccaagagaaggttagcactagaccggccaccgctaagcgtgaccagctgccactatgctaacaaagaaccacggccgagatcgcccaaaacccaacccttacaatcaacacaaagccccgctctatccaagtcttcaggagttatggagagagggtgagagagaagaatggaacacctctcccccttaggccttccgacgtggccaacttgtagagactagtacgccgcttacaagaggatgaaatctagagggagcttgcaccaattggttgtggggtttcggctaggggatgcctagacgacgtctccaaggagagaagcgacggagaacactaccgccgccgccgtccgtcaaggtcttaaagagaaccgagactgggctttcgttcggcatccacacatgagggatgagacggcacgacaacgccctcaggaggggaatgacgctttgagcgtcatcattgccggcccggccgaggctaggctaggttttcacccgccactcatcacctacaagtccacggctggcgcccagatgctccaccaccgtccaacctctgccaacatgtgggtccactgcaccagcgcccaccgcatctaccggcagctcctcctcctcacaccgtgcccggctccgtcgccgccggccgcgcctcgtcgcgtcgtgcctcaccgcgccaagctagtctcgtccatcgccggctgcgcctcatcgcgccaagctaggctcccattgccgaccgcgtctcctcgcgccaagcccgcctccaagcgccgagccggcctccgctgccaccgaccacggctctacgcgtcaagctagcccccgagcactcctcctgccgctgccgcgcaaatacagtcatctgccatgcctccccggctgtcgccgttcgtgcctcctctcgcagtcgccgtcgcccatttccaggcgttgataccgtgtccgcacccaccatgctgccattgcaacatcctccattgttgccgacgacgcgtccaccgccgccgccaccactactggagctgccccagccgctgccaccacccctgcagctgccaccaccacagcagctaccgccgtcgccgccgccgccgccgccgtcgccttccaccgtaggcagccacgcccgcggcttgccgtcgcaggtcaccatcgccggtcatcgttcgaccagatctggcctgccacggtcgccacatcgccgtggtcgctagctgccgccatcaccagacgtcactgccgccgtcgccaccaccagcggacggccaccactagaagccgccgccgccgctgccaccaccagacaccacctccaccgccgccacctcttcgccttctccgtcgccaccacctctggaccccactgccaccaccgctagccaccgccgcctcaccacgctgccccaccgccggccgcctccccaccagatctagccgcggcggcccagatctgggcggtcttcacaccgtcccgtgctgccccccactgccggcgcgacgagagaatgaagccccgccgccgccatccttgcggccgctcgggcggcggcgcggcggaggaggaaggagggggggcgacgcggggttgccgcctcccgtgtcgcccgtgagggaggacgacgcggaagaagttgtgtaacacagtatattttgaagtttctcgtcggttatttggtttcatggtaggcaactagcctctagccattaattggttactcctagtactgcctgcctgttaattctcttcttgcctgtagaagagcctattgtcgcaaggcaacatgccaacatgagacctgaaaaggaataagtcaattgttggcagggttatggataacacatatccaaaagtaatcgactaaactcggcagaacccaccatatattaagtcttatatggaatcatgccttgtatatatagaaggagttccggataaggaagaacaaatagagttcaagctggaaacgataaggactacccatattgtatcatatttatctccctagttttacttggacaaggggacatatatgggtataaatacaataccccagaaggagagacaacacaaaaccaagacaagcctgaacaaaccaatacacaccgctagacatcgacatcggagattagcctagacatacccaatctagtgccatcggaggccgtcaagagggatttagtgttatctctgatctggccgagtatgtattcgaggaggaagactaccctgtcgtcaactacgtgttggtgtttatgtcgccaagttgacgacgactagataggctatcccaattattgtacttgtgagattctgatgaataaaagcaacaccggcttcgaccaacaggagtaaggctattacctgattctgatgaatgaggggcccaaacctatataaaaatcattatctctgtctctttaaccttaatctcacatataccctgataccaacgatccccacaccatgcaaataccgtagtcgtgatctaaaacatcgacaatttggactccctcaactataactccaatatgattcatatccttaaaccgtaataccggatatcttgacccctcaactatgaaaatcggtgcaattttattccctcaacagttttgtagagcggttccgctgacgtggcgctttgacttggtctaacccgctaagtcacactatgggactcgcacgtcaatgtcacacattctttattctcttcattccctttcccctcctcactttcctctctggcggaagcaacagggcatggcggtgatgacgggaggctgttgtcgcgtcgccaccgtcgggcaggaggaagcatgagcgaggatggcatggctgtcagaagggaggttgtcatcgcgccaccgtccctcccatcactgtctccgcctcccctccgctacccccttccgctcgccaccgtcg

SEQ ID NO: 39450 - DNA, 3485 bp, Oryza sativa
ttcctgcagccctttgtgaggcccctctggtcgatttggtgtgttctgctactgcggtccatgtaccggttcatcgcagagagccttgcgctgttatccctgtggcatggccgcagttaagagctccttccagagtacatgcgtaacaactttgggaggggaggattggcatccggtgtccacaacgcggaaacgatggacggatacaaatacttggtccatggcgagtccaagcagaagatcaaattactgaggcctcgatatgctctctatctcaatgtcaccgatgaaaacttgctggtcacactggacaagatttggcgatctgacgggccggtgctacagtccgccaacagcgttcacggagacgactgcaaggatctgtgcctggccttttccatgtcgaggtttctccggtgcaggctcgaagacgtgaggctggacgcagacagcctctccatgtcgcggaatctgatagtgacaagaatattgcatgtcgaccagaaccctgcgagggtgttcaggataatggagctggagatttcgttcctcaaggactacttctacaccctctatcctatcgtcttctggcaaggccttgcttctctctccttgagtgttcttcagtctctcgcggccttgggactcgccctctggctcgcctcgggcgtcaatagggtcaagaaagatcttccggaccccgtcaatgtcgtgcacggccataatgtggaggtgacaatcacatgggtgttcatgtccttcatgatgttcaaagagatctgggagatgatcacttacttgctatcagactggacaaggcttctccttgtgtgcgagtatacgcggtccagatgcaggtggataagaaacgccacgatggagaagctgttaagttcctttctaacgttaagttcctttttaagtcgtaagatcttttctgacccttggcatggatacatcgaccagtacgacttcttgcagtcatttgattacagcccgtcgctctggaacctgatgtaccgtgctactctaggcgtcatcaaagagagggtaaaagggcaaaagcctggcaccgccatcaagatcccagaatgtgtaaaacctgcaattcttcaggcattgcgctcaatggatctcgctggcttgggcggccgcgagcttccccgagacgtcccatcgttgagcgccgcgagattgcttgaggatttccgatgggcgttgcttgacctgtacacgtgctcccaggtcattctggtttggcacatcgcgacctccatgtgcgagatcaagctcgcccgagacaggggcattgacctgagcaaaccagggctcctgcgctccgccttcacgtacctgaaaatttttctctgcggctgctgctgcactcctcagccgtacctcgttgctgaaaatattctcggtgatgatcaactccggactagctacattgttgcaaacagcttgtcacgatactgcgcgcacttggtggtttttcagcctgacctgttgcctgacagcttggcgcttctgatattatgaatgaccgcgactccttgctgacaaagtatgacaagctcaatgggttgttctcacccgaagctgctgaactgaaaaaactgaacgggaccatcgtagagaaaggcgcggtactgggaaggcaattgcttgaaacaattccagacgatcagcagcggtggcaaatcctggcgggtgtatgggctgatttgctcgtgcacattgcgcccagctggaacgctgaggcacacaagatttgcctcgagtacggaggggagctcatcaccttcatctggggattgctctggtactgcggcatcgagaagagcagcctgtggcgagatcaggacgatgcgcctggagatgccaacgtccagcctcagcctcagcctgcagcagaagaacctcagggtggccacaatgtcgaagatgatgcgatggtggaagatgcccaaaacggaattgaagctcgtgaagcaggcgtgcagaatcaaccagcggagcaggtgctgcagcaagctgctgaagcagatgtggagattgcagatgaagcacgagaagacgagcctgagcctggcaacgacatccacgctcagtctgctgctgacatggagattacagatgaagctcaagaaggggagtctgagcctggcagcaatgtccaaacttctgctgctggtgtggagattatagatgaagctcaagaagaggagtctgagcctggcaacaacgtccacactcccttcagtgctgacgtggagatcgcagatcaggctcaagaagaggagtctgagtctagtaacaaggcccagtccgctgctggcgtgcagattgcagatgaagctcaccaataggagcctgagtctggtaacacaacaggatcaggtagaacatcagaaatacctgttaaaagacgctggagatatgtcctgggattgagatgcagtgatccggaagggaaacagtgtccggacctcgcagctgatgagctgatgtgtgaacacacatcaagccgatgaagagcagtgcctctcatagtcaaggttgagtacttgagtgaaactgtgaaagccttgtctgcaaaagcaagaaaaaactagaagattattcaactcatgcagtgtgatatcttccgtctcccgaatgcgtgcagcaacgtactttacaaatatataactttctttgtacattgtgcttatgttcaattttgtttgcagagtatttatgttcaaggaaaaaaaaagagagtttttgtgttcagtttatctttcgacagcgtttatgttctgtcgacagtaatactgcagccatgaatgtttcacaattctcctcaggttttcgttcaagaattttgtttggatgtctatggttgccacattcttggttgcacaaatcatttgggtgtcaaatgccttattgccacatgcttgtggttcccaaactgtgtatggattctgcaagcatttctggaaagagagacaaactacaaacccaactatcctacaggctgcactaaattgcagataagcgcagataaaaatcaaactatgaatcataatactagccagcatcattttgagatcacatccaaaacttttctctccaatatgcggagataccatggcagtacagtaatcagtactcagtaggtacattgtttcagtagatcaggagccgcacctggatggctcgccggcccagaaggaatctgcgccggccactcgcgacacggcggagtgcacactgcgcctctgctccatccgccaaaccagagcgagccaggctgcccgacggaaggtggccggagaagccgcttctgggaggaaaccctccagggcagaccagagcaacggcatctccagcgagaatgacccccggaactggatcggaatcccttctccattctccctctgccaccaccacggcgacgcctcctcctgtaatcagcatgatagatgcattttttggtc

SEQ ID NO: 39451 - DNA, 3131 bp, Oryza sativa
gggcattatacttttgcaacttgttacagcacaagaaccaaaggatttgagaaagaatgggctcatcaaactaggagatattatacgattccaaggaaagagcatggagcagcaacatgaggtcctaaaaagcattgtggatcctgacctgaagaaatgccagttagatgacgccgcagagatgctgttcctgggattgaaatgcagtgatccaaatgagaaacatcgtccagacctcgcagctgatgtgtggccactcatcgaggaaatgaagagcagtgcctctcatcgtcagggttgagtgaagctgaggaagctctatctcttgaagcaagaagaataaactacaagattactcaacttgtgtggtgtgaaatctcccctctcctgaaatttgtgtggcaagcaaagtgctccacggatatgaaactttctttgtgtattgtgtttatgttgagttttgcaaagttgagtttatgttcagttcacaatagtcaagcctgaattcaataatttagtctgagatgtttgtggtttccacattcttgaggaaacaaattatttgggtgccaaacgctctggctgccattgtggctacccctacccatcatggcctgtccatttttgcaagcatttctgcagtgcaagatgcagaggccgggatgtttattattccattatctaaaaaaaaccatttctggcaaggtatacaaattaactacaaacccaactacatcctactcaggcattgtttagttcacaaaacaaaattttttcacccatcacatcgaatgtttggacacatgtatagagtattaaatgtggacaaaataaaaaaaccaattacacaatttgcgtgtaaattgcaagacaaatcttttaagcctaattgcgccatgatttgacaatgtggtgctacagtaaacatttgctaatgacgggttaattaggcttaataaattcgtctcgcagtttcctggtgaaatctgtaatttgttttgttattagactacgtttaataattcaaatgtctatccgtatatccgatgtgacaactaaacccaaaatttttccccaactaaacaaggcctcaaagaggacaaatccaaactgcatgattttcgtactatcctagagtaaattacagatagccgcaaatcaaaataacaattaattgtactagcctacatgatttaccccccttttcttttcgtctcatcgagagaagccagatccaaacaagcgtcaatagcatggcagtgaattaattaatggaggaaaattagtagggttttgggtacacctgggaatgtggccttccgatccttccgctagtccactgctaggttgcccccgccgacgaggagatggccggagaccagagttggccggagacggggagggaaagccttctgggagggaaagtcggaaaccccggtggcatgatagcgccggccggagcaacggaagctccaggagagtgatgcccgggagtagaacggaatcactcctctccaccgtctcctccgcatcgccgcccgtcggtcgccgccgccgccgcggcggccgcctcaccggcagaggcacattgctgcgagcccagcgatgaaggcggcggcagaaggcccacgttgccgggccaactcaggcccatatattgattggatgggcccacgcatattcgtcggctgcactctcataggccttaattacggcccgtgattggaagaccataaatttcctaaggaaaaagtacacccgaggtccctcaacttgtcatcgaattacaaaatcatctcccaaccgcaaaaccagatatatgacatcctcaacttataaaaccattcactttacgtccttcggtggttttgacccaattttatccgacgtggcggctgagtctgggactcacatgggccccacatgtcatgatgccacgtcagcatcttctctcgctttcccctcctctccctttctcatctctctctctctcactttctcctcttagggagcacggccggccggcaggggaggagcgcgacgggcgcgcgacggccagcgagggaggagcgcggctgagaggagggttggcgcgatgggtggcggtcggcgacgcggagcacgacgacgacttggggccgccgctcgcttgctcctgggggctggaagagtagcacgcagccacgcactcagagtggaagcggtgggtgtccggcgacgtcccgaggcgggcgaggacggcggtggcttgcctcccgctcctctccccgccgatctccctcgccggcccgcgggtgcgcgcggagaggaagaagggcagcggccggccggcagaatagccggtgaacccatccttccctccatttctttgctagcttccgccattgtctcttggattttatttgctcatctggtgcttctggccctttccgtttctgcagctcacagcctcacacccgctcaaattcttcacaatctgtaagtgtgtgtgtgtgtaaattcttgcaaattagaagctgaattgctgctaatagcctgcatcgactcgtaaatttatgtttttttgttggaacagatgggctgtggctagtggccgcagtacagctatgggggatgccatcctgctgcagaccaaccacattcgacgttaacaaggtgccaaccatgcggggacctagtgcaccggcggcgcggcgcactgaggacgacgaggggcggcggcggcacgcggcgcgcggtgaaggccggccgtgcgtcggcggggtgcggcgcacggcgtgacggcagccgacggcggggcgcggtggcggctaggcggcggccgcgacgcggacacgcggcggcggcgcggctaggacacgggctcgtggtggctggcgtgcggcgggccggcggctcacggcgccacgccatgcggggcggcgtgggggcggtcaagcgggcatggcgcggtgctgcgagcacgccgcggacggcgaatgcggtgcagcgggctagcacggcgcggtgcggcgacgccggtggccgggtgggtgcgggatacggctgagcggcggctcggcgcgggatgcggccgagcggccatggctgctcgctgctccgcccttttccttttttttttctttcttcat

SEQ ID NO: 39452 - DNA, 8709 bp, Oryza sativa
  unsure (1)..(8709): unsure at all n locations
ggcggagttcagtgcaaggcgcggcccaagtagtggcgtggtccagggcggccgtgcaggtgctgtggccggcgagcagccgaagtctccatcagtgccctttagttttcttttgttcgccggggacgagagagggtgctgatgtggcatcctattacgtggatcccacgctaactcagccgccacgtcgtataaagccgaagtcaaaaccaccgaaagactcaaatcgaacggttttgtaaagttgaaggatgtcagttttgcggttgagggatgattttgtaatttgatgacaagttgagggaccttaggtgtacttttttcatttcctaatttatatactacctgaaaggctgaaatgaataggaaaaagtacaccgaaggtcccttaacttgtcatcgagttatgaaatcgttgtccaaccacaaaaccagatatataatatccctcaacttaaataaccgttcactctcttcatgtcagcgtggctatgtcatcacctctctctttccctcctctctctctctctctctcacttttctcctctttccccgccgcgccgtgcctccctcccggtgctcgctctcctcctcctccccttccgcgtcctcgccgctgccgcggggtcccacttctccccctgcggtctcccgcctcgcgggccgcctccgcctctccccgtccatggccgccgtcacgctcctcgcgctcggcaacggcgcgctcgacgtcacgggcgaacgatgcaggagggacggcgaacggcgcggcgatgagcgcgacagccccgacgacgaacgcggagatgaacgggcatcgacggccggcgacagacgacaaggcggcgacactggagaagggaggaggccggcggggcgacgaaggagaggagaaggtccggcggctggctcgcggccgctcgctcgcccgccaccgccgctctgctccaccgaccgcgcgcttgcctgccgccgacccgccgtcggcgcttcgctccgccggccgctcacccgctgcacgtgcgtgcccgctgccgcttcacttcactctgcgcctgacactcaccgacgccccgacccctccgtcctcggcgagctcgtgtacagcatccccggcgccaagaacgtcctcgagatgcccctcctcgcagctcaggcacgtacatgaactctcatgcgattatccatttaatcattgtgtttgttgctcataattgttagctaaataatgtaatcttgtgcagtttctgttgttgcgttgcatacagttggctgtgttagaatctggcagcagccggtcagtagtggatctagatcaatcgggcttctttctgttatgcatgtaacaaactctgtaattgaggagaataaatagaaaaccagaaaagcagcaaaggtattacgctgcgccaaaaactctgctcgttttctctgttcttcagttaaactgttcacgttcgacaaaaggttcagagattgtgagagtgagagtgagagttcgtgagttttgattcagtgtttctgtgttcctaacaataatcatctacgagttcttgttaatggcgatggtttaggtgactcaagtgcgatgggttcgtgctcggtctcgccatcaaccactgcatgttcaacggcgtcggcgtcatgcagttcgtcaactcggggtgtgccgctctccgtcccgccggcgctcgaccgcgccctgctccgcgcgcgcgaccccccgcaggtcgcgttcctgcaccacgagttcacgcagatcgacgacggtgatgacggcggctcgccggcgcagaacggcgccgagccgttcctgcacaggtcgttccggttcacgtccgagtcaatcgcccacgtcaaggcgctcgtctcggtcgacggcggcggcggcgggcgcgcgcccacggcgttcgaggcgctggggatggggcatgcgtggcggagcaagctcctcttcgcggtggacgggcggccgcagttcacgtcgcctcctccggcaaggagacgcgaggcccagccccgcgctcgcgggcactgccctccggccggcctgcccagaggagaaaagtgagagagagcgagagattgtagtaagggagaggaaagagggaggaaagagaggtgatgatatggcttactgacatgtggggcccacgtgggtcccacgctgactcagccgccacgttggataaaaccagggtcaaaaccatcaaatgacctaaaataaacggttttgtaagttgagggatgtcatatatcggaggacgatttcgtaactcgatgacaagttgagggaccttgggtgtactttttccaaatgaatactccctccatattttaatgtatgttaccgttgattttttgacaaacgtttgacctttcgtcttattcaaaaaatttatataattataatttattttattgtgacttgatttatcatcaaatgttctttaggcatgatataagtatttttatatttgcataaaaaatttgaataagacgagtgatcaaacgttggttataaagtcaaggcgtcatacattaagatacggagggagtatattgtttccgtaaaatggcacttcatggttattgataggaacaatcagctatctgaaaacagtggtatcatatcttactataaagttatcccccactaacttcttaagcttgatatgaagatgcctcatcatcattcactaacaagataccacaccatcatccactaattaacaagatgtcacatcatcatgcactaacactcatcacatttaaacatcatgcaaacatgctatatctttatagtttttataatttaagagcttttcaaatacaaacatgttaaattatcatccaacataattcatataatgtttcaatgtatatctttattatgttttatgatatcttatatatttatatagttcatcctcacttagttagtgcttaaatgattaatctatggtctaaattatctttttctttttttcctctaattaagttatatcacatcaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaatatatatatgtatatatatatgtatatatgtatatatatatatatatgtatatatatatatatatatatatatatgtatatatatatatacacacacataccagctatgctgccgtgtacgtacataaccagccggctgctgaaattactatacaaccaagacgacgtggacgccgcggtgttcaaggctctcctgtacttcatgtacacgggcacgatgcccggggggccccgccgcgcaagacgacgacggggcgccggcggcggtcatggcgcagcagctgatcgcggcggccgatagattccacctcgacaggttggagacgatgaggttgaggcttctctgcgaggagttgtggactagctactaccggtgtctggcgacattaatctgcagcgtagccagcgactacgtctttgtaacgtcctgccttcccccaggccgggcccgcttacatttgatagctttcataggtcatagattgtcctcacagaccaacacatatcttttctgcacactttgtcctcactcgtgtgcactcgggaagaatttcccggtcggtcacccatcccaaattgcttcaggccaagcaacccatcccaaattgcttcaggccaagcatgcttaaccctggagttctttggagattggcttccggaaaaaaaattgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcctgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgcttcaggccaagcatgcttaaccctggagttctttggagattggcttccggaaaagaagttgcaacttgttgatataagtattctattaatcctattaagccctaggccgggatgttacagtcttccatggtttaaggacatgttttcaaagttttgtggtggtgccttttaatttaggcttttcgagtaacgggtgcagcttaattatgtaaagttatactaatatgtatgacgtcgttgattttttttaccaatatttaactattcgtcttatttaaatttttttttgcagatataagaatattttaacgtaggtgccacgtcagtcaaaaccgccatccaaatcgtcttgggacttattttgcatcgtttttgatagttgagggaccagttatatctggttttcgggttgaaggatgaaaatcagattggttgacgagttaaggggacctcagataagcttattccaagcaaaaaaaaaagctaagaggagagggcccacgcgcgatggataaaaccctctcacgtattggcgtatgtattttgttcgtgcgaaaaaaaaaaaagaagttcaaaactaatcgcgcgcagtgatcgtacaagcgatcgatcgctcattatatatccttttcgcgcatatatacatggcaccgtagaaaaggaaaggaaaacccaacacggaaaattaaggaaaacccacctcgcacgcgggtattccacaccgagtccgagttaattacgttctgccccgagcggcaacagtatttatatcgactgcaacacacgtcgtcgtatcacacgtaaacccggccgctgaaatacaaaccccaaaccaattcgagtgagttctccgacatgatgacccgtcgccaggatgcctactaccgctacccaaccacgtcgaccatcgtcgcgtcggcgccaatgcccaccggccaccacgtcctcaggatcgacggctactccctcaccaaggccaagttcgccgccggcgaagaatgcgacgagtcgtgcagcttcgtcgtcggcggccacgcctggcgcatcaggtactaccccaacggcgccgtcgtctccggctccggtggcttcgtatccctcatgctctcccttgatcatcagcccggcgccgcattgccggccgccgtcgtcaaggcgcggttcgcgttcagcttgctcgacatggacggcgagccggtgccgtcgcgcacctacgcgagcgacggcgtggtcagcttcagcgctaattcgtcgagcacgttcggggcggagaggttcatcggccacggcgagctcgaggcgtcggggcacctcaccggcgaccgcctcgccttccggtgcgatgtcaccgtcgtgaagcgcgacgggcctccgacgatgtcgaccctctgcccggtggagcacgacatgttcagatgcctgctcgacaccggggacgacgcggacgtcgcgttcagggccgccggcggcgagacgatcgccgcgcataggcgggtgctcgagcgacgggcaccggagctggccaagctctgtcgtcgtcgcggcggcgcctcctgcttcatgggactcgtcgggaggcacatcgacgtcggcgacatggacgccgctgcgttcaaggctctgcttcacttcgtgtacaccgacacgctgccggagacgatggccccgcgagaggtgccggccatggcgccgcagctgatcgcggcagcgcgtaaatacggcttggactgggagaggttgaggctcctctgtgaggacaaggcgtggggatggcgcgtcgacgacacgagcatggacacgacggcggcggctgctccggctaccggcgatgatccgaagcgtagccagcgacgtcttccatggtttataaggaaatgtttttaaagtttggagatgcgtagttctagcacagacagatactccctctatctagaaaataagtgctaccatgagtttctgtgcacaactttaatcgtccatcttatttaattttttagaaaaaaaaatctaaaaacataaatcatgcataaagttctattcatattttataatctaatataaaaaaatacttactaatcataaaaaaattttaaataagacgaacgattaaagttgtatacggaaacttatgattgtacttattttgaaacagagggagtatatgaaatactagtagaaaaatgtacctctacttacttacatagtcataaaataaatagtttatatcttctaaacaaaataaaagttcacttcagttttcagttcagactcaccttaagctctaaatgtaacgaaacggaaccaataaaattaagggactgtctactcctcgacagaaaacccctcctaatatcttgcaaatttttgttcattggattgatttgagattcgtgcaaaccccaccaaaccctaaccaccttttcctttttcctccctgccgccgcacaacgctcaagcgctcctcccctcctctcagcaccgcgcgcctccttcactgccgccgccgcctcactgttccgtcacccggcctcgccggctggccgaaaagtgtcaacgacgccggcgaggccccgnccgctggcccccttcccctcccctcctttgcctcaagccggcggcggtgcgctgtatgtcgtcttccccgtcgccggcggcggggcgccatcaccggctacctcctcctaccactctttcagctttgcccccgtcgcctcaaccggcccgccgcccgctcccgaccccgcggcttcgcgccgccgccgccgcctcgccacctgcccgatccgccgcccaccgccggactgccgcctcccacggccatccctctaaagccgacgaactcccctctcttccccctcccacccccaccccaccccgggatcctaattcgtcggccctctgccggagtttgggttcgccggcgccggagaagaagaggtggtcgccggagttggagaagaaaagcacgaatcgtgaagcacatccaatgatccaaaatttgcaagatttgagattgtgttttctgtggacataaatttagcatttccgtaaaattaatattgttttttattgtttttacattcaatatctctaattctattgtatgcatgttacatgtaaggttaatcaaaacgagaagatgataataaatatttttttatctttaattaaagggggtaatgctttatattttagaatggtgggagctaaggctacactttactgctataagatcggcgtcttctctccacacgttctatccataagtgtcgtggcgacgtatactcagcttctcttcctcgctcgaaagggtgtcgccatgcgcgcgttcgagagcttcaccggtcgtcacgacgaccgccgcctcgccttcatcaaggacggcgtcgagctgcgagccgggctgccaccagggccggctgggacagtaaggacggtgcgactgtactgagcctccaaaaattaggagcctcgaaaatatgtatactatgatatcaggcctgataggcttagaaaaaagacagaagaccaatcgacgatcgaacatatcgtgacggcttgattgtattttaaacttatttagtgtgaaattcgttaatgacaatgagtttttaaatattatcttgtaattttatggtaaatgtagaccttcattttttttccacaccgaaccactaaagagtcagtgccggccctggccaccgccgccacccgtcggcgaccctgagtccggcggcctgcgccgccgcttgctctccttgctggacgggacggacgtcaccttcagggtcggcggcgaggcgttcgccgcgcatagctccgtggtcgccgcgtggtcgccggtgctcagcccccctccccc

SEQ ID NO: 39453 - DNA, 2298 bp, Oryza sativa
gacgctgcttcacccgaggacgacgaaggtgcatccacgtcgacggcgtggacgccgtggcgttcgaggctctcctgtacttcatgtacacgggcacgccgccgccgccaccggagacgatgccggccggccccgccgcgcaagacgacgacggggtgccggcggcggcgatggcgcagcagctgatcgtggcggccgatagattctgcctcgacaggttggagacgatgaggttgaggcttctctgcgaggagttgttgaccactggtgacaatcttctagtgtagccagcgacgacgtcttccatggttcaagaacatgtttttaaagtttggaggtggtgccttttaatttaggcttttcgagtaaacgggtgcagcttaattatgtaaatttgtaaatgtatatatggaaaagtatttttagaacttggtacgattacacctagccacctactagctaggttatacatgtgttatcatggtcctctgccatgacaagctgtggctgtgacgcgtcgagctgtggcggatctaaaaaattgattcgttggtgtcataattaatatgtactccttccgtcaaaaaaagccaaccttaatatggatgagacattacgtagaacaacgaatctggacatgaagcatttccagattcattgtcttaggtaatgtcccatccatactaaggttgttttttagacggagagagtatatcggtgtcataatatgttaattatactagttactggtgatgacacaatccgccgcacgtaggcagcgacatcttcaatggttaaggggatgtttctgaagtttttggaggtggtttttttagggattttggtcacacataaatactcagtcagtttcattgtcgttttaccttttttttttctaatcaaacttattttattgtggtatatttttctataaacttcatcagacataaggaaatttggcagaaaaagaaaatcaaaccgacttataatataagcgggtgcactattaattaattataacatgttttatctcaactttcatgttttcaaacacgtgaagtgggtttacaaagtggtcaaagctgcagatcgatatcatcatcaggattgctttgtttgccttgccgacgggtgtgtctgtcatttgtgccttttgctacttcgcctcgttcccatcgccggcgccgcgccgccggtcgccggcacggcacaggcggcggtgctggcccgcgatgaaggtggcaatgggcccatcctggtgacgcaatttaggcccatatgttgactagtcaacgggcagtctccccttcatatgctgatgggccgattcgtgggctttaatagaccttacggccccgtaagtgaacaaaataaaatgtttctacctgaaaaataaattgtttctgtaaaattctcctgttctaaatggcgcttcatagttttttttataggaagaaacagctacttgccagtactaaaaataacaacagtaaaatcctaactatactggccatccaagggtaatgatgcaatctctgaccaatgctgtaagcctataactgtaactctgtgcgttctcagttcaatggaagcatcaaactcactcacatgaagccgcaaagtataaaattaagctacctacaattaattgatgaaaggatgtgtataatgaatctaatccccgtagcatgctcttaggaaacaataggcaaacaaacgataaaaaacaatagatcaatcacataagacacgagattttaacgtggaaaaccctcccaaaacaggagagaaaaaaccacgggcgctaaccagcaaaatatcttcactatatatggggtgaggttacatcgctgcacggcgacgggcctccgctctactacggcagaaactggactttattaagtgcaaatgaatttggatcacaactcaacacatgctgcatgattactgaacaaagcctacaaaacaaagtgcaaaaacgcctggataaagtcagaaactagcccctgcatgacactattattccagtcactctacctacagcaagtacagctacagctagtcgagtgtaaaaagaaagtcatcgtcttcgtcgatggctttggtcaggtaaagaagaactgatgatgatgcagaagcagtggcaaactggcaatggacaaaggaaagcagcccagctttgcttgccggctaatgctgtccgtgtccggctcacttcacttcagtgtgcagcggcagaattgcctaccaaataggctttttttctcacgtctgcaaatcttcatttgtccttacctt

SEQ ID NO: 39454 - DNA, 3877 bp, Oryza sativa
  unsure (1)..(3877): unsure at all n locations
aataaatccttggaaacaaaattattattactactacagatttcagatatatcagggagattctggagtagtttggtcaaagatacaatcttttgttttactacctcacaaaataggactgcacagagaaatgatgaatgatgcaaatagggatggtcctacactcctaccaagcaacagtaaaatatgtcagcatgggttaataatacaggcagagatccaggagaccagaggcatgattcagaaaggctaaaaacaagaaacaaaaaaaatgtgacatgcaaaagatgatcagtagtactagtggctgtttatctccattgcctctgggtgatgcagctgtaatcacacaccaaatggtgaaacagaagcttcctccagtaattcaaaatgtattggtccaagggatgaatatgaccaacagtcaatggttggctgatcatgctcatactcatactagcagaccagctgctgttgcggagtaaaaatttatcctttctgacaaaagcctggactgctgtatatttatgctttgataggttattagagttaagtgcagagagtgtcatggagtgtgaaaagaagcaatcagttttattttacgaatgatacattaggtagtagctaattccaacactagtacatagacggatagaccgtgtttagttcccaactttttcttcgaacttccaacttttccatcacatcaaaactttcctacacacataaatttctaactttttcgtcatatcgtttcaatttcaatcaaacttccaattttagcgtaaactaaacacacctatagaacattcaaggactgcaactactaaatggacaacactaggtttgatttgtagactatgttttattgatgttggagcaattgtgcaaatatatagggtgtgtttagttcacgccaaaattggaagtttggttgaaattagaacgatgtgacgaaaaagttggaagtttatgtgtgtagaaaagttttgatgtgatgaaaaagttgaaagtttgaaaaaaagtttggaactaaactcggccatactctcatccaggttggaagaattttgtgttttcttccaatgatacagaaatgttttaatgaatcctttcaatattatctaaaaaaaaatgaatcctttcaatgaatcctggtagaaagtttcactatccacataagtgcagatcccagagggtcagtgtcacagactgaaaaaagcaatgaattcaacatgctaaaaggtgctgcccaaccctaagcaacaaccaacagttaaataggcgtgaagcagagctaggagtgaccaaagactaaaagagtcatcaaactactcctacttggctacaccgaacattcaaatagtaaatgaaataactcaagtttagttttgaacatttccaatattgagtaatcagcactcaatttaccatcattcagagaggacaaggctcctgtttgtagggcttttacaaaggtaacatcaagttcacccttttaaaaagatcctagagaaggacctacttgctgtatatatttagtgtaacaaagtgctgtaatgactgtcattaagtaggattcagaccagggacccctcctaatcataggcttagagccatagacataaggtggtgcacacaaaatcttgacctctgcacttcatagctcatgccgcccagacagtgacagtcctcagttcattgaacttcacataagctcaccaagtaaccaaaacacataagctcagcttcagctcagtctcctccatggagcccaagtcttcttcttcctcacactatctgcagccatctgcaacattgccatcaacaagaagagtaagcaacaaacacatctccaatcccttcttctacttgatttcttgattcaagaagaccagacaaatcaacaacaaatcagtttcttgattgaaaatttcatcgtttgatccatcgatttgcagaactcattccaaggagtgggagctgaagctggaggaggaggaggaggcatgaacccattcgggcccacattcagtgacccactctgcagcctcaacctcaaggagacctcagagttcgtgaggtcatccttccccatggctaccatggcgaggagcaacagcagcaacggcgccaccggcaatggcggccatggctaccaccgcgagacctccacggcctcttcatcctcttcctcctcggcctcagctcagaggaggcgagccgagcagcagcagcagcaggtgccagctactccagggcggccattgctgttcttcaattcctcgagccctgcacatcaccagctcgtctccgcgaggaggtcggtgccttccaagtgggaggatgcggagaagtgggtgaggcaggcgtcgtccgaccaccatggcggccatcaccaccaccatggcaagggctccaagcttcaggaggagaagagggcgtcggcggtgaggaggtcggtggatgctgacgtcactgctcttgctctctacactgctcctgctgcagaagtgttcctcaaaggtgagatgctgaaatatttttttcagttaatttttgtacttctttgagtttttctttgtgttcataggcagatgaaatttcagtgaggtcactgtcagaatgaatttctgaactttcttgtagagttgttctgagcagtaatttctgaactttcttgtagagtaattctgtgcagtaatttcttaactttcttgatgtgtaatttctctgcactttattggtttcttaagctctcattttgtttcgtattttgttctgaatttgccaaatgttttgtatcttgatgtgattcatacgattccttcacatgtcacatatgcatccaaagtttcagttgtttgttctgaatttgccaaaaattcagtaccataattgttcatcaagaactagaactgcaaatctcacaagttttttacgtttcagacaagttcactgacaatgtggagccctccaaggagagcttcgtgttccggagctcctactgcgagccaacaaagaacacggcggcgcaggcggtggccgccggcaacggcatcgaccaccggcgtgacatcggcacggagatgactccgctgggcagctccaccacctcgaggtgccacacgccgatcaagagcacctcgccggcgaggcacaacacgccggcgagccggtcgggccccctggtgccgtacgccggcggtggcggcggcgccggccaggacatctcggacctcgccgactgccacttcgccaagctggacctcggcgcgcagttcgacgccatgctcatcaactggagctccaaggaggaggaggaggaggaggtgtccaagagcttgaggcacttcgaggccagcgtcgccgccgtcggcgagaagcgcggcggcgccggcgactgccggtgggaggacgatgacagggccaagagctgcataaggtttgcacaagaaattttagcataaattatggcaaagattagagatgaatttctcatatgatgaaaattttcttgtgttttgtctgattattaggtatcagagggaagaggcaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39455 - DNA, 2262 bp, Oryza sativa
cacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccgtctcctcctgtctggcaactatgggttttttcctaacctcttccatgtgtgtagtggtcaaacgatccagttgctcccatatggcatcaaactttctttgttgattctgcttgcataacttcttgaacaggtccatcaatctcttactcttgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgcagttagaattgttcctctatacttgcctgtcatgaaagtgccatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtgtcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctagttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatagagtcaaatccaccccgctatcacatatttgtataggagcatcgccataa

SEQ ID NO: 39456 - DNA, 3976 bp, Oryza sativa
tgtcttggattatttcggttggatatcatccgatatatgcacacacggctaatacagttttggaatcattccccattttaacaacctaacatgtatttagtattgagtacggagtacactttagtatttaatcctagattttatttccatgtacatccatatagatacatttgaatttgaattatatttagacaattcagaatcttcgggggatgtgaattggattttgtgggatccaaatggggccaacaagtttagggcccctttgaatcgcaggattgagaaaacagaggaataggaaaaacttaggaattgaatgccacatttattggattcctatgggattttgaaacacaggaaagttttcaaactgttgtttgattagcacacggaaaaaacgcaggaaccttagacacatgaagaggaaaacatgaggtgagacctcatgcttattttcctccaaaattgctcaggtaaggttcatttcataggaatttcaaaggaattgataggaaacaatcctttgtttcaaaggactctataggattatttaccatagaataaaatcctctagaattcctatggtttttcctttgattcaaaggggcccttatttttatcatgtcatggtgataaatcattttatgatgataatcagatgttagggtaaacccaggtttgtcctttgtaagccaaccgacccggtgagagtactagttccggttcaaccgtcgggctggtatgttttttttactatggctacagtaaacatttgctaatgacttttactatggctacagtaaacatttgctaatgactttatttgctaataacgtattaattaggcttaataaattcatctcgcggtttactgatggattctgtaattatttttttattagtgcccgaacaccccatgcatcactctactccctctgtcccataatatgcggtttactgacggattctgtaattatttatttattagtgcccgaacaccctatgcaacaccctactccctccgtcgcataatatagcaacctagaaccggatgagacacttcatggtacaacgaatctgggcaggaagtatgtccggattcgttgtactatgaagtgtctcgttcggtactaggttgctatattataggatggagggagtatataatatctgatgtgatacgtcaaaactttacacccttgaatctaaacaccccccaaagtcagaaagtgcctttttcttctccaacgtgcgcacggcacacaaaatctctaaacctatcaatagaagctcccgctccttccaaaaaggactctcaccggaagcatttgttgaccgcttttgttgagagtactttttggaagggttaaaccacagcttctgttgatagctaattaagagtttataaacggtaaggccatattgcatacgtgtctctactgtcgacaaggaaaaaaaagttacttcagtagcacatatgcaagattacattttctttaggaaataatatacgtttgagtgaacagtacgagtagaatgttggatggtactagtagctgttccctccgtcctatttaaagcgcaactataagtttctgtgtctaattttgattgattttttctgaaaaaattaaaaagcataagtaagtattattcatgttttatcatctaataacaataaaatattaatcatgatttttttttaaataagaccgacaattaaagttagacacggaaactcatggctgcgcttaaaataggacaaagtaagtattaaaaaatctgaagctctacattcggaagcttgtgaatgcgaaagtaatccaaaatgtcactacgaacgaggcagcagtgaccgcgtaaaggattggatcatttccctttccatctccatcatccggtagcgaatgacctgaactgggagcacactcgctcccttctgacgctgggtgtaggaggttgtttccttggtagctatccatatcaaatgagccgaactgaccagagtttggtatacatcctgataagttgttgtacatcactgagaacacggacagtgatgacaaacgagttaactgccatggtattgctccactcagcttgttgtgggataggtctaagctttcaactgaactcatgcttgcaaaggttgctgggattggtccggcaaagaaattgtaggacagattgagggccttgatatgtcccagatttcccaactccctgggaatttgtccagacaacatgtttgcagataagtcgatgccagacatccaattgatgaaattgtgtttgtatatgtaaatgttgcctttagtacggaagctgaagcctctttcttcatagcatccgatgtaatcgaaaattgggtacctaaagtgattctcacagattagcgaccataaagggataccaactggattttgtccaaatgagaggtttccaatacatgatggcaatggccctgatagactgttgtgtgagaaatcaagtatccttaaagactggagctgacaaaggctgggagatatctgcccttcaaacttgttgctgcccagtgaaaggtacttactttcacctagatattgtacccattcaatgtttccgttgaattggttgtgactgagatccaaagccatgacagtagagctattgaagaaagaaaaaggtactatatgtccggacaaagaattatgagagacgataaaaaaatcaagctctaatgcggtcatacagtttggtatagcccctgaaaggttgttatgagatagatccaaaagcataattcttgtcaaattgcaaatgcttggatggatttcaccgattagactattgcccgcaagactcaaggtgcataaagtggaaaggttccattgtgaaaaatcgagtttacctgataaattattgtcatgcaaatccaatgttccatgagcatcgaaatctgctgttagatatcgcggcagtgttccttcaaatttgttgccatcaaggtataatgcatgtttgatcgacaaatgattcgtaccaccaaatatggggccaccaagtttgttgtttgagaccttcaaggttgtcagtataggatattcagtgagcaagcaattaggcaattctcctgaaagactgttatttgataggtccaggtattccattctagtaatgttgcacaatgatgatggtatttctccagaaatcgtattgctagaaacatcaagaaaactcatatttggaaatactgagctgatgttagccggtagatgtccggagatacggttcataggaagactgatagcttgtagattcatttggggataccatattggacctaatgaccctgttagtgagttatttccaagattaaggtaaactaatgtggcttgctctgtaaataaccaattgggcatgctcccagacaggctgttattcgacaaatcaagcacttctagttgatgctgtgtgcgtaaaaaaattggttctctaacaatgttcttatcaaggttgcagccagagaggactagcactttcagttggaatgaaggtgaccagctaggaaagttgaccgcaacaaccaaattagcatttcctgagacatctatcttttggagcttggtgaggtttctcagccagaagaaggaaaattcaccactcaaattattcattgaaaaattgaatgtctttaacgctgacgtaatatttgaagacagtgtcacaggaatactcccctcaaagagattttgtgagagactcaagtgctcaagacgaggaagtgagaacaatgatgaaggaatgcttccatttagtcgattggaacttaaatccaattcccgcaggttccgaagactttcaaaaactgcaaaaacatgcatatggatgattattataaattgcaaaacaataataaacatcaatatattttcttctgctccaggaatactaggaagtgttcattttggacctgaagacggaagtactccac

SEQ ID NO: 39457 - DNA, 2080 bp, Oryza sativa
ccaccttctcctacgcttggctcactgagacacctgagaatgatcaatggtggattgctagattgtgtggttttatcatgctgctggggaagcaactttgctttttaccactcttgggctctgtaaaaacacgggtatttagctataagttttaatcatgttaatgacttagtcacacttgctgagagcagtgttgattgtgtcacgatgttaactaggacctattaacgtattgaattgttgattctaatttgaatttcctgagttatttattaactgttcatcgcttgatattaagtcatatgcatatgcatatgcattatcgatatatttattagttagaataaattctgtgagagtgcattatttcaagaatatcaagtatggttcatgccacgttgttggccattatctgtagcgcggattagttgtcactggagaggtagtgaggtacacgaatgcacaatagaaattagaaatcccattctttataatttaccagtacaagtctgcaacatacacgcagatacttgtacactaaaattcttacactgtatgcatcttatatatatagtacatatgcatggttatacaatatcaactgaactcatacactgcatacaagtctaaagaagaaaaatatgatttatcaagaaatgttgtgctatattagagtatacaatttgattctaggaggttaaggtcataaaagtaaaacccagaaaataaaagtgaaactagcgtgttttatttttgaatgcatataatctaatggtcacacaaccaaaccatatataagtgcaaatagtaattggacaatatagtatcatcttaaatttaatggattcttaaaaggataattcaagtatagatcagccatctcactacatagttaacaacaagaattatctctgatgatctacaagtgcatttgagttaaggattatatctttatatagttctataaatcaatgctcagtaaatccatcataggatgaattttgaatgcatgcatagttagaaataatcatcgttctatttaacctcaagagcttaagataagatcaatattgtgctaccatttcaagttaaataggcagagcataaatggttagacattgatctattctcagtgtagaaactaaatagagcatctaggatccattagcagaatcataggtaagttggctcttactaagaaatgagccgtagaccggtattttaccttggaagtggaatacgagggttgctacaggctctcggtatgggcatggtacgtacccctattttgtgacttgtgagtttgacatggacccgtagcttaagttaatgagagtgtcggagaggaggggaatggataaattgaaaagatacgtaaaacgagatgagctattagcatatgattaattgagtattaattattttaaacttgaaaaatgaattactataattttttaaaacaactttcatatataaaacttttacagacatcgcatcataaaacttttaccaacatcacatcgtttagtatttcagaaaacatgcgtgtgaaaaacgagataaatcttttctcaatgttccgcgggcgaagttgaaagaaaaagattgagaagatatgtaaaatgagatgagtaattaagatataattaattacttcatccgtttcatattataagactttctagcattgaccacattcatatatatgttaataaatctagacatatatgtgtgcatagattcattaacatctatatgaatatgagcaatactagaaagtaagtttaattattttaaattttaaaaaatagatttttaaagtaacttttctataaaaaaaatctttaaaaatacgcaccgtttaataactcaaaaaacgtgcgagccaaaaacaactcaatttcagctagcaagactcgtttgcacctgggttctggaaggccaagtgggacaatagtaacgcggttacgcggagatctcatgacgagaatatttgctttcggcgatagctgaaattgaggcaagttggggagtcacttgaagattatgacgaattttgtccgtcctcatacgtatcctt

SEQ ID NO: 39458 - DNA, 15108 bp, Oryza sativa
  unsure (1)..(15108): unsure at all n locations
tgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgatggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgagaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgctgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgatgttctaactgaacctgtctttcacatgaaacaaaaatatttgaaatattggaaaaatatacctatgttgtatgctcttgcttttgttttaaatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgcttttaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaaataccattttttcttttttttaacattagcaaatcattacttttttaaaaaacttttatttccattttttaaataccattttttcattttttaacattagtaaatcattactttttttaaacattttatttccatttttaatttttttttccttatacatttcctttgcttttttttttaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccagcggctcggcacgtgggccggcacggcacgcccgtttcatcagccgtgcctaacgggccgtgccgaaacgggccgtgccggaaccgtgcccgtgccgggccgggccgtgccgcccgtttggacacctataatcggctcggttggcatcttcttcccccattgctgccctggttgccggcttcacctccgccgcgtctcctcccctctccgcctctccgctctctccttgctccgttgctctcgccaccacaaccaccatgggtccatggctacagccaaacctaggtcgtcgtcactcttgcctggccccgcctccggcatcgccgctcctccatcctgctcccggcaactaccaatagccgcgcagacagcagcgaaccaaccctagggtagtcacttcaaggaccggaggaagttggatggtatgtgatctgcttcttctctgtgttattgctgcttttgtcttggattatttcggttggatatcatccgatatatgcacacagagttttggaatcattccccaatttaacaaccaaacaggtatatttagtatttaatcctagattttatttccatatacatccatataggtacatttgaatttgaattatatttagaaaatcagaatcttcggggatgcgaattggattttgtgggaaatggggccaacaagtttatttttaccatgtcatggtgagaaatcattttatgatgataatcagaggttagggcaaacctgcacttaagcgcgccctgtgtaaattgcagcctaatatattcattcatcttatagcaagctacatttctcaacagccatttacacaacatcgacatttagatgacaggcccaaaacaaaatatggacattagattaaaaattatagactcaagaattttgaagcagttggtaagtggagacttcacaatcagaaatggatgacagaaaaataaacttcaaatcgttaatgaccacaccaaaacaccaaattccttgtcgcgagaattgcacgccgtccgagtggatggaaaaacaagaaagcaacggtgccccaaaacgccaggacgaatgaggcagcactgactgcatagagcactggatcatctgccatactgtctcttccttccgatgcaagtcacctgctcctgaatctggagagcatatgtttccctttgacatactccgaagattactgttgccttggtagctatccataccgtacgtgccgaactgaccagagtttggaatacatcctgataagttgttatatgccacagagaacaccgctaatgacgataatttggtcagctgccatggaatcaatccactcagttcattgtgggaaaggtccaagctttcaatctcgctcatgtttgcaaagcttgctgggatttgaccagtgaagaaattgttggacaggttgagggatttgatatggctcagattcccaagctcccatggaatttctcctgacagcatattcccggataagtcgataccagacatcagatcgaagaagttgtaaccatatgtatattgtcccccttttgtagcaaaggtgaagtctattgggtcatgaacaattatgtaagcctctattataacataaataagtagcaatggtgaataattttgagctgccgtatcactctcacaagagatgttgccaacacatggtggcagtgagcctgagagtttgttgtgtgagaagtcgattatccttgggcactttagtttacacaagtttggagtgatttggccttcaaagtcattccatcccaatgaaagtgtcttgattttatcaagatgccgtaaccaattgaggttaccagtcaacttattatgtctcatatccaaatacataagatttgatgtgttgaaaagatcatccgagatgtttcctgataatgaattcccatacagattaagcgaacttagagatgcactggcacatcttggtatagatcctgataagttgttgtttgaaagatctaaaatttcaatgcttgccaagctgcaaattttttgagggatactgccagttatatggttcccagaaagatctagtacctgcaatttagacagattccaaaatgaggtgtcaagttcaccggacaggctgttatcatgcaaatccatgattactagtgctcctgacagattacgaggcagtgttccttcaaatttgttgttctgtaggtgcattgcaaacccgatggacagttttttcatcccaccaaacaccagacctccaagctggttgtttgaggcactcaaggtccacagctcaagaaaatcagtgaacacacaagtcggcattttaccagaaaaattattgtttgataagctcaagtccttcatgtgtttgatgctgcacagtgacatcggaatttctccatgaaagttattgtctgacaaatccagagtggacaagcttggaaatattgcgctgaagttggcaggtagcttccctgtaatacggttggtagatataacaatagattgtagagctgtttgggggtgccatatgggacttagagatccagttagcgagttatttccaaggtttaggttaaccagagttgcttcttttgtaaaaagccaattcggcattcttcctgacaagttattgtttgacaagtcaagctcctgcaaatgatgttgtgtgcgtagaaagtgtggttctgcaattatgcctttgtcaagaccacaaccagagagagctaactgtttcagttggaatggaggtgcccatccaggaatattgacatcaactgctaaattaatattccctgacaagttgatttcttcaagtttagtgaggttcctcagccaaaaaaatgagagtttaccactcagattgttctgggaaaaccgaagacctttgagagacagagaaagatttgaagatggagttatagggataggtccttcaaaagtatttcccgagagatccaatcgttcaatatgtggaagtgaaagcaagaaagtagaaatgtttccagtgaagttattggaactcaaatgcaattctcgtaggttccttagatatccgaatgctgcgcaaagtatgaatacaatgaatcagttataatcagcatcatagaaaatcttgcccagatgttatgatcaagcatgaaatgtccattatttttacctcgttcggttggaagagctccactcatcctgttgttgttgagatttaatacttgtagtgaaactggctccaaagatgaattaattggagtacgtcctgctaacgaacttcctgagggatcaaggtgaggtagttcaagtaatgaccccggaaggcttccgctgaatccgttggcactcaaattcagctccttcagattcgtaagattttttaaaactgcaatagtgttacaaatataacagcacatgtacaagatgttacaaatataatcatcacatgtacaagatgctaattctttactgaactatgttcattctaaatatccatttctgtacctgcagtgggaacaactccactcatggcgttggagctggcatctaggacttcaagcgaaaccagttccccaagatctgcgaggatactctcttgcaaccagttataactgaggttgagatgctgtagcttgggcagcttcagccctaccaagctgatgatagtttgtctgaaaatattagtcattgcaaaagcaaggagcaatcttggttattcaggatggacactgtgcacataccatcgatatttagagaactgggatagatactggacagatccaggaactgaagctccgggaatgaggagaagaccgtcgtgttgaaacgccaaaacgagtcaccatgtgcatttagcacttccagagaatcatacaggtttgagaagtagagatgtgatactcgcccagtgatgttgctgcatttgacgcgctcccacaagcagcagtcgtcgtcaccgtcgccgcgcccccatgatggcggcaccgtgccgtttgagcgcgtcagagaggagccaatgtccatcagcgccgtcctctcctccacgaagcagccatgggacgtggagatattggaatctagcaagcatagcacaaccaagaagaagaagaagaagaatctcatcctgaaataaactccgtcttctcctgcgctcatctctagcaggctggagacacctgaggatgatcgatcagtggtggattactactagattgcgtggttttatcatgctgctgcatttgtcctgtttccatgaactttcatgggtacacacggctggtgaagcaacttttgattggaccaggttttcctggtcgtacccggtccgtgacttttgtgagttgacacgcgacgaccctgtagctagctttgtggttttaaagttttgcagtctgggattctggaaggacaagtgggagtgtgggacagcaggaacgcggagatctcatgatgagattatctgctttcgtcgataactgaaattttaaggccaagttgggagtcaccggagctgatccccctttcttctcccgtggtgtacgggctggtcgacgtcgttaatttcactttgggattttattgtcaaagtttcactttggactaggtaactttacctttgttgcacaatgaagcaccccaaaccacatcttcagttcttcgatgactttgagcgaattgttactgacgtgctagtaaattttcatgtctaaatgcttgctatacctttatcgaaagaacgctagacatcactagcgtaaagagttatggtggtttattgtgcaacaaagataaagttgtctagtccaaagtgaaaagattgtgtatagagtgatccaaagtgaaactttggcaataaaacatggctcaaagtgcaattcactcttttatttttttggttctgggtcaccttcgcgttgcgtgccctcagcatctgagtttagggtttgtttgaaaagcttctagcatctatacctttttctagaatcagaaactctcttaggctgcgttctttccacaagtttcccaacccctttccctcgttttccgcgtgcacacttttcaaactgctaaatggtgtgtttttttgcaaaaagtttctatacgaaagttgctttaaaaaaacaaattaatccatttttgaaaaaaaattaactaatacttaattaatcacatgctaatggaccgctccgttttccgtgcggtggagttgggttcccaaccccaagtatcaaacacagccttaaaccgttcaactttttcttcagtttttgagaagttgtagttataagaaatctagcttctctaaattctcagaaactgtttaccaaccaattgttttttagaattttaagcttcttaaattgagctttagagattgaatgtagcattgcattatacattctccgtcctaggaaaagatcatttatgtcttttttgtttatcccaaaataaatttattttaagtaattattatattagatttcgtgaaaaatagataaagtaataaataactgcattaagatttggtgaagtatgcggtattttagttttgttttctaaattcgtgttgatatgtgtaagacgagcgaaaaaataaacttacttcgatacggaggaagcaacttgagcagatgcaaagcccgatcgcatacagtcaagtcgcaactcgcacgtcgcgtccgtaacggcgcctggaagcagcttcgtcttggtgcattctgccaacaacttgacgataaccgggacctcatagttgaagccgggaacgtcgagctcgatggcgtccgcgacggagcctgcaagcaacttgtacagtcatctgtacatcccattcccaccaacaacttacctggcacggtcctgcaaaatctccaaaagaaatttttggcccaatcttctgtttcccccggccttttgggagcttcttctgtgattgacttggggccggttaccagtggcagcaatcaggctggacctgccacaacgcctcctcggcccatgaaagcttccttttccaagagcaaagttgtaacatcaaccggaccggacgaacaggtcctgccatgcgattccagcaaaggacgcaaagatgcaagcatctcaagtccgatggcgaaaacgacagcgaatagcgtgtgaaaataggttgagaggtttgatgagcattggtgaagccgattggtatggtttgcgttgcgctgacaccagactgatttatttgcatcaatgatatcaggtatgctctagtggtccttttaagattggtttgatgaagtggttgaagattatgacgatttttgtccgtcctcataccgtcgtacgtatgcttgcccattttctagtgtgagcaattgtttttcttgatgctgtatcttagacttattaaacaagctactgcagggagggtgcttggtgtgtttagttcacgtcaaaactggaagtttggttgaaattagaacgatgtgacggaaaagttggaagtttatgtgtgtgtaggaaagttttgatgtgatggaaaagttggaagtttaaaactaaggctgtgtttagttccttctaaaattaaaagtttgggttgaaattggtacaatgtgactgaaaaattgtatgtgtatgacatgttgatgtgatggaaaaaattgaaagtttggatccaaagtttggacctaaacacaccctaaattcggtctcaaccagtttggactttggagtggcacatcacctcaactagagccaactctgcacctcgaaatatcaggcgagaacttacctgtcaataatcaggcaggattcctatctgttgatttgttatccaggctatgtttagattgaggcaaagtttgaattttggttgaaattaaagatgatgtgactganaagttgtgtgtgtatgacaagttgatgtgatgaaaaaggactgaagtttggatccaaacacaaccccggtagccatgcgctcctctgaacttgcaaaaaaagaggagaaaatctgcaactgaggctgtgtttagatccaaagtttggacccaaacttcagtcttttttcatcaaattaacctgtcatacacacataatttttcagtcacattatctctaatttcaaccaaaatccaaacgatctcccaagtttcggatcgtgaacggagaacccgtgccgcatgctgacccttgactttgactgacagtgaccgatccactaattaggcaatttcccgctgtcaagtatgctacttatgattatctcctactatctcgtgtttatgaaacactgaccaatttgactgtaacatgtgaacaggggaaaaaaagagatgcgtcatgcgtatagggataagtagtctaagaggaattgtacaacggataatacgaacgacacgttgcgtgtgccggctctctggcttggagcacaacaccacaattactcgtgagcaagttactacttgtacctgttgtcgcgatccatggagactagtaaggcgtccatgtgatgtcattgttgatgggcaagtgcctgtgccaatcaggacacccaaattgcctgtcaatgcacatgcgtcccaactctcccaagtctccacttgagatggcgtcctcagttcgtcattattaggataagattgtccgggagtccctattcacacccagcaaatcggcgattacacgaactaatctatcattatctctagccgtcagggctttaatactctccatgattgtccgcgcggttcgccagcagcagcagcaacaacccccgcaaaattcccagattttgtgggacgcgcacgcgaaaaactccttccaatcgaagaggatagagagcagtgtggtggagacgtggagtggacaaggaaatgggcattgacttccacgcccaccttgttgcctccgctgcggcgtcgttgcctcgcctcccccaccaatcggatcggcgcgtcgcctataaaatttcctcccaactcctaactgcccactccgatttgacgccatctgctcgtctgcctcctccccgatttcctctcctctctctctctccctctctccatccctcccggcgtccaatctgttctgcttctcgctgcgcccccggaattgtggtgaggttttgtgagggtgtgggggaggaggaggatggcggaggaggtgtatgtcgcgtcgatcgaccagggcacgacgagcacgcggttcatcgtctacgaccgccacgccaagcccgtcgcgtcgcatcagctcgagttcaagcagcactacccggaggctgggtaagtgtgctgaactgctaattagtgatgctctttacaacgatgtgatatttcgggtggagattggcattagcatgggattattatgtgatctgtgtgatggattctggggctgaatgtactgctcgattggttgacctggatggaattgaggtgctgttagttttaaatatgctacctttttgtggtggttgtgattcattttgttttgtttgtggaggttcatagtagtagtactgttaattgcttgttgctgtatcaggttttccattgccgtttattttgatggcttaattgtcaaattaggattataatatgtgatgccagaaataggatattttgctctcctttatttattttttgcacatatctctataattttctagtgctagataataaccagaaatgcacacccttatggccttttatgtttcacaacaaagctcctttcctcctcctttgaacgattgagatttaagctatatagtgccaaacaaattcggaatatgataaggataggttcatatttttctacatgattatcatgttaagtgttgcttgctttcttactgagttaatggagtcgcaaaagtctagtcttcttgattttgagctatcatctggggacaggggtacttaaatctatggtgcgttaaggatcaagctctttatctgcttgagtaatttgtttccttgacaattgatctgtgaccatcataacttgtgctttgaaatttgacttctcaatgctgtattcatggagatgtctgattagcctgagttactttaaatctattaaaattttaataattaccttgatgcattttaaggggggcaacttctttattgtccacatgagtatacatttcttgcatgaatagtagaaaatttagaatcctgttctgttgttttgttgatttgtgcaaggagaaaccgaccaaactgaggcgtgccttatgctgtgacattctattgtctctgtttctggtcagtggtcagactcactgtagcatgttctctttagtgccacatatatgtgcgatgcactgaaaaattcgtcttgaatttttgttgatgtttgataccactttactttgccttttagagacaacttatgattttgctttacttatttgtgagttgtgactctgtctgctggtatgaattaacagatgggttgagcatgatcctatggagattatggagagtgtgaagatatgcatggcgaaggcacttgacaaagctgcagctgatggtcataatatggatgttggactgaaggccattggtattacaaatcagagggaaaccactgttatgtggagcaaatccacaggccttcctctatacaatgccattgtatggatggatgctcgcacaagccccatttgcaggtcttccctttgtccatcatgtttgacatatcagtgttatatagtgcagttttctcataatgtttgacctttcaggagattggaaagtgatctttctggtggtagaacccactttgtcgagacatgtggattgccaatcagtacctatttcagtgctttgaaggtgttatggttgatcgaaaatgtggatgccgtcaagaatgcagtccgagctggtgatgccttatttggcacaattgacacctggttaatctggaacctcacaggaggcattggcgggacagatcgtgatggaaataaagtatttgggcaccatgtcacagactgctccaatgcatctcgcacaatgcttatgaacctgaaggcacttgactgggacaaaccaacacttgagacgttaggaattcctgctgagatattgcccaaaattatcagtaactcggagagaattggtgtggttgccaatgggtttcccttggcgggcgtccctattgctgggtgcctaggagaccagcatgctgcaatgcttgggcagctgtgccagaaaggtgaagccaaaagcacctacggaactggtgccttcattcttctcaacacaggggaggagcctacccaatcctcccatggtcttcttagcacgattgcttataagcttggcccaagcgcacccactaattatgctctagaaggctccatcgcaattgctggtgccgcagttcagtggttgagagacagccttggaatcattagcacagcagctgatattgaaaagttggctgatactgtgcaggattcaggtggaatatactttgttccagcattcaatgggttgtttgcaccatggtggagggatgatgcaagaggcatatgtataggaatcacacggttcactaacaaggggcacattgctcgagcagtgctcgagagtatgtgctttcaggtgaatgatgtcctcagctccatgcacaaggatgctggggaggcaggagaagtgaagagtgcagaaggggagttcctgctgcgcgttgatggtggtgctactgtcaacaatcttctcatgcagatccaggtaataatccttctcacgagatttaaaaagaataataaatactctgctagcttttccattggaacagtggaacatttactatcacgcagatgcgaaatttctgggttgatgagcaactacgtttaagagtaaaataattcaaataggttatcaacgttgatgttaccaccacctgaaatgttcatgcttatagttgtgcttttgacttggtgaaaatgaatgaaatgcaagatgttggctctttgtgtccctctttctatttaaggttaaccaaagcaccaattgttaccttttgcacataatgacctcttacttctgtgagtcatacttgacatgattgcagccacatctgtacagcactatgctatcaatctcaaacaggaaaaaaatatataagtactgtcttcatctgtaaacaaaacagtagtgctatgaactgttatttcaaaattcactatcttattgataactgatctttggctaatttacttatatcctcctacagtacagcttactgaaattagaagcttgagctaattagttaaatcctcttatagtattgcttactgaaattgtcttgaaaaacaatctttttaaatgcactgggtgtaattgtagctgtagcttagtgaaacgtttctctttgcaattgtaaaatctctccaaattcccataagatcactgattttgcatgcacacctgcaggctgatttattgggtagccctgttgtcagacctgctgacatcgagacaactgcccttggagctgcgtatgcagctggattagctgttggagtctggtcgaaggaacaaattttcgctggtttgcacaaggagaacaccagagtcttccgcccgaaattggatgaggcccacaggaggaagagagcagactcctggtacaaggccgtttcaagatcatttgatttggctgacctttctctttagaatgacgagggatttgtgaattacttctggattgtataaggtgcttagcacttgttatgtccatgaataagttggtcaatggaacatccttcaaaagaattagttgattccccacgctttgctgctggaattattaagtaattttcaatatacttttttaacaattgagataggagtaaaaagaaaaaataatgaaatgtcagtgtttattcagtacttatcctgaaacaaacaaatgatgcctgcgctttaatgtggaacatgttgatgagtatatgttaaatattataaaaatgatagatagatttattaaaatattgtaaaaatgatgtaagagatgattggatatgtttgtatgttgatttgtaaaattaaatagattatagatgatattgcatattttcatgaggttaaatatttaattattgctagtgggtgatgatgtagaatggttgtatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39459 - DNA, 24438 bp, Oryza sativa
  unsure (1)..(24438): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgatgctgatgagatctccagccgctgtagacacaatggggaaagttgattgagttgtaaaaaaatatatataataaaggtaatactttttcgccgggctcataaaagtattacccccaaaaaaaccagacaaaataaaaaaaaagacagataacagaaacagagtgaatgggtaataaaaaaaattgtagcactactaaatggtaataaatttatatcacgtcctattcaacttgactcaaaattaaagaaacaaaaaacatattaagcaagactgactgctctttatttgagcttgcctgcaatttgtattacaagaacaaaagcaatgctatatattacagacaggattatcatcggtggagcaaattacttgcagatacaaagcacaaatatgtaacacattctccaaatgaaatacctaatacattgcaaagtacaaaggcaagttccagaataacaaactaacaaagtcaagaagtaaaataatgtggatcttaccatctgtacatgctgatcttcattcctagaaacacattttggaccttctttagcagggaaactgtttagaaataactgcattaggcataatactatgaaggctaaatgatgaaaaataaataactgaaagaattaccgttctagctgaagcttggattcaagagaagacactccgtgttgattgcccttgtttatgtcagagttggatggtttcccaagttcattgattgtggattcaccatcgacaccatgtgccatcatttttcctgtttctttcaatgcattaagctctgctcgcaggcttgaagcttttccttctgattcctcacatttagagactggtattttattcctgaaaatttctgagtcatcatcagctttatatccaatatccattaagcttgatacagatactatcgccatctgcatcttgttaggcgtcctgggttcacacatgccatctgttgtttggattccggtgtgcttaattactggaacaacttctagtccggaactgctatttatctccaagttctttatgatagtctccctcatgtctgatacatcttggagtgaaaagcagtggctgattatccagtctagtgtgatattgatttcaagcacaaatctttcaacatctgtactcccatacaaaagctcgttacacccaaggacgaaattttgtagtacagaagtaagttcagacgttttccacaggaatgcacgtgcaacgtagccagtcaatgtgttagagcggtcgccctcactgccaccagagagcacaacagtgctactataatcttttgatgatctctggacaacaccctcaataagttctatcaacttcaggactgccttctcaatcttgtgctgacggagttggtcagatgtttcaataggaccatcaactgttactagctctttccctgatgattctctagactccctccttgaatcatacgattctgtaggtttcgcatcacatgccaatgctaacttttctatctcttcaaagtcgtccatgaaactcaagtctgatactccggtactcttacaagagggtgtagtcagcttccccttcttgaagtgttccagttcagaaatcaaggcagacgcccatgagcttgaacagctgacattatcttcattgcaaccgtcctcggagattgatgatagagggttctcgaccactgtaggactgcattttactaaatctgttgcaacccgacctcttgataactcctcaagctgagcttcaacttgggaaagtttagaggttgtgcgagcaagcatggtccgcgaatactggagctcaccatccttactagaaagagattccttcatagtcttattttcgtcttccatcgcatgcagccttgcaagcaatgaagaactttcatgtgatgcatcataggagttctgcactagattgcctgagttgaatgatgttgtagaattgaaccttctcgtccttgttattactgcattgttacccagtgtttcaacttcatttctcattttagcaatggcagcagggcctggtagccttttacgtaccattgaacgcaatctctggcattctgcttcaagttttgtaatcttttttacattctcaagatgttgtttatgtgcagcatcagcagatttcaggttaaatttcctttcctcacttcgaatatcaagttgcttctgcagcatgcaaacctcatatctaagagaagaattcaatttgtccgctgactctagttttacctcaaggttcttgaaatttgactctatcacaccctttgcttcagttaactctgagatcattttctctttcattgagagcatttcagaaagtttcctattctcggcatccaagctagcaattatgtttattttctctactacatctccttccagcctctcaactttaacttgctcatgagaaatcagtttagcagtgtcctttatcaataactccctctctaccatggcaacatttagagcctcatcaagatggcaaatcctttgctcaattgcggctttctgatctagagtatcatcaagttgtgtcttaatagctattgcttcaccttcagctttctcccaacctagaatagttgtaaaccaataacatgaattgcagaaaaaaagaattgcagaactttaattgccattgtatctgcatacttgcagctgtccatttctcttctaggatggaaaaatcatgtgcttaactagttttgaaacaagaacatgtatcagttagcgaaaagtgaatggagttttacctaatattgcttcttctgccacttttgcttgcttagctaaaatagcatccttctccacgcattcagcttgagcaaatgaaatctgttcatttaagcattgcaaggatctctctaaccgtgcaatcttctctttctgcagggaaggaaaagttgaaaatccagataggaacatatcataattcataaggcttcttaataatgttaaagagataagtgatgtacctcctgttccctctctgatatattggctttgttcttcgttgaaattgtcctttctgaggatttttttctccaaagccatgttttattatccattagtgagatgctaaatatctatcaatattcaacgccgttctaaactccctagaaattaataagaaatataaatgttagtaagatatattcccaccaaattgtacaaaaggtggatacagacagaacatttccttgggtgctattctattaagaaactgaaattgtgtgtatcaagtcatctttgcaaaactatcccaagctaacataatctgaaagcaagttgtattttatcccagttaaattcatataattatatcgtatacacgttagttttttattccatgagacaaggttgaaaaatacaagaatttggactcgtggactaaaacaaagaaatccctttgaacactttctaagcttaataaaaactttggctggcgtatgccagctcagcaagtattttgttaaccaatgattgttcagaagtaaagtactgttaattatctgccatgttaatagaaattgaccactatctaatctactattcatgattaataagtttcttcatcagctaaccataatatcattttcctttcaatgcagaaagcgatgctcagctcagaaaagaaagtaaaggatatagtgaagcttgttctgttccactctctttgtacctaccacttcaaaaggtaaagtttttggcaaaatacagctatagagtttcttaaaacaaattttaacagaattgcccgtcaacttttagcttctgtgtcagctccaatagtggaagcccattgacattgaacctatcactttgatccagaagcgtcaccaaccgatgcaattaaaaccagccggtacaaaggcatttatgtgactcaggtacgtcctctcagaagtcaaaagaactgaagtacttaaacacctctaaaaacgaaatgcttcttctttgtctcgacaatctttagggcgtactattttgatggcatttactattttggacaactcgaatatagtagtaaaccttaaaacctctgaacgaagttttattgctaactggagtgaggcccaacctcacaatatctatttagacagtatttatgcaaattgattgcatctaaatctagacaaatatacaattcacaaggagggcaagagaagaagatgagagaaaagaaagatgcagaaacaagcagtcagagctcagaagtctaactctaaacccactagaaatattaactcaaaataagcttccttctgcgcagcaggaagtgaaaatggtacatcagctagaactgatggcgaaaaccccaaaagggctccacggtgaaacaagaagacaggatccctaagagcaccagcagtttagcaagagcggcttctgcaatcggcatgcatgttagtgtagttaagcaattaagccaaaaacatcaccatctaactagctccaaacccattaggtccttagcccaagctctagatttccccatcgttttcccagccagcaaacaaagaagaagatggagtgtgctcacaccgcgcattgacaaaggatccaaaagggcaagagtaaaatagaaggaagcaagattttcaagaactcaagaaaaggcactagtagccagtagccagtgaggtgaggtgagtgagctgaactgaactgacctccagtgacaacaggtggtggctctgctgcagctcaccaagaatgaactgccgctgcctcactgtgagcctgtgacggcatcctatggaggagggagatgaagacaaggacacaaaggtggatggaagggagaaaaaggtgacacgggtataagaacaaagcgatcgttcagcttttcccgtggggcaaccgctggggtctcactccgtaatttttttcttagtagatccttgcaatgacacatgtaccagcggatactgatgctgcgtattggctcactggcctgtggacccggggctcaaatttagccctttctcggattttagctatccgtatgcgcggtgaatcctgtgatgctgtgatgaaaagtcgatttagctcgagagtgtttgcctaagtttggggcttttaagtgtcggcggtgccgttggacaagagtagaatggagtgcaatagcagcattgcactccccattaaattactgctcctgttgtccccataagtacaggagtatcttgtgattccagcaagttatgacaataattacctgttttttgtccaggagagttcattgccagcttgccacagtacaaaatgattttcgtgagcacattcatcaatagtgtagagaagggatcagtgatgacagaagaatactagttgttggcacatatagtactaccgctactacaatggtttacttagtgattaattacatggatattggataactaacctgagagtggataggacctgcagcagtggcccataaggagggcgtgcatcagtggcatcgaccaccgtcagcttagaacgtttgtgaggtttacccacctaaatgattggcacttatcacatgtattaatggtttgatgcatgaatcaagggacagcggattgaaagtacggacaacttgtttgtgctacttacgttggaagtgtacacctcaagctagtgtgacatcggttcatcaatccatctgtcgggctgtcttgcgcaccaccaggaggaaagattgccagctatgttcctaaagcgacacatatatttgctgcacgataaatttagcgtcatataccagtcagtggcatcaatcttaattcacagtccacaagccaacagatctgtgaaatggatcggtcagtgtctcagtggctgattacttcaacgattagctccacgcagatgcagtcaaacgctaatttgacaatctgctgtaacggtcgttggacagatcgcagaggtgacaagtggggttccatgcagcgcagtgcagtaccacggacaagccttttctctgaagcaaaatatgaagaaaagtaacccgttgagaagagaagaagaatttacttcgagtaaaaggctgagctgaacatccaggtccagtccatgcaggctggcccggtgccaatctgctggaccaccagcccatagccaaaccaagctaagtagacttttgggtccaccggtccatcccgccgcatccgtggagtcacgtgtcctcatcgctcgccccatgctgcaattgcggccctgtcccgggtttgatgggccaatcgcgcgggcgcgcatgggcaaaacagcctcgccgaccgccgcgtcgcgcgttgcgggtgggctccgtgcccgtgccgccgcgacgacgatctcctcggtggcggcgtctccgcctgtcgtacgcgtgatgccgcgcgcgccgagccgaacaagtaaacaaccgatcggtccgcatcacccgccgtcgatcggtgagacggtgagtacgtaatccaagtgatgcacgggccgtatgcacgcgtgctgtgccggtcatatgtatacgccccagaaaaatgatttcatccgtaaagcggcggcggcggcggcggcttggaacgacacacgtcccattcttgcgtcattacaatcggtgtgttgattatgccgtcggcttcacagctcacacaagtcgcccatgtacgcctcagggtcatctcacgcgcacttgtgcccgtgctaaagacaagttcttcgatcgtcggtggtgccaaagtctaagcttgcacgacggttctacaggagattagtgccgcccggccggcctggaaccacaatttcaagggggcttgctcggacaattatacttggcattattgattatggctcaagagtactatacatcatatagatacggcgtcataacaggtcattggatggaaacgaattaggcatgcgggtacagcgtgtgtacttcctccactatccgtgaagtggaagtcaatttctgcaagatttccatttacctatagctaggtagcactactaactactccagtacagcaagccgtcctaaactcgtatcaaaacgtccaaacttcagctgattttcgtggaaattctgcttcatcagcagttccgttttaacccctgctcgtcgactgcctgccgggccaagcaagcaacaccaattcgatcgaggcaacacacaacacgacacgagacggtggcgcgtggcgggcgatgggcgatagacggatgggaagagcatcggagcgcatgctaggtcgtagccagtgagacaacgcgacgcgcgagagaggtggtggtggtggcgtccgtgcggagccagtctcacgtcgccatcgcgcactggcgccagatctggaccggacgggcgggggcgcggcagaaaaaaaagaatacgatatacaatgcgaccaatcgatcgatcgggagcggcttttgctggtgaatagctgcgcgtcggtgcccactttccctttggggaaggtcggggcaggccgtgaacaggaccgacgacgcgagccaccgaccgaccggccgtccttccttcccttccttcctcctctctccttccctccagggaaatccaccactactactcccgactattctaccggcaaaaagtgaatctagctagtagtggtacctaagctaccggccgtggctgcatgtattggcctagatagctagctgcaatgtagcgatgagccgatgcgtgtaacgctgccctgtgcgtgcgtgcgtgcgtgcgtgcttcccggtctccgcacctttgtgcttacctttttccttcgtccatgtagcacgcacgtcgacccgtcgttgcatgctggtctcgtgcgtgtgcttcagcagctgacgtacgagtcgatcgatcagctccgcgctcgcttgatatttccggtggccggcacgctggggccctacgttgcacagttccacgcagcaggggatgccgagagcgcccgggccgtcgagtggaagcatcgatcatgcggcccgaggggggcatttttgccggggagaggagggcctgcagccgcgcgcgcacagtgcgcgcactcgcagctgctcatgtctcgctactcgctagcgacgccccgcgcgcgcgtcgtggggtctcacgctcgtacgtacgcgctcgcgcgcgcgcgccatcgggtggtttcagctagtttcgtcccgtgaaaccgagtacggccgcccgcgccgagaccccacgcgggcacgccttgccggccgagacgtatccattgtggcacttatccatttactcgatcgaccgtgcaaggaaaccacttgcacgggccattgatgaagagaaatttagttgcctngtatggtatgcatgccgttttttgtcatgagcttagtgaggataagctcatggatcatgtgggcctaaatgtgatatagtacaggagtttcttcgcgggtatatcaagagttcaataccatttgcgcagattatttcttgtagccacacatattaattgagagcctgcatgatgcatatgccatcgatcgttttctagctgcatgcagacccaggtccgcgagtcgcaaggggacaagaggaaaattttctttccccctgctattgcacaacagttatagtggctagtagaaatgcatagaacgcatgtgcatggcaccctcgcgagctggcccctagcaaagcttacacaagaaaagctacaagacacttgcgaacaagtcacgacgactagtcctgattgttgcttcggttagacgtactacgtccctacttactaagaatgatgctgaacacgcagccaattaatcctgccttgtccttgtcatatatctgatgctagcaaccggctgaaccaccgctcgatcgcattgcattttttttcatagattgccacaaacatgcacacggcacggaaactcaagggatccatcaggaggcacccctgttcatcaatacacacaagcgaaatctagaacgaacaccaaaacgatttctgacaagctctttccctgcccatccactgcgaacgataaaaaccaggaccaagtcctgaacgaggaacaggtggacgaagtgaggtgaaagtgaccaagcgtctgatgactgatgagatctggtgctagcaataagagcaagttcaatagtatagccaactactagctccaattcatctatagctaatttaatagctcattcatataatagttacatactacactattaatacctagtcccacctatcatagacacactgtgtcttggagtccgtgctacagctggctacaaatctgtagcccgctgctcttctctctcctaatttatctccttaaaatatgtttgcagctggcttatagtctgctattgtacctgctctaatggccacagggagactgaaaacggccaatgcgctcgcctggttggttgccggtgagaggcagctaaggtaaagcttagctccagggggcgaactgattcggagagccgaggagagcgacacggcatcggatgagaccacattaacttgttttttaccgcgagaggttggctctcatggtcatggcccagccagtggctggcccagctcgcttttgtgaaccagtcgcatacatacacatgcttgccttgcttgatgcccggttgctgctgatgctaccctgcactgcactgcacttcacttcactctctctcatctcgccccacacacattcaattattgcaatgcccaaattagaaacaaggaatcccctttctctagcaaaatgttacgcccacttgcatctatgccccggcactattctcttctcttctttttcagggaggtgcataggcaacacattttaaagcatctccaaggatataaaaaagcgagcggaaaagagatacatgcatctgcttattcctctttttctcttttctattcgggaaatctcatgataacatttttgttttcgcaacaagcaacagcaacctaaagatccgtaccttatcaaatgatcaagcacaaccgtacgtggtgggtctatatacattgattcatttttttttctttttggaagattgctatttaatcacgctttgaattcaattccaacaagtccagatgactgttggttgtctacttgtcttcgagatgttagatatgtgtgcaagtaacccaacactatgaaattaagagattattaggaagattctgcaaggaacagttcgatttttcttttcttgcattgcagatagggcccacatatctgattcctgttggtataggataccaaacgcagtcgtatgtcttttttaatttagaagaccaagcaccataaaacatctcttcttagagggagaaaagaaagaacattactttagtaccaacatctagaaggacgaatacttctatatgctccacatctcggcagttacgtttcttggaaagcaaagagccaaagcttaaatagttgacatatatgttaatctgatcgtctcttttgatgatgatagattacatgacagtagtagtagcgtaaagctagcactccgtaggatttataaagcgatgaatagtagtagaaaccgtgggtgtttaaggatgcttactagagggcaagtgttgtcggccaagcggaggtgcatggagcaaattttcccgaatcatggtcatcatgcagtgaatgatgcaacatgagaccgaacaaaatgagctgtgatgttgacacccagagtcatcgttgttggccatggtgaaagaaaagaaggaaagaaagcgagcgaaacggcaaaagatagatactcctacactgcttgaggcgacgcttggccaatctctctcgccttctagggagctcctcatttacatgcccacttgtgtcccattcatgatcagatccatctccatctcgctcgcccaatcaagaaacagagaagaagaaagagagaagaaaaaaggtagagcaaaagaatagcatccagctcttgttcttgctggtaaatctgcattgagtttttccctgcgtcagtgacacacacctctctctctccatcgatctttgccatgatcgatcgacgaggagacgatgaatgcagcgatcttgaattttaaatctttgatcatcttaggtgggccgggtcagggaatggaacccgttcttctgcagccaggttgaggcttgcgtcgcaatgtagggagggaatcgtgatgatgctgcagctgctgtagcggttgcggcggccgcggcgttggtcggcggcggcggcgggtgcggcgggtgcggccagctcatgccgccggcgttgccccacccctgctgctgctggggaggccagtgcccggccatgcctgcgccgatcgtcagtgacaggcctcccgctgtccccggatcaccattgctcaagaactagcagcacagacatcaagaattcatcagctcacggataccggtgaaaccaaacgcgagaaattcagcagcaaatggagcgaagtggagtggagttgtatagtgagctacccacttggtgatgatgcctgggactgaatggcaggtgggtgacctgcaggaccggaggcatctggggatggttcgagttctggtcgaactagacaagaaaacgaggaatttttaagcctttttattacgtgatgagaagacaatcggctgatgcggaaagcaaagtccccattctttttttaccttagctttggtgctcctcgccgccgccgtttgccagtcaaggtcgaacgccatagggacgcgctggtcggagcccgcgccaccgccaccgccgccggtgatctcgtcgtccccgccaccgtcaacgttgcccctcttggagcccgccgagctcccaagcgagaggtccaggttgtgctcggcggcatcacccgtggccgctgctgcaaaacagtgacagattttgtccggatgagcagtcacaactcacaaacgaacagcctagccatgagcagtaagcgcacacatgacacacccacccggcggctcgaactccccggcgtaaatgcttggatcgaagttcgtcaccgcatccttgccattgcacttgatggcagcgcggtcgtacgccctgtggccaagagacaagaaacatcaatcaccatcaccgctcgcccatctaacccagaagcgtaaactcgcaaacggcgcagcagccacactcgacattcaacaacaatggccgcgcgcgcgcacagtgcggcccaataattttacctggcagcttcctcctcggtgtcgaacagccccaagtagacgtacctgcagtgcaccaaaaacccacaagatgatttacgggagattgcccaagaacgaacgatcgaacgaaagaggaagaaacggtgatcgattaggacatacttcttgccgaggaattggcccatccgagcctcccatctcccgcacttgtggagcgtcacgcccctgtacttggagcttccccgggggaaccccgtgctctgccgccggagcacgtggacgaactcctccttggtcaggttgctcatctgcaatgatcccgttaatcttgcagctacagtaatagtagtatgatctaacgaaaccgtggcgactcatgaaaagaaaggaaagttcaggtaataataatcgatcgcgctctcacctgcttcaggtcatcctcgtaatcctccaagctgaaattgatgtcggcctccacgccgcggaacttgatcgccgcccgatcgtacgccctgcgattgggaaatgaacataacaaaaaagattagaattttgacagcgccggattcgattgggcgagcagggaatagaagtcagcgattggaagacgaggaattgagtccaacttaccgagccgccgcatgagcagtgtcaaatccgcctgcaaattcagtcgtcacaaaggcagccattgtgaggaatcgaaaccgcgcccatagagaaaaaacggctccaattggcgagccaatcgtggaggccgcttgtagcagttcccaagtatggggggtatggacaagatggacatgaatgaaacttacccaaatagacctgcttgccacaatccctgcattgcacaaaaggatgagaggagagagagaagacaagaagatggtgagtgatgagagaagagaagagagagagagagagagagagagagaggagagagtatggcaagaataacttgataagatgttgctatgaaaggtaaaaggagcagaagcaagaaatgcccaaaacaagacgaatccaataccaaacccgtccatgctgctcttcttttgctcccctttgcctctctctctctccttcttcctccgttgagctctcgaaaatggaaagaacgagcaggaggagacgaggatgcttaccatatgtgcgattcccatcgcccggtgcggcggtagaacgtgacgccgcggtactgcgagctgcgcgaccgcggcccgcgccggctcttcttggacaccgccgccgacgccgccggccccgttgcagcgaccggcggggcggctccggccaggcggagccacccggcgcgcgcgttcccgggggcggggtcgccgccgccgcccgggacggccggagggaagaactggcgcgtgacgacaaccacagcggccgagtcgtcgtcggcgtcgtcgggtatctcgacgacggcggcggccgaggacgaggaggcgccggagtcgtcggcggacggcgacagcggcggcggcgcggcctcggccgccggcgagtcattgaggtcccacatggcgtcgcccttcccccttcggtgagatgcctctgcctcgcctcctccgtcctcccccttgttgggtcttggactcttggcactgcaggagatagaaagaaagaaaggaagagaagagagagcaaggagaagcagagaaaagaaagagagggtagcagcagctgttgccttgttgggctatgcaagtactttctcttttgcctatctatctcgttggcaaagccgctgctaacctaggaggagagcagaggacgcgaaaagcaggggaggttgtgggtgtggccttgctgctgctgctgcgcattgcgcccgagcgattggggggagatggaatggagagaacgtagtaaagggggaatcgtggtggacgcgcggttataaaagcgcggcgtcatcgcgtgtttctccgtaagcagaggggcaaaaaattacacatgtttttagtagcaaaccttagccgaccgaacgggggaccctgatcgggggaggggggcggccgtgggttttcgcgcttggattcgattcgattgcttgtcttctcgcgtcttctccttttggtggcggcacgagggggggaggggccgcccttgcccttatcttggtctgcactgcactacactacactgcagccagggagggacggggcctttgctttgcttcttcgctttaccgttcgtccgtcctagctttgggtctgtgggcgcccgggctccgcctcagcaccgcccggatggactgtcacgtgtactcttgctattcgggatgcaccatcgtagtagtataaacggtagctcaacctcggtaccacgtacccaggttttaacgagcaagtctatataattagatagagtaattgagaaacatgagtttaaatagttactatctctgtcataaaatttagtaatctgagacccaacctaggacatgtctagatacattgtattaggataaggtcttatcccatactagattgttacattataggatggaggaagtacaaaaacagaacagacttactacgtgtagggaaagacgtggaaaacgactccatttttacagtagcagagatatgatttacgaatcggtttctttagtctgtatcatcttgataaatatggtagctacaatgattaagccgttactattatccactctatcttaaaatagaactgatttaaaattttaaaaatgtttttaaaaaaaggtagctaccttttacttgctcctacatcactattataatttctcccatataagaaattggtttcccacagcctagattggcatcattttcaacgttggatatatgtttttagacaagagcatttgatatatcaggtgtttatttccacctgtaaaagtagtaaatgttatacctaaaactttgaacaaaacttgaacaactacgagtggcactatttaccacagtagtcccagcatctttgctagactagagtacgtagtagtacgtgcatagctaggacctctttccatctttctctcatttcttgttaccgggatgccctctcgatctctcagtcaagaactcctagtcactacgctgccgcggtacttgacattctgacatctactgctctgcgaccaacaagccaacaacctatctagtcggagtacctcagtatcaatgcatgaagcaacggcttgacaaaccggacaggtccctatataacgtcgtattactactccttactaggaactactaacaataaacaaaattggtccggaagaatatgaattcaatttttaaatccaaattaaaattatttgtttctggttaccgatttgcttaataatctggcttggatcacaacaatccgaacgtccttttgctctacacgagaaattatgatccttacatgctccttctgtctccaaatatactacctacatcccaaaataaattcagcatttttcacacatcccacacatgccaatacaaaagaaaaaaaatagaatatccatactctattaaatcctaatacaactattcatttttttatctactccaatacaattattcactgctttttataaactccaatgcaataattactctaaaaataaaattattttaggacaaataaaatgaactaaaaaaaacttaatatgagacggaggaaatataacacgtactttacagattcgcaatagtaagatatatcctattcaatataagattgctactcctatacatattttaagaatgagttattagtgctatgatcctagcaccagcagtcacagctgcttgcatctacaaacaccatagcctatggcatgaaccatcaaaggcatcacccataattccaaaagcttccgaaagaacgacgagacaacttggaaggtgagcagtcagcgatcaaggaatgcctcttagctaacactagcagccatctcctatcggcaaaaattgtttgggcttatttatatacgatcgcttaattaacctgtggaaattaaacaagaaaattacagctactacacgggtcaaccaagtgcacgtctgtgccctgcatatcatatctggctttattaatccaaactctaatataatgttggtacctggacggcagaacttggttctagttttctcgcctgtcgactttggagaaggacgtacaaagacggtaacttgtaatctatccaacggtgtgttagactttggatcttgttggttttagtcggtatctgaatatctgatagcgagagtcatcgatgtaaaactgtgtctgattctgattgattggctcgcgtacaggtgaattgagtcagcatctactattcattgcgacatcgctctctccccaactatgtgaaatagtgaaattaaggacacatatatgaattctttttgtcgaattgttacatctataaaccaagaagtatattttgtactcctctcgtttctaaatatataaatatttctagattatttatcgaagattagtaagaggaaatattcattttcagtaacctcgttggccacatttaaatcatatatatatagaaacggagggagtatcacataagtttttctttttatttctttgcaaaacttctaaaacatttataaagagtacattattcctagcaacaagttataaatcacccatatatcgactttttgttgtcgtacaagatatatctgagatgttaaatcaacctcggactgaacggtgaagtcagaatcctcccaatcacaatttgatagtatattcttcacaataacactactggaaaaataatctttgctgggtcgacccaaaaccacaatagtcccggttccaaaaagaaccgggactaaaatgatctttacccccggctgaaaaccccacagccattatatgatctttagtaccgtttgttgttaccaacagggactaaagatggtctttagtctcggttcattccctgtcagaggcatgtcagggccgaggatctttactcccggttggtgacaccaactaggactaaagatcgccactttagattaaagatcatctagatctttactctcggttggtattaccaaccggtagtaaaattcaacacattgtatataatccatatcccttatcctctcctccacaattgcaaccactcagatcctccccttcctcctccccttccctcctactgtcccctggagacagacgccctcctcctcttcctcctccccttcctcctccctcccctggagacggaggccctcctccccttcctccttcctgccctggagacggaggccgcgccgcgcggacgcgtggtcccctccccttcctccccttcctcctccctgccctggagacggaggccgcgccgcgcagacgcgtggtgtatggacgaacgcgtgacgtgcggttgcagggtgcgcgcggtagtagtggcgccgtgattggagcttgttttctcttatgtgtgtgtgtatatatatatatatatatatatatatatatatatatatatatatatatatatatatatatatatatatatatattgtgattcactaatatgtataatctgtgatgtatttgatttgtgtatattagtaactttaagatttgtgatgtggattgggatgttactttgatttggggatttgggatgtgcatgccacttgattcgggagaaaataaaaaagaaacaaacaaagaaaagggaccatctagactgccgctatcctctatttagtaacaccaaccgggactaaaaatctttgactaaagatgggcatctttagtcccggattcctactcccggttggaaacccgggaccaaaggatcgttaccaaccgggagtaaaaaatgtttctccactagtgtaatttggagaaattgaagaggtcagctatctagatatccatctcaaagtcattttcgaaaggggaagtgataacatggtcccccgccattgtcttggcacaatcctgagggggaggactggtacgccgtgaggattggttttccccctttttttcgatttagtggtgaattgtgtcgtacgtgtactatactgcaaatagcacgttcaagtaaaagtttaggatacgcttctgatcgatgcttgtcaattcttcctactgttggctccattttcttgcaacatccatccttttatgtgccgtgtcatctttttttgcgttcgagagatatagaaaattattccatttgtacaataatttggttcactcatcgtgtgaactgcgcatatcggtatttcaacatccctttttgtttgcgtatgtaatttttctaggattaatgtaacctgtcatgaacgatgctgctttgcgttccctttcacataaccgtgaaaccgacaagggggaacaacttaattgccgctcttttcatgacatatactactttctctcttttatttctagctacgaaccgcacaacaacgaccgtcatatatagctgtgctaactgcctaagcttgataatttttttggtagaatatattgacaattcttaaacttgaggatattattaacaactataaaatatgaaaattacaatttgatcctttaaacttctaaaaccatgatccgtcatagccgttgtttagtcccattcaaatatctccattgtccctgtcgccacaaagtgagacccgcaccggtatattttactcttttacataagacaacagtaaacaacaaaccaaaatttctgcactcttgaaggaagccttatacaaaattaaagatgaacttctcttcatcagccatgcatatatgcagaggtgttgactctctaataaggcccttaaacagcgtgatcgatcgagattggcatatgcatatactccgctgtgcacgccgtaccaagaacgatatgttcagtacgaatattctcccctatccaagtttaaaaggcctgctacaacgcagctgtgtgcgtttcaggagttcagacgtttaaaagacgagattttacatatgcagcacagggctgaacaacagtgtccatcacctttctgttgttgaccaggagtacgtgctactagtatctatctatctatatagggccagaaagaaaaaggatggagtgatctgcattctgatcagtacaagtatactacattatcgtttgattgtacttcacttcgttgatcactttgcgaagtacttgtcttccacatggtcattctgagatcactttgacgcagaaacacgtctcaatgaacaaacaagttccgtacagccactaacatgcaatgcaaacttgttaactatttactccctgcacgttcacgttgttcgacgtgacccagctgggagagataaacagtgcttgtgcacatttgcatgcagtgtttacttgggagaagggaacgagaacaacaacagtaagacagtgtagttgtaaagtaaagtagtcgtcctagtgagagtagaagtacacgcgaataaggaaaccatagtttatgcctgcatgtcgagttggtccattggaccttagtagagcacggggtagagtagtctcacgctacagtgacgtctccccgactacaactacgagtccgtggctggctggctactgcctccatcgtgtataggttcgccccagattgggatcggtttccaagcccaaccgatgcttttacatgcatgcatgtggcacagccgcccctaccctagggacgtagtatcactgtagcacaagtagcaggacagctgggttagatcctatagcaagggttaaaaaaaattgtgtggttactctactgctcggctataagtaaaaaactcataaaattcaaacaagttttgtcgtaagtttttattgggtagtttctcgatttgtacgtaccagcttgaaaaactcgataaccaaatgtatattgttatatttattaacctttgatctcagcatatatattgatgtgttatttatgtacatgaaaaaaaatcaaacagctaagactattgtaaccaccaccgagtctacctcctctccttccttgatcacctaccaccgccactgatggaatacttctttttttatcttcctgatatgttgtctctctcctttcatgcatcgcacgcatccctcccgcctcatcgacgccagaagccatcaatggtgtcaaggagacccacccaaatcggtcccttccccacctcatgtctgaaccaagcagcggcgggtgttaatgccccgttgtcttcctcgtctccggtggctcacaccgtcggagacgcctccatcttcctcccaaatcagatgtgatcccaccaactatccttctctagcctcgcgtccactgcctccccgactatctctcttgacggagcgtggggctcctcaccgggagaccgcgtaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgtttttgggagatctgtgtatgaaggagctacaaagtatgagccagcctctcccttgttctgggtttctaatctggaaaagtccagtcccccctctaagtgggcaaggtcctccttttatatcttaaggggataccacatgcaccatttctctcttttttgtggggacttaccccaccttttcataaacagacggagacttgtatggttgccgtccgaatgaccttctgatgggacgacccatacctacctccacttccgccggaagcaggcgcgacgtgggaacatggctgtttgctgacgacatggccagtgtcagaccggtcacaaatcggtcattcttgtccaccacgcgtcagtttatcaatctgcatgttcgcccttcttcatacaatatcttgcctgtaatggttaggatgaagcctggcatatatctgaccaggactaacgtgccatctctgggaggtaacacgttagctccagctggggacgagcgcctagaagccctcgtcctgacgggatggggcgaggcgtgtgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggccctcggggctgaggggggtgcggcccgaccccctcggggggactaagaggagggcgaacacatcaccctcgggcccgacgtccctcgggggtaccaggccacgtgtgcgattgtgtctgcctcaaacctctagtcatgatactcctgatcccatgtcaccgacacctctaaagcccaacgtaactccaccatctctcaaccccaagacgctaatacatgtcttctgcgccctagcaacaaggaagatgaaccaatcattgaggggctcgcatagtcactgttggtaagtcctagctatcacgaggaagaggctcaggatggttgtatattcaaaatgtgaagaggcaaaaacttattttaccagctatagggtattgtgcgaattgtcgaattgggctattagacttgtacgaattagattgtcaaactggactactaggatatgatattcttttcattcctaggttaaatatggcattttaaaaatgttttcgtaatatatgtatgtaatactgttcatacctatttttccctaaaatagttaggtatgcatctaaatatccttcaatttaattgggtctgccccccctagctatcacctctcaccccgtctcctctctacgtgtgtcaccacccttgctatctatgtttagcgttgtttttatgttagcattgaaaaagatatactccgtagaaaattcgagaaatttgactaaaaattagcatacccatcgattttcatgagattttataggatcctacggcagggtggtttgatgcgaattgggaaggacagcgactttgaccgagcgccgatcagcggggtcgttggattaggtaatccagtacagtacaggcctctggttcgggaaacatttcccgttccgtgcgttggcgtccgaggcgaaatcccacgctgccactgcagccgtcggatgcatccgacgcacgtagtgacaccgaagcagaaccaatcacggctgggcagctacaccttccccaatttggatgcttcccacacacggctgtcttcgcatcaattaatcgctgacaaaggcatctctgtagcctagtgcttactaactgacggcgatattggatatatagctttgctgatgcggcaccaaagataatactagtataaaaacggcgccgatgttcgcacagtttctatgctgcacattagtattagatttgtgcgtaccattaggggaagcaaagcaccaaagctgcattaaacaacgagatggtccactgagagttttgggcaagttgcaagcattgttaagtccggagctcgcttggggccctcgtggccatcttcctccccacaccaagtgttcgaccactacctacgttggatgaacaaaatacaatatctcctgcccaccatgtagtattatagtgttattatatttatacttttcattagtagttatactaattaagtactcctactaatactaattgattgggggggggggggggggttggtcactggtcagtacttcattatgacagtgcagaggattgtgtgggaggcatcgattcttgatgatggctgcaggcgaggcaagggtgtttgtttgttcgttgtgcttgtgcacatggatgctttatttggcacgagactatcctattggaattaaggccctatttagatttcaactttttttaagagaggttttacggtgtttgcattccaaaaagggtaaagattcaacactcctcaatcacaggtaccatgttaaaagtatttaagtattgatataggtacttaggtactaagggtaaaaacataattttgctagtagagagaaaatggtagaattgtctctcaaattataaaaggtaccgcataggtataacggtacgtattaacaccgtaaaacctctttgcactgtttaatttcctgttttgcgtggtttattgtagatttacgttgtattggagttaagtcgtttactgcgtcactaaggtttaattttctgatttgcgtggtttcttgtagatttacgttggatttgagtctagatttacattgtgttcttataacacattattggcccaattatgttattttttttctacatttacattttattccaacgaatacgtaaaaactcctaccttaattatgttgaaaattatattttatttctagcaaaagatttatatcgtcgaccatacaatctagtctcctattcaaccctcaaccatacctacacttttccctctgtctctttccggtgaaacgttcaaaccctagaacaagaacaaagcagggaaagaagacgatgcgatctggaaaagaagacgatgcgatctggtatagatcgattggatatccgtgattttctttttttttctgatggcataccgatcgatggatattagatttactcttttttctgatggcataccgatcgatggatgttagtattcaattaaagtataatggccatgttttataagttaattacaccactgccatcatgttacaataaatttgttccgtaccttacccctctcttgatcaacggtgcacgttgttccacctccaggtacctctaggtacctcgcaaacaccgtaaaacatctctttttttaaacttctaatttttctgtcacatcaaacttttttacacacactttcaactttttcatcacattgttctaaattctttaaacttctaattttagcgtgtaactaaactcagcctaagggggctgcaggaa

SEQ ID NO: 39460 - DNA, 2361 bp, Oryza sativa
gccccctccccccgaaattttttatttttgttttatttgtttgatatttttttcacgcttaaggacacacaagaaccaaccatagaaaaattgaactcaaatggacgtaatatgtgacctgtaaaatttttcctctcctctcctctctctccgaactagtgcagaggagagagatgtgcaacttttttatttttattttatttttttgatatttttttcacacttaggaactcacaggaaccaaccatataaaaaataaactcaaacagacgaaatatgtggcatgtggaattttccaaagctctaccgaaaaacttctctcgaaaacacaatcttgcaagcggaatttggaggttttaatatcgccgaacccgacaaagcggggaagaatcggatgtaactttttctgtagatgtccgtgtatatattatttgcctgattccgagtccgaatgagaaagttacgcctattttaatagatgacatattttgtccgtttcggtagagttttggaaaattctacatgtcacatattttgtccgtttgagtttattttttatatggttggttcctatgttctcctaagtgtgaaaaaaaatatcaaaaaaatgaaataaaaataaaaaaaatgcatctctatggactgtttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtgatatgctagctattttcaaacttagctaagtggtagttcgagtttaatttttttttgtggttggttgtatcgtgatcctgagtgtgaaaaaacatccgaaaaaataaaataaaaatgacaccgttgcaactccatacaaagaaacaagaatggaggcgccggcgccagcatagctggcgccctcctcctgccacgtcggttcgcgtgcgccacggtggcagaaggacggcgccagccaccctggcgccccaaaaaggaccatttctgggataagttttttcagagatctatttgcgaaataagttttttaaaaggagcaaaatatgaaaaatccagtaatgaaggatgcacagtgacacaacacaagtggcctccctcaattatttgttggaacgctcttagctggctggtcaatttagatgtgaatgctttccttatttggcagtgcacatcgaatcatgttgctttcgcagcacacaaaaggccactgcgtttggaccaatggattcccgcgaaattaactgccgggccagctaattgagacgtaacgtagtactgctacagttatggagaaagtgttgcgttctgttggctgttgcgagcctaactcgcaagtggaaccaaaaaaaaaccaagagatgtttcatactagtactaatctggaacaatttgacagaaccataactttttcgtagctttgtgtttaaattgtcaaagacatctcttttctcaaactccctatactactacagtttggagaaagagttgccttttgttggctgttactccagcttgcatgttaatccaagaaatgtttcatgcagctaagcatgagccatctcacaaaacaaattgccaaagacaacttcaactctttactcgaatttcacaaaactacaactgcgagaggatacctctcaaaacaacatatttggccacatgattcttcctcctcaaaacacctccatcccatgaaatgtagtactgcttgagagcaatggcgtgtggagaccaaccttttcttttctaggttatcttgtcttccccaagagatacccacgcatgttgccggttgccattaaggcattaacaacagattactactactgatcacagaattttcagatgatgatactactgcttgatgcatactacgtggttcctgacttcacaacgaagtcatgctcctggcgtagtatcatgtcagatagtggtggttgagaccttgaaacttgaaagaccacaaaaaaaattgcagcttcagacttcagagtcgacagaccgccaacgagaacaagaataacacaggtgacaagtatggccgtatgggcatttccttctccttttcagtttgtaattactccaagattcaggctttcaataaccatgtgcccagcttgatccattttactgctagctgctggcctgctgccactcgatgcaaatgaaaagagaagatgtcagcagaaagtagcaacaccaaaccaccctgcagaaacagtcgttcacaggttcagaagcgtggagacactataacattttcctttccggtgaaagttg

SEQ ID NO: 39461 - DNA, 21245 bp, Oryza sativa
  unsure (1)..(21245): unsure at all n locations
tcttatataattaccaaaatttgatagcaaactaaatatagccacttttttttggtaaatttgaaaatgacatcaaattaaacaaccccttcaagtacacatcagagcatcgagtgacccaccaaccgattttcatctcctcttcaagctgattgctcaattccccatcttttcctttcacttcttgcctatattcaggctgtacaagacgactagcctggcctgttccttcttttcacctctactagtaggagtactaatttactgcctcgccaggcagttttccccgcatgcagcatgcttcactgaaatgccttgaaagcaaaagccttttttgggaggcagtctccctgctcgggactctgtttcctccatctcgacagggatttttttactgggctatggcttgtgatgcctgcatttctcatgcaacgcgacaaatggtgcctgtacttgtgcaaaaaaaaaacagcaagtttcagacatggtacacgtcatgtgcagacgatatgtggaaacgaggcaagctgctctgctgtaaaagggggattggttgctgctgtaaaaagaggatttggtccagacacatggaatcaatgcaggccgtagactgaaaagctgcctcgtctcacaacagaggaaaacgaaacatgcaaaccatatgctcaccgtaaggaaaggaaccattttcatttgagagaactgcaaatatgcaatgcattggtccttggaggtgtacggtgtgctcacacggcagttcagggaaaaaaaaaagaacttgatgccttgcacattgcacaagcacaaaggtcaaaggacctgtttggactttggggcttggaacggaaagtttttggtcaggatcaagctttctccttgaatttcccgatctgagcgattgttttgtactagtactacaaaaaaagtacggttcatacggactacgaactgcattcgtctgcaccgtttcacccttatcagagagtgcaaatgaagtaccccacttaacggcaatcaaatccatgtacaatcatctttcagtacaaagactgaatttcggagagcttctgtgtgtggtttactggagggacaaaactgaacagtgccaaataatcaaagataagataataacgttgcttaggacagatcccgtggttcatcatctgtttgatattttcatgggtagtttatgtggatcagttttgctcaacatcaccatgtacgttccagtgatccagtctacgtactatacagtactgcactgctgaaatacagttaaatgctttcgatgtcaaatactcctgttgaaacacgatgcctcacacgtatgctgaccacacttatcaaaatttcaaaacatatgaaattggaacctgtagcaacttgcacccgacaaaccagggtagtttttcctttttcgttcatacggtccgatttatgataagttaatttgattactagtttttttttcctactagtactatatatgttcaaaagtttttccgatatcaaaattattatttttctcgctagattggcgttgttcctactagtactatatatctgttcctatgttccctcaacctgatgcttgcgttgttgttagcagctggcacatggcgcccacacatagaaacatcgtactgcaactcctcggaaccatcaacctttcggtgcgttgttactccaaaccttaaccactagtgtaatcgatggggtgttagctcacggatcacacattttggcatccgaaaacaggagcggcaaaaataaactaatgaatggcagcatggcacatcgtcataaccaactctgatatacttatcttgtgaattgataataccctatacataaacaagatgctcagtaatcttaggaaaccaccacacacgcatgcaactgatgctttgctgcgttaatactatactagatactcttacttagatcttgccgtttctttaagggtctttaatggaaatgggagagggctttgcctatctgttattagtacttctacatactcgttctgtaccaaaataaacttaatctatgataagatatgatatattccgaaataacgaatctagataagtagttgtgcagatttgttgttttatgcatgatagattacattctaacttgatttttttataacggagagaatatgaaagaagaagtctactactctgtcctacctaatgtatagtaacttactactgaattggatattttataatattatgaatatgaacatactcttatctatctaattcatagtagtatgaaatgtcaaatctggttctaaattgttatatatttttttacgaatggagtactactaaattatgagtatcaagcaatattagttcaaccacattgtcgtttctcataattacttatcaatcatgtcttttttcccctcgtgatgttatcttatcagtcctttgcttgggcacaatgatagtatatgctcagcttggtaccggtagtaccgaaggaaggccacatgggaagaggcccatctacggtcgattttcaatcatatcgttttgatgggagcgtgcaatgcagtgagtagaatcgattttccttggaatggcaccacccctaaacccttttccggtagaatctctcgtggtgagttgaatgtagtgacactgctactgcgagttgctagaagtgatagatgttactcgctgtgggctgccccctgcctgtctcgtgcggtctagtctggtgtggtcgctgtcgtctccactagagaccactactactactcgcttgcatcacctgaacagtagggttgctggcctggcacgggcggctggggatttttttcgggacgcttcacaactgtgtgtcagtcattgtgtatcaatgtacaaatgtttgctcggcgaccagcactgccgagtgatacttacagctggttagcttcacggctaatttatagtagtagtagcagcatgtatgtacggttcgccacagtttcttagcaccgtgtctcacgtatcatggactcaaaatctgtagcctgtgacactcgtttctttgcacactttttatgacccgtcgaattttcgccatagctagacgtgaaccaaacaggcacttaactgcggcagaccgctgtttgcatctcagcatcctcagtggagtgtgttaacattggtggtttaaatggtgatgatcggtttctgccaattgttttataggaaaaatgaaaaggaactgtagcatgggctccgttttgggctgacctttgctatatccggccatctgggcctcagtccacctaataacagacccagagcacaacaaagttggagtaacctccatatataggaataagttcattataggtccctcatctcttgacgttgagtatgaaattcgtccctaaaccacaataacaggtataacaccccctctcacttttcaaaaccgatatacgcgacatcccaaggcagtatagcagttggtttcggttgacttgacaattgagttagtatgggacccatatcagggcaaccaatccaaatctaaataataaagattggtcaaccacacatgttagtgacacattctcttctccctctctacattttttctcggtggccgacgatgagactgtatggtcgtccaggtgttggaagagggcattgacattggcatcggtgagaggaggtcggcagcggcatgtgagcaggcaccgcatttaatgcatgagccatatagcgcgaacaacggcatggaggaggacattggtatcggcagagaaggacgaatgggatcctacggaggctgttgcagcctcgtgagcagtcggaccatctctggtcaacctctccacttatgcactggtaggcatcggcagaggagttagagggacgaggatcctggcagcacggccatcacgacgaggtgcgcaaccaacagcagtaatgccctatctcggatggcgctcactgtcaccacatcgtgggttgcctcatcagatcctgtcgctgccaccacaatgagaggagaggagaagagaacctatcgtaacctcgcaagtagtcgatctgcctctaagcgacctctccgcttgggcgctgtcgcccggcacggagtcggcccttctccccgccgcttgccaaattccggcccctacccctgtccacgccgcctgtggcctacatcttggcttggtgaagatggggatgagaggagaaaagagttaactgctaacgtgtaggacccatgtgagccccacgctgactcaacaaagctgaccgaagttaaagcgccacatcagatgaaaccgggagccatattgcctcgagacaaaaagttgatatggtttcgcgagttcgtggatggactatacttggtatagcggttgagagatgaattttaaacttggcgtcaagatgaggaatctaaagtgaactcattttccatatatatgcagatcatggtccatcttatgggctttcactgggctggaagcctggaaagggccatcgctcttcataggctacgacgcataaagtggcacaaccacggcccacaggcatacgagcccgtccgtgcttcttgatgatgcatgctttgtcgaagtacgtagaaacaaagaacatcggggatgccaggatatggacatcactcagttcatctcctacacattggcagattgctgcatctacaagaaaaaaaaaacgcatcaacctgccatgcagtgggtacgttacgttacgtagctgccgaagctggctgggaataaaggggaaaagggagtgagacgatgtatggttggcgtcgttgccgtggtcctcgaccggtgctcctttccaacgttggtgaatcatgatcggtcaatttgcaacgagagagtgatggaggccagtagctagccgcccacgcattcttcctcttctctctctgtgtttggaggccggccaagcggctaactagcgtcgtccaccgtagtgggtttcctccttttgaagcaaatgaacaatgatcggctccgaaaagaagagcaacttgtcaggtgtggtcgactatcacaccataagacctggcccatttgagtatgttccgggaattaagccctcaatcggcacaggcgaggagttctcatcaccgtcgcaaacacacaagtgtttgaaaccgggcaccggcaactagttgggctcgacatcaacacgagacttcgctttctctctttcttttttttccccttttcttttctgacagccactgtctgccccgagcagagcacgcatatatgatgatcatcatctaggactgtagtcttcccaagtgtacacgcccctccctttttacctttccgaacctccgacacccacgacatgttcgttagtagtactggtgctggccatgcctggcggcaaagctactactagcccccatcgtatcagtatagattcatgcacgctagtgggagcacgacgcacccagcgagccagccatcacgtaagctgataagccctttgccaaatcatatccccaccacgcaacacgggcaattcggcgcgcgtgccgagccggccgttccgatcctccgacgcgagtgggcgacgcgtcgcttgactcgcgcggcccatatccgggtggaaaagggggtccaaaaggggggagtgaattccgagttcgcggcgggttggtgcgcgccgcgccgcgcgctcctgcttgtcggcgcgcccgcctggcagcgaccgaacgaacgagcacacatgacacagcggagccggcaaagcagtacacgcgcgaggcgcggggggccacctcgcgcgcaccaggggccaggtacgctcgtccgctcgcgtcgctagtttaatcggtgggcatcaaacgctggctggaaccgtccaactgccggcgggcggggcggagtcggcagtggaattccagagcacgagcattatccactctgtccctcctctcatcgccccggtcgctctcaccgctactcccccaccacgcccccattttcacccctatctcgctcgcttattatatagcggcaccagatgaggaatcaatcaactcatgccgctgcacttgtttgtttatctttaaagctactagtatgtgtagctaggaacggatccatccatccatcgttgcattcctcgttactccaccccgtccttttgtttattgggagccacagataagatagcaacgccctccatccacctccctccccacttcgctctctcgtctccggccgcgcgcgcaagtccctgtcaactgctagccccgcctgcttcgctcacctcacccaactaacccctccctcccctcgtccggataacaaccaatgcccaccatcaacacatcatgattatgatatggccatgattgattgcagcagagcatctgcttaacaccactactaatactagagtatccatctctactgtgtctctgcgactatcacaagggcaggtagccgggcgggcggctggctggctggcccgttttggctgtaagagcatgtacaataggaggctataaaccagttataatcatatatcgagaagaaaagagaagagagagaagaaagcgggctacagatttgtagccggctgtaacacaaacttcaaaatgttatatgtgtatgagaggtgagaccgggtattaatggtgtagtatatttttatagttaactattgtatgaataagatattagattggctatagatgttttggagctagtagttggctatactattgatcttgctctaagggatctggatttggtgcacgctattcctggttagttattggacggacaagtacaattagaatatacagctcggcacgcgcatgtactgattagggcacatcgtccctgttggataaaaataaccaagccgtcccctagaggggatccaaacagatcgatcgagctgatatatactactcctcgaacacttaaaccatccacaagtaggtgtttttttcctgaacaatataatcgatccgaccaagcaataaccaacgctgccagaccaagcgaggtgttttactcctcgctttggctctctcagcttgtcttttgtgccttgcttgaacgaatacggtatcctatcctgtcatgccctggcctccccgtacgtcggcggtccagcaggaagccataaacgcgggccgcgacgtataaatgacccgtcaccgacaacatctgtgaactggaagtcgttgcgcgattcctaacagaagcagagaccgaaatcggtgcgcgcgcacccacacctacctacacggcggcaacacaacacacacgagcgcgcgcgtccaccccccgtgaaggccgtgacgtgacgtctcaaaactcggaactcgccgcggttggacggattcctcctcctcgcgctcacccaaaccctatcccgcgtctacacgtcgcgttcctagctaagccgcaccgacctccacccggaccgatccacgccgtccacatagtcgcacgcatcgcggccgtccgttccaactccgccgaccccgaccaaggtgggcggcgaggggggatggacgtatgtggcggggacgggatgacgatgcgctcaaccaaaaaaaaagtggaatggacatgacacgatgcgatgtgattagcccgagcttgcgctgctaatcttgcgggaaatctacgtcattagggtggagacgatgagtagtagtagtagtatgattgggattaggagagggaggggccggggatagtgggcgggcgttgccgtcgctggcaagcgaaaattgacgtcgcttgtccggatcagcacgagcgacacgtacgtgtgttggcatgggcgggcggatggaattagctagtgctctgtgcgctgcggtgcggtgccgtggacggggagggaaacgtccacgtcggagcgacgccacctagccgcctcctcatgtcgacatgtcggtgcctgcctgccggcgcgcgctacgctagcgagagctagccggaggagcggttgggggctggcccgaaattagtggtgctctcgctcgcgtcgcgtccaccgaacgttgtaccacccgatgccggtgcggatggatcatggatgggatggccgtttgtgtttatcccagccgcgacgcaaaagcagccgggctttgcaaccgtacggccgcaggctggaagggggggggggggggggggcgcctnattcngnatggagtaactgcgaacgtgcgcgtgtcagtttttaattgtgccggtggtgcaactactactccagtcaagagcagcatcaacaccgaaatttgtcgcgccccgtacgtacttaaccccgcgctatcggttttctgctttgtcaacgcgtgcataacctgcgaggtgaaagtacagttaatcatatattggtactgttttgtcttgtgcgagagagagctctaccctcctatatatacgatcgatgtttccaagcacaaaagggaaccggatatactacagatttgggcgaaaacaacgttgacgacgtaaaaacgaggccgaacagttcttccgcgtgtggttgcgtcccagcaccggaactgaaagcgtgcacctttttcctggtttccgcatgcatatgcgtcccggcttttcttcgcctacaccagctttaggcctttagctactagtagtacattgaaatcctaccgtaccagcgcgacacgcgcatgcaacgcgaaccatcaagccgagctgctccgttagctagagccagccatcatagataatcagattcattcgtggtacgacgttattgcccacctatctcgccctcccgctccgacatgtggtggtccaatggcttccttttcacgcgcgcgcgcgggcgcgcgcaagcgacaaagccagcgatccgagccgagcccccggcctgcgtgcactactagaaaattcaccacgaaaaaaatcgtggcatcaatactaaaattatggcaatagatatatattatcataattttaaaatcgttgctagccgtggtaataaatagtggatttttatttagtggtaataaatttaaatgttgccacggaatagatgtggcaaaaagtcatattgcaacccactccatatgtggcattagttttacgtaccaaaataaaagttcaaatattaatctaacatcctatctatttatctatttgtttttttatatcgtgtcttggctaggattcaaatccaagacctatccttcacgcgtgctctactttaccaactcacctacacatcagttctgttggaaaatgcatatcgttccatttgagcctatctaactgagatttgaatcataaatttgaatatctaaaagatttcaaatgaaaaagttatcacctataaaattgtagatctcatcaagagctataatttccatataaaatttgtctcaatctgtgtccatatgaaaaaattaagttaaattataagacgacaatttttttattgcaatgaatttgttgatcgtgacaacaaaaaatagtgaaaagtaccatgtactgtgtaaattgccacaaaaattaaaattatagcgatagaacatgtttttttgcaacaatacgattttttttagcgatatctcattttctattgcaacaaaagtactaaataaaacaacgattgtatatcgttccattaaaatataattatttgctacagaaaaattatcgttgcaatagtacaatatattgctatgaattattttttgttgtaataatttggtgataatagcttaattatctggtattggtgtcgctccccgcttcgcgcgcgccacgtacgcgtacgctggcttgcttgcatatgcacgtccctgcgcctacccacgctacgtacgcatgcaggtcggtcctaacctaatgatgcgtggggggctcatctcatttgctcctggccggcgtgagtcgcgcgtcgacaaccttgaatctgcccagcccagccgggggccacggtgtactgttgtaatagtactatctatctaatctagctagttagatttgcatgatttagacccggagttctggacagggaagccggccgccggccacacggccagctattcccgcccaattatgcatgggggcggctagctgacgattgactccacctaaaaggagccaattatcaagggacaaattagcataattaaagtgtgtatattggctttggactacaatacatactgtataacttcgctgtaaagtttctttacggagaaaatgccatacgttagtaacggcccagaaatgtcgtcgtctcaagcttttggcgcaaagacagttaacggttttactttagtgaatgttaccgattgtgcttctaattaattaatggcattgacctgtgtacgtggcttgctgtctggtgtaaacaggcagttcgatcaagtacatatatacatatacatatttctgaaatgtgtaacgaattttcgacagctagaacttgaagtgaaagtacatgcatgcatggctacacggaggctcacccaaggtcaacacgatcacaaatgtggcgacaaagtgtgtatgagggttggtggagaagagaaaaaaaaagatggatgtgacgtaattagagatagtcataattttattttattttcttcgagctgcacacaatgtacggtgatgtggttgaggatggaatttataatcaacaaaacaattaccataacaatggcatgcatgatcactaaattgattcagcttgtgcagaaaccttgtaatattttagtgccaaaacaagcagcgcgacaaaccattttagtcattaaaatcgaatagggtcatatgtatacccacatgtacataggccaaaatgacgaaataccactattagtttttccctgacttaatgttatttcatttgccagtttgcggtatatgcgattttaatcataataagttaatacggtaacatgatatatacaattccttgtggtttctacgcaactaattgctgaccctaccatatgtttattgaacctggtttcaccatgcaaagcaatatcatctctctcatatctaagatgaatggtaaacaccataagtttttgtggctagaatagaaaggcaggcgcatggtgttgtctagtccaattgtggaataacacaagttatctcaatgtgttgtgtaggtgttggtgttgtaagatatgaatgatagcaataacaccaacaattaaacgacaattagtaacaaaatttgatctcaaattacatatttgtgtcgacgggagatacccgtagaccggataaataaaatattggggtacgttggtacgaggatctacacgatatgacgataaacatataaaaaacaaggattatactagtttagacttctcgtgaggtaatagccataattcagtttatatgagattgatatggaaaaccacagagtacaaagagaacagatgaatccgacgataccggcgagatcattgttgagatcgttcgatgagatctcccggcggcttcggcttgtgtccttcggcttcgtaagctatggcgggtgtgttggcgctgtgattcgatgatcctgaactccttcgggggtgtgccttttataccatgagtttccttagtctccaagtagaactcggagacaatgaaccttgccgatatagaataatccctatcccctcctagtgggactctgttaatcgccggcccgtgaggatatttttcataatatcttgtatacttcgttattgcatacggaaatatatcgtatgaaagatggtataccaatcttgcatattcggtaaatcgtaggatagaatgtatgccttatccgtaaccttaacactttgaaactctggttattaattagttttccaattgcctaattaacatattagattagtcctggaaagaaacatattctcatcgcctcaaaatataacaatttttagggatggcatatatatgcacgagaggagttgaatttgtttttaccttatcgggatgggtgaagtagttccgaactataagagcaagtttaatagtatagccaagtattgacctcaaatcatttatagtcaatttaatagacaattcatataattgttatctataaacctataccacacaaataatatttggttccacttgtcatacacacatgtatcttggagtctgtgctgcagctgactataaatctgtagcccactgtttttctcttttcttttttatcttttgaaaatgtttttataactggcttatagtctgctattgtgtatgctctgatagttccaagggatgataggtgcagtgcaacggagttatggagctaattctgatgatgtatttaaccgatttcgtctgtaggacccagcaaaggggcactagctaatcctgcagtatcatgtgtttattgatcataatttcatcatgtgacacaccataagtcactatgactggaatggaaatggaaagcgcatggctcgttgtccaattgtgacggagcgtggggctccttaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtccaatccccctctaagtgggcaaggtcctccttttatatcttaaggggataccacatgcaccatttccctctttttttgtgtggggacttaccccccttttcataaatggacggagatttgtatagttgccgtccgagtcaccttctgatgggacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggacggggcgaggcgtgcttcaaatcgcctgtcgccacctaacccgcgatctgaccggtctgtgactggtcacagaccggataaacgagcgtgctgtactgcgatacaggcggcgtgacgcgctcgtcaaaactgcaataaatgtggttaggtgagccctgccatgctcacctaccccatatacgtggcgcaaagcccacaaggggtcggggcgcttccgccctcggggcctagacgggagcggcccgaccccttggggagacaaagagaagggcggccgtatcaccctcgggcccgaccccccccaagggagttaggccacgtgggtgatcgtgtctgcctcaagtctctaagtcatgatactcccggtaaagaggagggcgaacacatcaccctcgggcctgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacacttgggcagaaacccaacggccacaaatcacgcatatcggcaatggtaactcggctgtcaataatgagcggtctcttcaagactgccacattactcgagtagcacacgaatctggacatggcgattcgtttcgtctagagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccaggcacagcgttggcaagagtataaaggcactgaggaagggatctgtttccttcctttcgccattattccccttgtcttcgccgcttgcgccctaactccttctttcctgtgccctaccttcgccacacgtgctcgctcttaatcttctcttcctccggcgccatggcacggggctccgctctgctcgatggtagcgtgctgccgccttcccgcattgtgagcgagaggcaggctgggctggcgcgccgtttcatgccgggatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaatgcggtgatgactttggccatcttcgcgcatctgtgcgagatgttcattggggtgcgcccatctcttcggctgttccggtggttcttcaccgtacagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagcgcgcctccgacttccgagccagcccccggcgcaggcctctagctggcgggcgtcggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagactttatgaggacccaccagggagtgagatgggactgggctcctgaggacttcaagatattggtccaacgggtgctgaatctcaactccgtggaggcgtccctcattcctcaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgggagggggtcgtgcttctgggtcccgcgacacgggcccgcggagtagccgccttgcccacgccccgcggaggagcaaccacggaggaacacctcccccatctcctccccgagggggcggggcggtgcgtgccagcagcaggcgcccggagggggccgcgccgacatcgcagcccgagagggagcgcaagaagaagcggctccgcaagacgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgttgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaagccgctcgggaggaagccgcccgggcccaccaggccgaggaagccgctcgggagaaaaccggatttcgccaggacgaggcgatggcgacttccgaggcagctcgcgacgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaacgggtccgggggacatccccgagtccggcacttccatcggcggcccgagccgcgtggcctcctctccaaggcggctcttccccacgccttctatcgctccactgaacgcagagccccttctgcaggccttggccgccgcaaacaccacggtgttggatgggttaagtgcccaggtggaggccctacaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgctgcccagggggtgcttgacgctgccgctgcccgagaacagcgggcggcggagaccgaagcggcgtcccgggggcgcgaagaggcccttgaggcgcgcgccatggcgctggaagagcgcgcttgcgtcgtggagagggatctggcggaccgcgaggccgccgtcaccatccgggaagcaacgctagcggcgcacgaggctgcctgcgccgaagaagagctcgcgctccgcctccgcgaggacgcgcacaccgagcgggagcgagctctcgagggggccgaggccgcggcgcaacagctggcggacaatctgtccctccgcgaggcagcgcaggaggagcaggcgcgccgtaatctggaaggtgcccgcgccgagagggccgcactgaaccaacgggccgctgaactcgaggcgcgggcgaaggagctggacgcgagggcgcgcagcggcggggcggccgcgggcgaaagcgacttagccgcccgcctcgcagctgccgaacacaccatcgccgatctgcagggcgcgctggactcatccgccggggaagtcgaagccctccgcttggcaggcgaggttgggcccggcatgctttgggacgccgtctcccgcctagattgcgccggtcggcaagtgggcctctggagagggcggaccgtaaagtacgccgccaaccacggaggtcttacccagcgcctctcgaagatggccggggctctccaacggctccccgaggagctcgagaagacaaataagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggctcgcgttccccccaactccgacgaggagggcaatgccggtggtgcagacgacagtgacgacgaggccggcgacccgggcgcatcggattgagcccccagaccccgccattcttcagttttttcttcttttctttcttctaaggccttcgggcctcttttttgtatagatcaacttaatctgtaatcaaaaatgaagaaatttttgtatcaatttcatcttgctgtgtgtatgagatgaggatgatctgtgccgtggtccttttgtgtcttagcttgattaagggttcgtgcccaggtcccagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcatgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcggatgggagaaccgcttccgcgccgtagacgaggaagaaaggcgtttccccggtttctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtggtcaggtgaggcgaagcagagcttgatgcccatgtcttcgcagtagtcgacgaagagttcactagtgaattgggtgccattatccgtaataatacggttaggcactccaaaccgggccgtgatgcccttaatgaatttaagagcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccagtggggtctgggctcgcgaggacgcgagccgtgagagttcgtcgaccatcatgttatcccgtctgggcacgtgccgaagctctatcccgtaaaaatggcgctccatacgccgtacttggcgcacgaatgcctgcatctgcgggtcagaacaccggtactccttacagacttggttaacgaccagttgggagtcgcctaacaccaggaggcggcggatccccagtccagctgccactctgagtccggcaaggagtccctcgtactctgccatattattggttgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtgggtccgaccctcttcgctaggggccgcatccctggggcactcttcgtccaagcagcctcgcggggcgcacttgtcttccgtgctgatgacctcggggtcggaggataacaggtgcggccttcccacagtggcctcggggccttcctgggggtcgggggctcctggcgtcgtcggacaagcgggcaaagggccaactccagtcgtcaggggccttaggcctccgttcggttcgggggcctcttctccctgctttttcccgggtcgagtcagcacagggttagcctcggggtcaaagggcgataggtgcggccttcccacagtgacctcagggccttcctgggggtcgggggctcctagcaccgtctgacaagcgggcagagggccaactccggtcgtcgggggccttgggccaccgttcggcttgggggcctctcctccctgctctctcccgggccaagtctgcacaaggtggggtgcgcggaatgaggattgtcctcatcgcgctccacgaccaacgccgcactaaccacttgcggggtcgccgctaagtagagtagtaagggttcatttggctccggggcgaccagaaccgggggagagctgagataggccttcaactgagtgagggcacgctcagcttcctccgtccaagtaaacggcccggagcgtttgaggagcttaaataagggtagcgccttctcccccagcctcgatatgaaccgctctatacttgctgggggggcgcatccgctctatagctcgtatcttctcggggttggcttcgatgcctcgggcagagaccaagaacccgagaagcttgcccgcaggtacaccgaacacgcacttatcggggttcagttttatgcgggcggagcggaggctttcaaaggtttccgctagatctgagagtaacgtttcctgg

SEQ ID NO: 39462 - DNA, 3692 bp, Oryza sativa
cgtctttacaaccaagtcatcgacataagcctcaacattacgtcctaattggctacccaaagaaattcgagtagtacgccgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccattccggatggatgacctcgcggatgaatccggcctccagaagtcgcgccacctcctcgcggataaaggcttgacgttccggggcctgccgccgcactttctgccggaccggccttgcgcccggccgtacggcgagacggtgctcaatcacctccctggggaccccgggcatatccgccggtctccatgcgaagacgtcagcgtttgcccacaggaaagagacgagcgcgtcttcctatttgccgtccagaagaccactgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctccccaggaccgcattgtagggcagactgaggtccgccacatcgaagttcacccgctccgtgcggaagttggcgggtccaccgaaggtgaccgggaggtcgatgtgacctaacggccacgtgtgccccggcgtcacaccgataatcggctgggacggccggagcatcatccccggggccttgatagcgtcaaaggctgcgggggaaaggatgttgagggccgctcctccatcaatgaggacacgccccagcttcacgatgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcgtcggaatggactgacctcttcttcctcctcctgtcacgccgccctatctgagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgcccccccctgaacgcgtagattaccgcatgtgcagggatgcatggtatggtgttgcggacttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccgatcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgtcgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcgagagctcagaagatcactcgcagagccccctacctggcgcgccagatgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtccaatccccctctaagtgggcaaggtcctccttttatatcttaaggggataccacttgcaccatttccctctttttttgtgtggggacttacccccccttttcataaatggacggagatttgtatagttgccgtccgagtcaccttctgatgggacgggccacaactacctccactttcgccgggagcagatgcgacgtggaatcggggctgtctgctgacgacatgacccgtggcagaccagtcacgtcgggcattcttgtccccacgtgtcaacttaacaatctacatgttcgcccttcttca

SEQ ID NO: 39463 - DNA, 6960 bp, Oryza sativa
ccccttggggagacaaagagaagggggccgtatcaccctcgggcccgaccccccccccccccaagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaaattgcaaaataacataactaatatcttatcttttttttacggaaagaaataaattagtatctcaaacctccgtgtgttgagtagttatatatatagatactgtgatatgaatgatgacaacatcataaagaaataaacaccatgatatttgatgacagagttcgatcatactcccaccttttatagatgttagatttattctatattttgattttctttttcaaataagttaatcttatttgttgttttcatgtatttaaaatttaaataaagagacaaattaaatatttaatcagaatctgatgagttttcttaatactcattgattctatgcatgaacatactccttgatattttttacatgtaagataatataacttctcttttctcttgatgataaaagtaatatgtataactcttatagatacttatagatagaaggaagaagttccatatatacatctttgaaactctaatatcattattccaccctaattaacttagttttacattgattttaatctatattgttattaccgtttgaaatccaactataattttaatttctttcagaaacttttcaaattaaactttttttaagtatatgttaagtgaggcatcgagaaggaagtacattagtagtacatagagaggccggggactcggcgaaaggcagattcataggttgatcgatgccgcctgcagtatactgttccgaaatgctgctttttgcacgggtggttgtactccaagacggtggtcgtcgacctatacgatgtccggatgcaagttagccggtggacctaacaaattacgctgccgctcgctcagctcaggctcccctccaaacagcacagtacagtgctgccgtcgacgtcttcctcccgagctattttatcattatcgcaaccaaactctaatcataccaccccccacccacaaaatcccaatacaaataccacccatcaaatagatagcgagaaagaaaagagaagagaagaagaagccgcccaaccaacgccaaaagctactgctgcttgcacaggagagggcagagagagagagagagagagagagagaagagggcggctgcggcggcggcgcgcttcgctcatgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcagaagcaccagcggacggcgtggagcggccgcgccaagaacccggatctcaaccaggcgccaagcccggagaactccgacgccgagtagaagccaacaaaaccgcctccgcgcggcaagatcgatcaacggcttcgtcaacatgcagccagcgtatgatcacctccaccacgtacgctcgctgcatccatccacctaccacctattcgtccacccctcatctccacctcggcggcggcggcggcggcttcgtggcgagatttttcgatgcggttttggataagaacaagggaagggcagcgtcgggaggagggcggtggagacgggggaggaggacgccacaagtggcggtctttccaaatgtcaaaaaagacagctgtaacagtgataaaacaagtcatcctctctgtttttttttcctctctctcttctccgtgttattatcgactagataagcagcgattaattaatccgtccttccccctttaattcttctttggttgcgtcgtcgcacacacagtacagggagtatatacaatttgccaagcttgatccagttgctcatctgcctcaccccttaatccagttgtctgttggtgagcaaaccccggccggcgcgcgttaggttaggcagccagccacccacatcgttaatcactctcacagttaagcatctgcctgtaatgcgtgtgtgtgaacgtgcaaaaacgcaatcatgcatgggatcagtggacggcgtagtggtggtgagccatgtcttttggctaatctaatcaccaattatgagcttaccacattaccactagtactatcatgggggaggtagcaatcaggtcggtgtccaatggcaggagcccgtagtacaactaactcggcaggagtgtccgccttcctgcctgtgcctgccattgaaagtatgcgtcgcgtactcgcgttgcatatttgcatggggatcgatggttgttagcctggccggccaccacattggaaaaacgtcgtcgtgattggtcatgattgcagtggcgtgtactacgttttctcatattttgcatgagcttcaagtactcctacaaccgaccttctattgcgaaacaatggctgttcgtgccggaaatcgaatggattgattcggactcggcgtggcaggttatgaatcctctgggctgcatcatatcaacgatgggtgaacaagaacaacccatgtagtatgtacttacgccgcggcagtaaattttgctggaccatcagcacatgatggtagtaatgcaaaacacgggctagctgcagacgcatgcagaggcgacagcagtgcaattttttttcgtacgtacagacagtgcgtgccggccgcccccacccctccactgttctacctccccaattgttgtggaactaacttttgcatcaaactcgtcctctctcgcccgttaattccctcaaaactcgattaaattttcgaatggacaaaacactgttttctccttaagagagtactacattttgttactatttgtaccacaatctgacccttttccagcgatccattcatcaattgtcatcaactagctctccaggatgttgttactgttctttgagatttgttgtagccagactcagccagaccgaagctcgcctgtactacaaaggccaaagggaggggcctcggcggtgtagtttgcgattgctgaaagggaaggcgacgttgcctgccgactcgctaccttttctggcctttttgggcgccctaccgatcggacccaacaagccacccacgaaaccagcacgccatgacacatccgcttgtgtgctgctcctcccacgaaaaaagggccccccgtttgggggcgcgcacccgaccagccgcaccccaaatcatctggctgcatccgcatcgtctgtagccgatcacacggctcccacggctcccccctcccctccaaactgggcccgtttcgatcgatcaacctctgccaaccgcagcccagcctcgaatcaacaaggcccataacacgttgtaatgagcgcgcgaaaaactttcttgtgaaagtacaggagtcggaggaaggaatccgtatctaacgatgattgtgtccgtgttgtgcttgtgcacaaatcgtgatggggcatggaatcgagttctaacgtgtccggccgctgctagcgtccaattcgctgagcttgacggcgaatctaaacatgcagttccaaatcagggccctatctagctagctactactactagtagcattagcagcaagtgagggctagcacaaagcagtcgagtcgcgagcagtagatgagtggagcggagacgataccctgccggtgggaataccagctacagcgaccggtggccgcgccgcgacgtgcgtgtttttttgccgctttctgtggcgtcgcgcgcgtgccaccaacaccaagtcaccaacccctgcgtttgccggtcgcgatgccgcggcggggacgtcggcgtgtgggcggatgagagggaaaaggctccaaaagaggccgggggggagtttggccggcgacggcgacgtcggcaattgcgtgccggcttttcgcgccgcgggcgtctgtggccgacaagaaacagatacaaggtgcaacgaacaaaaacgcattggatcgatcaggcagagaggaaacatgaattactgcaaaacagtagtaccaggttggttggcacatggtagtagcatgcgtagcagataaggcaggattaacagggcacagacagtgaaaaaaatattgagccatcatccaatataccagccataaatattcagttgaatgcagagcgacagattccagggattatttactgcaggagggggcagtttgcagggaccagttcttttacctttttttttaatcaaatttgtaggtcaatggcaaaaaaaatttctaatcaaaaaacggcacggtaatatgaatcactaaacgatcttgcgatcgaacaagcacacagtgtttactgccctgtgctttttctaagacttcagagcagtatttttgcatatgggacaggtgttcttcacaaccagccattgcctgacgcatccaacatggaagtcatgtccacagtccagtgtcccgagatcatccccatcaacatactcttcctggataaacagcgagaacgaacatagttagaagacatcaatatgaattattagtttgcagaattgccaaaacttttcattgatttaagaagacaatgaagaaaaaggaagatattgagcaaagacaattcctcaagtgtatcccaaggtaagatatttgcttgggtaggtcagtatatgcagcactaggaatcttgaacaaaatcatattcaactttcagctacaagttttaaaagttgagcattgttgtccaactggtagtggttcacaggcctgaccgacttaattgataattacagctacattattgatagatgagtgtttttcaagttaaaatggacatactcacaggcttatgtcacctattaggtatggcgtacaattaacaaagctaaatgcacaaagcactgaacctgctagatttcaagttaactaaacaaaggaaactatgtcacaagcttctgataggcctgagttatacctggcagatacagcatggctcttcttccacagatgcttccaacctccatgatgagaatttcctttgctttaggagctttgtcacttcttcctcactgaggccagtgctaacattgcctattctttcttccagtgccaatagctcctggaagacaacagcaattatcagagttttgctggagaaagatccagataatattgtgctaaggaaaaccaacctcataagacatgttgtctatgtcaaggcgcatatccctgtgtctgtcatgaatgtcgactccaccatagaaaatggactgtagcaagaacagatatacgtggaagcaagagtaaatacctcaagaaataagcaaagattttagaaaacaaaaaagggttcagtgcaagttgttgcctatttgtttctctctgttgaaatgatgactatatttttctgaattatagatatactatggtctttcatgcattcactatatactatttccatattacaagaaacttctgttttcagaaacaaaacaacaccttatgcgatctctcttttataaaatggattagaatccagcctctacatccaaactgaatggacagagcaaaccttatgtaatcctagcatcaactagtattagtcagccagtcttgctgtgagtttttaggacataatatagtttcatcaatctctacaagtccgtgcagataaaaataggcaactgtaggtaactccgaaaccacagttgttactgacctcaaatcttacattttcccctctgtgaatcatttcaagcgcgttccggatctggtgacaagcaaaaaggtaagaaacatattgtcttgcatagacttcatggttacacaagtaaataaatgaacgacgcatccaacatggatggctcactagttattgcctgtccaagccacatagttctagagaataacatgcggctagaaacaaaacgtagcatgcataaggtaaacggtccattgaattttataactattaatccactgtgtcatttaaaaccaaaacaagatatgtgctctctctctctctctctctctctctctctgttgagttaataaaattaagtgtcactactaggtacaagatgatggtgcgtaagggggggggggaatttagcaactgccgtaacattttcagattggtgagaaactaaagtttatctttccaccgcagaattaggtggatggctgcagacatgcgaagaagcatgtgagatcaaaggggaaatgagatttagaagatcgtcagaatattattcctaatgatgcttctgtatgtccactaaacggatgtaaacataacattattctgatttctgacctagttcagaaacaaggcaggcaagagaagggaaaaaaa

SEQ ID NO: 39464 - DNA, 18684 bp, Oryza sativa
aattttcaccagatagatcattaccattgatgttaaggcctatatcaacattatccaaagaaaggttgcgctcagctaccaagcgcctttcaccaatccttaggccaccaccgatattacgttgctcagctttgatctcattagagcccccaaaatgtagtgaactgccacttgcacttgcttcgcctgattcccaaaaacctaaaaaagtgccattttgatgcacaccgtttccatagggaatagttccatcactacggttcacctgataaccttgaaggttatgtgactccactgaaccaagaatgttgttccaatatccttgttgatccatgacagggtttcctgaactggatgcatggtcaaatccaaacacatcagcaagctgctcaacagagttcttctgtccttgcattactgaagatgtgctctttatcaattgatgtctggcaatagcatctcaggtgctgttcatctctttcaacaattgaagcaagtggtctgcaaatgtaagaaagattgtaagatattagaattttgggtaaaaaatatgttcttagcattgcccgtacagaagaagcaaacaaacagtctcaaattgaaggaatgttgaatgctacggttcatcacacgctaggttctgctgaatttcagtcattatgttactgaacaacgcaagtctaatcctattgttatatactatctttaactaattaacatctatagaaatgtgaacagacaaatcttttgttcatgactcggctatcagaaagttattctttttgataaaagggttactatccagaagcaggaagactagtttgggttttacagaatagcaattcattctgtcattgatgagagcattaactaattttactgtagcaatcttggcatgaaccgcatttggtgaggtatatggatgcaccaaacttgatggtttgggctgttgtaagcaaaggttgtgctgatgcatgcaatttaatgagtgtgagacacggtgattgtacattgcatgcgacctaaacagatggactgcatgcaagatgggccccattgcctctgtggacaatccaaaaaatatactactactactctcattttatttgcatttaattcccttccttttcggtttgcaaaaaaaaaagaagttttaagtaaaaaagacaaacggaaagaaaaggtagaagcggcgatccacggtttcaagggacaggttgattttctcgtgacgaaattgaaaggcaaccaacacagggaggaatttaaccaaccaagaacaccaagtcatctctgtttctcaccgtaacaccaagcaaagagaaacgtaccgtttacaaagtttgaagaaatgtgtttatgaaaaagaaaaacacgaatttttcacggtttaatagcatttgacacattccggactgtagaaaacatctcgtgggatgaaccacgaaagaatcaacacaagaaaggacatgtattgcaaaggaaccatagatttccaaccaaagagtatggcaggccaccatgcagaatcaaaagaacaagagaaattaaacaaaaacatagacacagagagatgcagcaaaccgtaccagcaacaggtgcagagattttccaaacagcagctctcaagaaccacacgagccaaaccaaagaacagacttttctcgatttcccttctcctctcctctcctccctcccttcgtttcttgatcctctccaaggcagagagaggaagaaagaaagagagagagagggagagaaagaacgaagaatcagcacaacaaccggaggaaacgaccgattgctagaagagaggaggagagaaagatggtgcggaggaggcgaccgaattcagagagatcggcagggtgggtggagaagggaatgggtggaggaaattttgtcaaggaggagagagcgagaggaaggaggaggagaaggagaaagacagggagagaaggaggtggggtggtggtggtgatgagaggatgtaagaggaggaagagagagaagtttggctgaatttggatttatttatttctccatctcatctctccctctctctctcttcctgtgggtcttggttggaaggatccctttcttcctcccccactaaaacccagcctttaaatgctccccaattcacacagagaattaacatctcctttaacaagggccaaacaaagattagtagagagcagagagccactgttgtgttgtctttcacatgacctccctccccccatccacttttggatttttgcagcactctttctctgcatgctcatcctctccattgaatagtgtattatcctgctctcttttttttttcttccttggttgagcatccttgcattgattatttctaggtgtaatccaagtgtcatgcctgcttattgaaatggctgcgttgtttgtcacttcatgagtaattgtgaaagggagctgttcactgtccagataagttaccagaggtacaactgtaggagtactattaaattgtgagctggttcttttaggagcactaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatccagcaacttgtatcaattaaatgctttgcttagtcttggaaacgtcaaagtgaaaccctccactgtggggattgtttcataaaagatttcatttgagagaagatggtataatattttgggtagccgtgcaatgacaatagccattgtgactggcctaattgtgttactgtcattgaaagacagccggtttctcttcaaaaacattatcttttgcctaagtttatgctaaaccaagaggcttttccttgcaaggaagccattgattgtggtgtggtgttttcaatattctctctatcatgttggctgacacgcatatattcggatgggaacgcttaaaaacgagggttcacatgaattttgccatatagtttgttcctcctgtgcatcaaagaccacctttctttttgctgcatttccgcttctttccagctcaaacgaaataaaaacgtataattaacacctccggaaaatctgcaaacgttcttccaagcacctcaatccaacacgtgttgagccgagagaaatcacatggttattaatcccccaattaaatcctctttgatttttttttgcattcacaatacaactaattatcacaaaatcgcctaaaattcatttgaaaatttttgccgtcacgaacctcacgtagccacaacatgcacgtctcggggcccaccgtgccaccatcatgtagatggagtgaagtcaaaagccgatacgtgtcctaagcggtgcacggcatgcatgcgccattccagcttacgtccatgcacaaatcatcatctgaaattatcaacaagagaaaaaaaatttctctgcacgaacaactccccttttcaccggcacttacctagaagaacaccacacaaatgttttttttcccatactaataattacgagcttgaaattttacattcggtcaactgattggaccagctgcacgcagagaaagatgaggctaattatcagtggctgtttcagaggcgattttttttctctccatgagaacaaattatttgtgtcatttgtgtgtttgtgtggccttttttataggtcgttgcgggtgcttggaatgctttgccgctttactgatggagctcgtgctatgtggagtacttggcaggagaatatacggctggaatgcgcttggcccggctagctatgccattttgctttactttccctcttcttcctccatctcagtttggattggattctctgatctttagcaaccctctttaccatggttgctttgggctaaattgcgtaaagaacctcggctgcagactacctcctcattgggttcagataaaaaaaaagtgggcgaatttccatccgggtcatcaaaagccaaagcacattttaaaaaagcatatcgtttgggggagttaaagttattacagagtgtatctaatgagaccgaggagcgggcggaacgggttagaggtgcgaatgcgacaggaatcgttcgcagtactgtgttagaaatacgcataatcctgttcttttgtatcctaggatttgcatttcattttttcgttcttgcatatacatgaccgtatgtcgcagcgcagtggtaaacccagaaaaaaattattggggttcaatacatattaattatctaattattagttaatatataattaatgtgttacaaattattaaaattaaataatttacccaaggtctgacttggaaaacaaaacactacaaattcccatgccgcagcgtgggtgttgtgttgtggtcatgtttgtgcctagagagagtctttatagcaattctaaaagcaagtttaatagtatagccaactattagctctaatttatctatagccaatctaatagcttatttatacaatagttacatactacactattagtacctggacccacctgtcatacacacactgtgtattggagtccgtgctacagctggctacaaatctgtagctcgcttcccttctctctcctcatttatatccttaaaatatgtttgtagctggtttatagcctgctattgtacctgctctaatagtacatcccactattagctctaatttatctatagccaatgtaatagccaattcatacaatagttgattactatactattaatatatggtctcacctatcatacacatagtgtgttttgaagtccgtgctgcagctagctgtagatctgtagccgctgctcttatctcttatcgtttatctcattaaaatatgtttatagttgactaatagcctggtattgtaactgctcttactcttactcttagtagtatagcatgtgaattgcttcaacatatgggatgtcaatttcacgtggtcgattgaagctagagctagttagttgaggggattctcggacttggttgacacactgcacctataatagtcgttgatgatatgtgggattgggtccacctgttaatcactatcaccgcaagggcagcactacaggtaatccaccatgtgcaaatgtacgtgtttcttaaattaaagctacatattttttaaaaaagttatttataaattttaattaaaatactaatgaaaatgattccatttgattaatattagcaaaattatccatgcgatctatattgtatatatcattactgtcaaaattttcaaattaatatatttcaaaaaataattaatagtaggtactatcttttttatcattgttcgaaacttttggaattcagaattaatacaagttgtactagattggagtctcaattataactattcatcattttaaattgaaaattttggagcaaacaattattatgttatagttatttcttctttagtcagtaatattataattatatctgactgctagatttattcacaaagtgtaattgatatgaactcttatttcaacatgtggagtccaatacacttttccaatggcgtgcttattttacaccaattcttgatatgaaccagatcatgctgatatgatcgatctaatcaataaacggattgtttttacatagtgcagttagagcaggtttaataaggtagattgagccggcgatatgagctacacgtcagattggatgatgacatggacgagagaaaggtggaaagagggtgcgagcggatggtaaattagtcgctagcgcacacgagctcctaggcgcctgtgcattgctttttgtcagtgttgcagcggagtgagagagggaagggtaaagaagaaagagattgaggtgattaaaaaattaataaagatattacttgtttaacgtgtcaacggcttactattgtactctctagctataagatgacatggtacacatttatagcctgtagccggcgatactattaaacctgctcttagggctcctttggaacacggaatgtgaaaaacgtgtgaatactgaataggaaaaaaaacaagatcggaatgttaagtatgtgcagattaggcaggagttcaaaacacgagagttttaggcatactatgtttggatggttaaaagaatataaccaaagaacttttatagaattaaaagagagataaagagaggaagtgcatttgccttctcaacgtaaaaacaatgaggttagagctcacggtaatatcttctatgaaatcggtgcataggatagcaattcactcaaatcctctgctccgaagaacacatatagaaaaaaagtatccaaatataatcctttaaaattccttttattttcgactgcgtgaattttacattataaatgacaaattcttttcaaaattgttgcttaaataatattgtcaaagtattcttttttagaagccaattagtgctactttttgtcgctctcttaatttatttttagccttggaccttttcaaatatggaggcatgtctctgtaattgttttttctatttgtcttctcaatggtgaagattgggaggaaaaaacaaactgtaaaggcgcatgccaacctcctagtactagtagcttaaacagctgtgaatgacaacggaaatagtttcttgaaagcaaaggatcacaaggcaagcacaaccagaggcatctgcatagattattctcacaagttcaattgtcactaggccggcataacaaacaaatgaaaagccgatatttggagagagttttcattgacccgtccaagcatctactagcatgtttaccggtcagccaaccagccaactaaccctgataaaaacatgcagacaaattatcacaaaacactactagctaggactatgagaaaaatgccatgtgacagccaggaaagaaagcacggttgctactgccatttcctaacggagacgtaaagaaggtgattagtcgtagtaggcgagagagcactctgatcttgatagctaggcagcaaatgtaaagttggcgccattgaaaggcaagcaaagcatacatgataaacattgtagaccagctcaatatactttttgtgcttttcagtttactagtcacagccgtttttaattgattagggttaactctagtactacatggcttcacacgatatttttggcttctttgttttgttcgaaagcatctttctaatggccatcattgcaaggttttgtttgcgttttctctctctttttctccatggctctctggtcatggacatggacgctgcttaaaagctggcaagcgcctaccatggacagcaaaaggtaggggccattttggtctctcttcaatctctggactgttaaagcctttgactaccgggcgttttaatgccctgtaaggtcgccgctgcaacaagattcgtacactacgctcctcaattcaagccgtatgatctgtgcctccgtacatggtagatcaagatgatatcttttttttcctttgacgttttgaccatctgtactagtttcatggatcggtcggtatatatgtgagtgaaatgggtttcatttggaatacatgtatggtccatggttgatcgatgatcaggtcaactgtacaattactgctgctgtaagctcagggaatccaagaccaaacctatggaggaaaggaaagaaaacaaccgtagcatacaaaagcaaagggaaactcagaaagggacccattttttatttgccattctgtgtgacctgaagtcaatcagctttatcaccacacctagcagcatccatcacttgtttgctcaagtagcagcagtcaatgcgtgcacacacatcagacggatcagcagtatatacatatttatttataaagaaaaaaacgatgagaaaactactccaactatctcctgcaaacggtgcttcttcaaagtgcctttattcccaggccacaatgctagtgctctcctggaagaaagaaaaaaacggccgagtcataagcatcaacagcagcactgctccttggaccatcgccaaccaaattgactagtaggatttctgggttccgatctctcatccacgcacagtgcgcgcacgatccatccatccatccaccggtgccggatgatgatgatgatggagcctgcgaatttgccgtggtttcctgctgatttctctctcttttccggcgcaaaaacgtcggacgcatcagctatagccatcgcgatggactcgtggggaatagaccggttttttctacgcctcggtggtggcatcggaaaccgcgattcgttggtgcaaagcagcatcataatttccggtgttgtctttgctgtgtcaaagcaggcatgtgctcgcgctcttgcaggcgagcgggcggctcgagctgctgatgctgctgcctgccgggcctggatgctgtgccgcgccgcgccgcgcctgtcccaacgcgggcgaagggctgcctggttacttcacgtcatgggctaatgggtaataaaattttaattgggaaccggcgttttcactgtacgtacttacgggctcatgtcccccgatgctgctgcctgttttcttctgtcctctgctctgctcccgtgtgctaacttaggctgtgtcggcaaatgtggttggaaactaatctctgtatattatgattaattaaatattggcttaaaaatttataaaataaattaatataatttttaaagtaactttagtatataattttttttagaaaacatatcatttaacccttcgagaaaattatgcgcgaaaaactataagttgaaaaattagtaccaaactttggttactgtgaacactttgccacttcccatttttagctgacacattttgctaaacgtgtatttggtttatattatgacctgttacacatttttaatagatgtcccctatatcatatatttaattttaccccattttatgattaacaatttattcgtcacacttttataaatgccacagcttacttaattttggttgtggctttgtgggtgataactaaacacgtgattaatgtagacccccgaaaatgggtggtacttgcagcacggaacaggcgaagacagtgggggtgggattaatgggggtgctttggtacaaggcgtgcaccaaatctggctataaattacgtcacgagacttggtgcgccgcagatatcaccgcaatcatgccccgcgtttacgcctcctctcccccgcattcatcaaggcgctacgcaagttgcagcctctcctctcctctcactcgtgatcgcgctccgtcgtcgcgttggcgcacagcgtccgccccgccatccgtccaaccatcgtgcgggcggggacgcgatcgcgctgcgtttctcacgttcttttgcctcccgcgtcgcgcgcgcctcgcgaaatcgctcgcaccgctcggctttgcggtggaacaccgaagcagcagccagcagcggcgttttccccgtttttctctactactcctaggttggttgcaacgcggggacacgggcacacggcggtacgtactacgtagccgctgggagaggtaggataccacggcaattgatttgattcagactactactactactactagtggggaattgattacaaactgagtaatccagcgagctggaccatgtgaccaatcgactgggatctcgtcatcttaaacaaaatcttggggctggccgtgacggccccccctctccttgtcagcgggcgtgcgtgacagacaccgtgacatgctgggacgggcaccgcacgcatcggtgccatgacgttacgtcgccaacccaacagcagatgtttgttaattcatcttttgcattccatttcacctgtcatttagccggcagcgacccaactgaccccggcgacggccgtgacaatgaccaggaggaggagaggggacaccctggaaaactggcaccatatgccacaaatttcaaacctgtggacgtttgaaagaacatgtccataaatttgaaagctggtgtgtgcgatggcatttatcacagtcaaaacagcaatatatacaagtgccccctaccctttaacccagtggttgtatgcctctatcggagccagatagcatgggctcatgtaactttctccttcttttcttctgacaaatgcatggcaatgcggggctctctctcctctcgtcttctcctggtgaaagcaaaggcacatggacatgttaaagcctaagggccgtatagcctatagctgccacacaaatcttttaaaaccacgtaagcgaatactcgattgtatcggagtaggtatacggtcatacaactagtagcaaagcatgtgaaggtactactactagttgtgtgcgtgagtgactagtgtgacctgctgcctctgttgcccaagcatgatatggctacagggtcatgtgaaggtagtggccatgccttggggattcctttctttgggacgatgacttctcatcatcaagaatcacagatgagatgtggctatgtgccaaggattgcctgtaaagaatgttcaccggtcactaccatctaggcgtctacctgtgcatgatgccgtatccatgtgaatatattcaattctcgtaggatttgtttatcccctttagcttttacttttgccttgttgtgacatgcaaactatgtatgttcaaataagatgactttagctgtgttgttattcgcagaggcagggaagacaaaagcagaccaaactcgtatgatataatgtttttttaccgtggtatactaataaattgtgggtttactgcttttgaaggaaccttgagcacacagccagccaatcaagaaccaacaagcacccaacaagtaaagaaattgatatgggtgaagctaccttactataattaaggatggaccatgtctatcacaagctagagtgcttggataatgtaaacttctccccttgtgaaattgcatcatgacctcatcatagcaagcaaagaacgggtgtggctggggccccattttttgttggtccaccaaagggttgcctaagatactcgaattaataaaaaaaacacttgtcattgcgcttaagaaacataaaaccagcggtttcaacaatgccatgaatcttgcaaatgctgcatgtgatgataagtgggtttccgacaatcgcgtacaatctgcctatgggcatccttttgtgcatgttgaaacacagcgtcactgcccaaggcacatgtcggcttcaaatgcaaggcaccggcagcctaaagattaatataaccatctctatgaagagattagattgtatcctttctcactaggcaaaatgatgaaacgggtgaatcatcaggcttcatttggcattggcaatgtgctgatggggaagatcgtttgggttgcaacaggaccaggatttcatgaacagtcttgtgattcccacgcatcaattccatcctatcttctccattttttaagcgtttcttctgaagaattatccctctttcggctgaggtggtacgtttgcttgcacggtatagatccttgggtacattgcagaatcacgcctctgtggaaattcaggacagggcaatctgatcgactgcaacaaattctgcagaatagagtgaaacagctaccaactactaccatagatgaaatcgccaaaaagcatattctgaacgaaagttactggaaatctagctacctgtagttgtactctgatcaagatcggtagccacaagcagttgattaatgcgagtaatcgtacagtgcacggctgcgccttaaggtaccatacattacactgccgacacgcacaaatgcagtgccgttcaatatgttttttaggttccagtaccaacctatttacttgaacctttctcaatagtcacgaactttacaaaagttgcaaaattgctgggacctatcgtgttgctatcacacagaatagggtatcacagcctatcatccagatatctagcagaagttgtgtcatgtcttcagtttacgataatttcatttttatcgatgggtagagagcacattaaagtgccagccataacaagtaatggcttcagcaccaagaacatcacattaactaccttgaagcttcatctaaacaatatggacaaaagggccataaatacaaaatcgacctttcatgatttaggacgatgtgagcatggaaggctaagctaagctccacgcctatcaacttccacttctgccgctccattttgtgccatgagaattgtgtacacttttttagagcatgctggtccgagccttctcttaaaatcacccagaggaccttccaacctcaagtcttcaagcaaatgttctttttcatgaacctgtcaaagaacctgtcaagaaaaccgaaaagccaatgcctagcttttagtcttatttagaacctgtcaaaagggcagcactcacagatttactgtcatccatatacacattcagtagtgatctcatggacgggtacttcttctcaattgcaatagcttgtcctggactgactccgggaatagcaactaaagacttcagcctgttacagatgatttgaagaattagcatagtgacactctacaaatcattaactgtcaagaaaccaagaacactatattcgaatgcatagttgggagctagaactgtcaaaagtatgggggaccaaaattatcaagttgtcacaattaaaataggtagcacatagtcagaacatctctactataaaatcagaaaaaattaaaggccacacaatccgaaaatccaaaagtccatgcatggtctccatccacgggtccacagaagcatcacttaaccaccatgctaaaccgttaatgtaaatatagcttgcaaaccaacatcaaccaagcttggctgatatccgatgttggctgaatagatgatgtcatctacaaagaaaagaagtgccacaaaatatttatagacaaggttggattacaaacactgtcagttctgatttgaacaattcgatttgattgtaccaaagtaccaaaggaaagaattagatcaaatactaaatgtatctgaggtacctagacaggctaggctagatttcatagaggatcatcagtttagcaacaaccaaatagaaatattcagaaatgctggttcagaacttgaatcaacaccatactttgcaaactgcaagtaaaccttgtacacaagatgaaaactgtgaaatgtgcttcttctaatcatctaatgtactgtatatagagaaaggaacattatttcaattagtggacacaaaaaggcaaagcatacagcaacaaatggaaatttggttcagtatacagttctaagcacaacttaccaggcacttttcttaatccgatctttatcaacgcaacctttagaaatatttgaaccattagcatgcacagataaccatgtcaatggtttcctgcagaacagtcagcaggggacagtatcaaaacatggacttggttgttcattgagtgaaacaacaaaaatatttctgcaccaaatgtgcgtgaaaggcacaatattggccagaagaatgtgttaagtatttatattgtcaaacgtaacttgcctgaacttgcaattcgcaagactatatgtcaagccaacaatatgctctgtcacttcagcttcatctgtgcagtgccttgagcgcactctagcatagtgtgtcgctaatttgcataaggcctaaaagaatatgagacatttcaggatacagtagtagttcagaacagaaattgatagcgttgcaaacagacctcttccactggtggacgcttccaactattagaatttgatgtggtcttgttgtactgattctgctcactggcatgaaaagaaggtgattttagcaggacgataggcaaacacaaacaatacctcacataactatgttttccttccaaaccttgagagtcatgcatatttctccagtcttgtgcgtatgtgtttgtcatggtgtgaacagtgcaacatattacatattacttcctctgtttcacattataagacattttggattttgaatagattcatgcatggatccatgtatgtgcttcatatgtgtccaagttcatatatacattagtgaatctagatgatggattgagatgccaagacgtcttataatgtgaaacggagcgagtacaatgctttttctcagaaatgctgcttttcattagccataaagtaccagcagtccaaaactatgtgatcgtatagttcaagcaaaaatagactaatgacaattaagaaacattagcacacaaaactaatgttgactgccactgaacttacatgcactaagaaaaaccaacatgatttgaacacaaaatcagaatttaaagcagagttcagaccaaaagaacagtaaatataagataatccatacttccaggaactaaccgtctttttatgaagctcatcagtttattagtaacgtagcaaattgtgaattctggatactgtcttcgaactttctgaacatgatccagtaatgtaccaccacttacaagatcgcagaattcctcagcttgaagcacaaagagaatatatggcacttgtgatgttgaagcttggtcctgcacaaatgtatggcactttaggatatttttcctgtgtcgccagtatttacacagagaaaacaagaagataccagtcaaatgcgcagtcttccgtgactttttgtggaactgtatatatacatcaaataggagattttttttatctagatttatcggctggcaccccataaaaatggtttaatttcttcaaagcaaaacatgaaagcagcaaagggtgatgaattctataagagaaccttctacctgactacccattctttgatcaactctaactttctgtctagaatttatggttgataccacatcactgtgaatgcattttgcaaccattcatgttttgcaaccattcatgctcatctacagtaaaacgattttggtgttgatacttctgaaatttaaccctttcaattttcccataagctaacagaattataaatttactatgatgtgtaattgttcattctgagagtggcagatcgcctctgtatggtataatggtaatattctttgcacatactcagccaatttagcaaaatggacaaagtatcaagtttgactgaatgtgttagcagccattggcttgggaaaacactccacatctaactaggtacaacgaaaccactgattgaacatgattgattaactatcatgtgaataaaagtatcttctttaggagttgggcctgaggaagcagcattggctgttcaattacacaggcagctctctttaaaaacacccggaacgcatttgtgcgttggttataaggatgaaaccaaccgtttaagtagaaatatatcatttttttttcttttactttggaggcgcaagttttaccaacgtacgcatgccagaataaggttgaggccaacaaaacatttgaagaaccaataaagggatgcaatttctaatggaaaaaggtaaacaaaggaaacaagttatcctgtaagcggtacctgggtaaactcattaggaatttgcatcttccataaaattgaccccttgattgaattagatgttactcgaaaacaaaggcccttctcatgaaatccttgcacaagatgacctgtttggaaatccgagcagtggagaaaggtgagacaatgaacaaacattactagtattaattaacttacttttgtttaacacacctccaactgagccactttcaataacacttgagtcaatctcagcaacaatacattttgtagctaacttccctgattcccacttctttttttctttctccagcttcttcaattctgctagttcagctttcatagcttccttttgctttttggtttcctagaaataaacaatatgctctgttaatctctagatcatggcatgaataaataaatacacttctgttagatttcaaaccagtcgtttttgttttttttcttcgatttctctggctttcttttccttctttagtctcttctcttcctatatcatgcaagaacaagaatttcaaagctaaacctataatttgtgaaacttgaaacaagaagattttctttatgccacacctgttgtttcttcttcctttcttcaatcggtagggcattttcttccttcaaaaacaagacatctccttttttgttagtatacatatacagctattaaggtgtaacttttgtcttttggattgatcaatatctttgttgtataatcttaagtctcagctatttccactcacataacaattaattacacctaaaactacaatatgatctccaacagcgtaatcgtaatttaacatgcctaacggcatactaggtcatacattcttctgattcagtcaaatatcatttccatgacatttctgcctagaaaatataaaaatatgcttcaacgtttataacagatcaaattacaaaccacttaggttaacatacctgcggacaatggttattgataaaaggatcagcctccttcaaggtagaatcttcacaaggagaattagcacgagggggttgattgtagctggttgttcctaacaaaagcatacatagtcaatacactaaacaataatgtgttatctacattgtttacaaccagatatatactaaaaggattttacaacacatatgagtgtcaaatattttatttttactgtcctcactttaggtttttcttaccattatttttgcatgcagaattgtttgtttgatatccaacatttgattttgaataatccttcttatctgtactttttgtattctcaactttatcagtacaggaagtagtacaaggctgaattgcgtgttctggcttcgccatattgcttggcgtcctggttaaagactccctgtatacagtgtcatccaattcgtcatcactatccagagatattggacaagatactcctgtaaaatagaaagaaagagagttactccacataagaaccataataaatattaaacatgctgtcatctactaatcaatgtgatcgctcagttgcctcccacataagaaagcagggtggagataaatcttaacccaaaaaaaaagttacaagtggacatgctgtgtcgtcaacaaagcaatagttagtggagtttttttttaagaaaaaaaatctctgcctcctcctcttgataaaaatctgtgcactttctaaactttgacaggtgtcatttgggtccaacatgtaacttaaggtttaaggacccttcatatatcaagtagagtaaagaaacaaatgatgctcgaaagaatagtcagatacactttgtttattggtaattccaaactactattaaggacagattaatcatcgaaatgtttgcaatcattaggatttaggtctgattccacctgatgttaaaaccaaaatgacccaacaaatcgattcagaatgttgcaaacaagttttctcaaaactgtatagaaacccctgccataaatcaccaagaatagctatattgataaatgataaaggccaagaaaaagaacacagaaatgagctacaagctccaacgctccatgactagaactggacctaatccttgtctattttgccacacggcaaattcaatggatgaagccaaatgagcttaacctaggccggtagaattcatgaaaactcgaaaggaatgcatctaatagttaagaaacttcaccagaaaatttcctcgcggtcataggagacgtcaagccaggcacggccgggggacgagccaagcgtggggagttgaagcccggggtctcaggaacaatgtcgtcaagcccgacggagcacgggacatccgagccaggggtcgcggaatcgggagcgtcgaggtggaacgacgggctcgggagaacagaatcgggcgtatcaccagcaatggcgcggttgcggagcgagcacggcacgaacgaccggggcgtatctgccaccacggaggcggaccggtcggcagctaccggcggcggccgccgcttcggaggggtgggggtgtcgtcgagcacgatggttgacgccgcgagctgccgccgcttcgggtctggaggggaaggggagaaggcgtcgggggaatcgggggcggcggcggcgaccgcatgggagcgcttgtggagggcgggaggggtggaggcggcggcgacgtcgtcgtcgtcgtcgtcgtcgtcgtcgatgatctcgacgacggcggcgtgggacgccatcggtttggtggggcttcgccggtggatttggggatttcttcgccgagatggcgattttgattttgggttttggcgggttagggttccggcgaatggtggtcggctcggctggtcagcctcatggtccgcttcacagatatcgatgtggtgctcgggccatctgcgggggaatttactatttgccactctctcaaatgccagtgctcaaataccactcccccaaattttcattcccaaatgccatccgggcccacatgtcgagtctcactctccattcaaacgaaaggggtgcag

SEQ ID NO: 39465 - DNA, 1661 bp, Oryza sativa
cctctctctctctttatctcatcgctacacaaacaatcttgagcaaacctcgatgatgtaagatgacaccagtggatcacccttgcgccgtcctcgaactgcaccatgacgtgtagagttcctccttgttcctccttcctcgagtactcctcgctgcttatacacacatctagattcctccttcctcaagtactccgtagtgctagtgtcattggctccgttagcacgaacatctcctcgtcctcacgtcgcacctcccatcctcgttatggcaaggtgcgggactcgaaggctccttctgagtgggaggaagagagacggaacaagcaacagctcccctcttttgtagcttccatcctaagactcacgagtcgttgcagagtcgagagagctcactagcaaccttacaccactaggcggcaaacagaaaaggaacataggggaaaaaaagagtgggtgctgacatagaggccctacaattttaaatttttcccattcggttacatttggatcccactctctatttttatttcccttggtgatttggctgccatatagacgtcatgttagccaaaacaccctcaaaaccagtcgagtgagtcattttgcatgattttaatagagtaattaaatacctaagttttacaattgaaggacacgtatcacatccaacctaaaaatagttgaggaactcaaattgtactattttttgagggtttttatataccagtatctcgttcaaaaatgggatgatactgggttggtatcaggtcctaatatctaaccagtatcatgcgattcttaccacatggtgggtgatgcttgcgatgtatcaggtcctgatacctagccagtatcggtgatacctaccaggtatcatacgattctaccacgtatcaggtgatacttgtgaggtattagataataactattaggtattatgcgattcttacaacatagaagatgatacctatcaggtatcatccgattcttaccacgtagaagatgattctaccacactctacagccagacatgaccaagttaacaagctctttgcacccatctttgtctctttgctcctccgaagcagcatatggatagaatgaaggtccggactcgggatcgacggccggcgatgaaggcggcgactgtagagggcccgtgacggagggggcgttggtggagggcgcaccagctgaccacgcgggtggagcagggggtgggcattaacggcggcgccgtcgatggcgagcggcggtgttggagctccaggcggcaattcggcgaccatgtcgccggcgacggagttggggcgccagcggaggacgcaccagccggccatgcggatggagccgtaggtgggcgttaacagcggtgccgtggatggcgcgtggcggtgctggagcaccaggcggcaatccggtgaccacgtcgccggcggccgcgccctcctcttgccgagcgggtcttcttccccagcccgcgccggaatcgccgacggccacctcctcctcacggctcaggcgctgaccttgttcctctttggatgggaaaggtggacgaggggtatcccgtccagacggcataccggtatatagcatttatgtattttcttagccgtgtctttctgcgtacaaggcagagacgaaagggctgcagg

SEQ ID NO: 39466 - DNA, 20123 bp, Oryza sativa
tctttcttcgtacaaggcagtaacgaaaaagggttgggccgtccatctcaatctggaccgtgtatttctaatctaacggttaacaagtatccaacgggtgcaccgcggccggaaggggcccctcttttcccctgtcggcggcgccggccgcctctcgccggaccgccggcctcctccgtccgtccacgggagacagaaaactggccgcgcgcacctgttccaactgggaatcacaacaattcacagctcatcgtgccgtgcgcctgggtgggttgtccaggacaacttgccctctctctatctccctctctcgcgcgtccgggaaattggcgcgtgacgccatggccatgagtcaaccccgccattgccggacacatgtgagaggagaggagaggagtacgcgacgctgtcgttacccaccaacgagcagaggcaggtactccacggcatcgagaaccagcacgcgtcgcaccgtttctcaactttgcgcgagcacagtgcctgcactgcactgacagggcgagcgagcgaacgagcaaaccaagcagaggagagaaagcgccaagccatgcaggcgcaggcgcgcacaggcacagcgcaaggacgcaggaggaggaacagcatgggagcaggcgccgcggggggaagctaagctagcgaccaaaactcaagctgccaaagccccaaaggcattgcacgttcactcgttcggccaggcttttttcatacgggtaaaataattacacgccacggcttttcagagcctcccaacgatgcggcaatggtcttcttcgcccccctccttttggagaacccgagatatgcattggcactcttcttcctcaagatccctctttttctgttgcgatcaaaaaattgtgttaattaggaaccgattgacagcgtgctttttgtggtttatatgtagtacaattcttcaggcaatagaaccttgttttgcaaagttaatgcagacttgtctgaggtctgaggacaatctctgaaactgaaacagcctcaatctgatcacttgacttgacccctctcctgtatcggtcttctgaaaaaggtagtactaagtttgaacgatgaaaaactgcaaatgcttatattattcatggcgtaagtgcgtggctaagacaaatgatttacgctcgatcatttctgtttgcaccacaaaaatattttttgagtaacactttcgatgattctatccatcaacatgacaaaccaaatgagcaaatgaggcaaacaaagttagttattgttagagaaaacctgctagattaaaccaacaaaacccagcaaatcgaaggaccggacatatcaaagagagaaaatcaatgaattcaatcgagctctagctaacaagcactgcactactgctaaatcaatactccatatggatactacaagtaatcctccaatctgtcacttgggtgaccaggaagagaagaagtgagcggtgagattggacgacgacgaggaggcccggttggtgtcggtgaccgtccccgaccacgccgtcagcgacggccggccatcggtgaagcccagagacggccggccgtcgatgaaacccatcgatggcgggggacacgccacgacgcccaatggcggcagcttcctcatcacggacaatggcggcgagaactcgccaccctcttcttccacctcctccgtgatcccaaatggcgacggcgaggcgtcgggcgtctcgaatggcgtgtccgtgtccccacgaacgtcggccgggggcgcggcgccccgctcgtacaccgggttggagatgcacacgaagcggtcgctgttggcggaggagctggaggacggcgacgagcgccgggccggcgaccacctccacacggcggactccagcttggggatggcgaggaggaggtccttggtgtccgccgccgcctgcatgacgccggcgcgtagtagaacggcggggtgctcgacagcgcctcgcgcgcggtggtggtggtcgccgtcgtcgccaccgacgccgcgtcgtcgtcgcccgcggcggcgcgcgacgtccccgccagcccgagcttcgcgcgccgccgggacaacgcctccccctcctccgcgcgcatccagcgcctgcggaggtgggagcagaagaggtcggcgaggaggagcaccgcgatggtgaggaacagcgcgaggctgagcgccagcatgaggctcacccccaccgccaacctcgacatgccgtcggtgaacattgccgcctcgccccgcgcgccgcgcctcgccgagctcaacgagagtgagaggactggagtggagagccgcgccgtggcgagcgcgtgcgcgagctaacaaagcaacaggtggcgcgcggttcgtgtcgcgtcaaaagggcaactactacgactcgcttggaccagagcaaggttaactcaactaacctctaacgcatttcagccataccaattttttaacaaagctgtcaaaattttggctacatttagttgttgtcaaattttagtaattacatataaaatcttgataaattttgttaaccttgtcaaaattttggtaactttactaaaatttggtaatgtcaaaacttggtaaggttgaaaatggtaacaaattgaaccaaccctaagcttcaattcatcttgcttggaagtagcttatacatataatagttacctataaacatatattacaccattaatatatggctttatctctcgtacgcacaaatttatagcccgcttcccttctctcttcttttctcttgtctatatgtgtttacagtttacttatagcatagtattatactcgctctaatcattttcttatctaatctaatccaccgtttgtctcgtcacgttttccgaggcaggttagtacttccaaaagctagtgggctagtgcaattagccgggggcagattatggtggagccgtgactgttgtctgcttaaacccaagcgtactcacgctttggccaaccattttcactgtcgagtgggtcccagccatgtggggcagggttgtcagtggtgattagggggatgatgtcaagtgtaactgtgtagcaaaagggagcaaaagcattgctctgttgctgatcattggaggcagggaaaggactatggaggagacgatgtgtgttttttggcgggaagtcgacgatctgcttacgagtgcgaatccaaagattcgggggtttctgatctaaccgcacgaccggttgcttgttcatcattttgaggtgatcagtcagagtcaggcgatgatgtttgagtagtttgacgaatctcctccgtgcagtgtagtagagcacttatctccgatgaccctacggcatgattggcgtttggcgaagtcgtagctccactttcacgggaacggtatcgggcttcatgattggcatttggatctaaggctaactttgccatgaacttaatttgcgatgagtatgaaaagacaacgactatgaaaaattttggctagaaaataaaagtataacatgtaatcaattcctaataaagtgggattcagtttaaatgtggctctcaatcaaacactagcttaagaaattataacgtgtccaagatttagtgtggtaatatttggtcatcaaccaaatagcctcaatatttattccaacattcatatgttgttcaacattttcatgtaactagttaaggaccacacatgttgcaatggaaatccaaaatttacacatagctatgagtagggcatgtccagttaacttatacttcttccgtttcataatgtaagtcattctagcatttcccacatttatattgatgtatatatatatctagattcattaacattaatataaatgtggaaaatgctagaatgatttatattgtgaaacggagggagtacatagaaatcgtttttgcttatgttgcaagcaagtcactctaaccaggttggttaagtaagattgtgatggtccgttttcacttttttagtcatctacaatttgatgtttcatggagcgttttttatacggtgataggtcgtcgttgcaagtagtgatggttttcatgtgggagaaaggttggctttttacaggatgtctttttatccttagtgagttgtttttaggtgtttttatgtgaggcgggttacctgttgcatggacgcagtgcagatgttttcttttaaaaatagtacagaaaataaaaaatgataggtagcacactgttagacatttgatcattcacattttgaactaggtcttaaaaatggctgaaattgcaccggaagacgaaaaaaaaatcaatcattaattcaccaaaagaaaaaaaagagaaaaataattattaccaaagaaaaaaagaggaaaaaaaatcaacagcgttactacagtatacagtctacagactaaaactacaaaaagaagagcaacggcccaaaaagcccaggaagcaaacatgttcagccttctgatccagtccgtcgacttcaccgacgacgcggccgcggccgcggccaccgccgtcgccgccggcgaaaccagcggcacctctcaccccctctccccgcgctccggcgaccctctccccaccaccacctccgcctccgtaacggcgcctctcgagctgcccggcgcgacctccgcctcgcccgcccgaaaccctaagatcaactacacccgcggcatcctacacctctaccgctcctcctcctcctcctcgtcgaccgcctcctacgcttccgccgtcgccgccactccatcctcctcctcctccggacccgccgccccgcagctcgcctccgactgcctactcccggtaacctctcttccttggtaccatcttatttactaatttgttcatttccgcgtgttctcatgcctcatcggctgcgtatctcagccatggcgcggcacacggctcctggtgctcgcggtcccaacccacgtctcaccagacgacttcgtccgcttctgcggcccttacatcgagcacgcctccgatatccatgtcgtcaggtgaattatccttctcgttgaagcaatttgtgtccgactttgcccgggaagctatggttttacatatgtgttgtgtcggtagggatgatggggtggaggaccggtatagcgtgctcgtggagtttgaggatcagaagagtgccgatgggttctacttggacctcaacggttggaggttctcgtcatccgaggttactaacattgtcgattggatgtatgtctagtttgctgatcatgtgtaacattgctcctaaattgggaagctcgctcgcttcttgttccatggtgtaggtagaggtttgccatgttctgtttatagttgctgtccaatatacaccatcaaccaagcctgcggtgactccaccagttggatccactgagctcccaacatgtcctgtctgtattggtgagcttatttatatttttctccttgttttgtggtcattcaacaatgtcagatatgaattttgtccactacaattttgcttcgtatcacctccccataggctgggaagatatcaatttgcaatgccccctctgatcaaaagattagccacttctcttctgagaaactacacctgtgaagttgagacttgagaagctacatactcaccacatgtttgtggtgtcttaggggctgtttggttgagtgccaacatttgccaaagttgtggcacccaagtttgaccaattaagcctagtgtttggttcatgccacaagtgagttatgccacaattttttagcaagttggctcacttgtcactgagttatttttttgccataacttgccacaattgtggccaacaaattcttagccatacaatgtgtggcatgccacactttgccaaatattttgtggtaaactatggaagtcatccacactttgccaaatatttcaccatatatatgttaaccttatttttggaggtatacattgcctatcgatttcggtactgttttttttctttctttctaaaagctgactttggggtgctatttttccaagctactactataccagtaagctctgtcaaatctagggaccatgttatttctccttgggcaatatggattacataattatagttaagacctttgttttcaggtctatctattaacttatgttgtttaactatctttgtgcaagtatgcataggtacacacttcctctgtttattgggaagagtttttctgaacattttaatgtatcattttttttctcatcttttcaccatcttcttatgcatgttatgaaacagaaagattggatcaagacatcagcggaattatggcaacgacttgtgatcattcgttccagtgttcatgtgtttcaatgtgggtcaattcatcttgtccggtaatgatcattttgacaatcaccatttctcaattagggcaacaaacaaccatttgttatggctgtgattcttttcctgcttacatttttacatgatactgaatttgcctcaattttatataaatttatgagtcaatccattctatgccattgacaaagcgtgggttctacaatatgccaccgacaaggctcagttctacaatataccattgaacaacttgttttcttccttatctgccattagtcaaccattagtcagatgcagctaagggaggaaaaatgaccaatgccatgttgcattaaataatcttggaagataaaaacacaatggattcctatttttcatcaatgagaaaaaatagtggatcatgaccaacgaaatccatgagcacacatgataccctaggggtaaaatggatatattctcgcccttagagcaggtacaatagcagactataagccagctataaacaatagcagtgcggactctaagacgtaatgtgtgtatgacaggtggggatcaggtattaatagtgtagtaagcaactattgtatgaattaactattacattggctatagatgatttggagctagtagttggctatactattaaacttgctcttaacatagtttgactaatggttgactagcggctatggcatataaggaagaaaactaattgctcgatggtatataatagaactgagctttgtgacatatcgcagaatctgtgctttgtcaatggcatagaaatatagaatggattatctctaaatttatattcttccaattttgaatttttgagtaatcttctatggcactgattaacgtagtagttcgaattccataccaatacccaatatgtggccatttatcaagtgtgatcgaattccataacaatatccaataaaatatgtggtcatttatcaagtatgatattgtacatttgctactcagtaggaactaaccagggacagaggtcagggtcatttgcagaatgttcaccttctgtatttttcttgaagatcactgaatgtttatggcacctgtttacccgtgtcggtgaatcttaagacatattgcgctaaccagatttatggagcgtagagttgtagatgtgccaatgtctgcctatggctataatacaaatatattattgccaccactcaccactataaccatatgccattgatttccttgtattaagatcctccactgccttttcacattaccaagctttcttgatcatgacttgtttttattcataatatttctgtttcaggtttgccagttttgtcagaagcagtctaagaatcctacatgttctgtttgtcaaacctctggaaacctatggatctgtataatatgtggttttgttggatgtgggaggtatgctactctgctaattgaatttttggagcattttgcgaatctctttgtatttaataatctgaaggaaagaaagttaatggcatgattactgtttgtgaatttctttgttattacaggtatgaagaaggccatgcaattaggcactggaaagaaactcagcactgctattcacttgatttggaaactcaacgtgtttgggattatgttggtgacagttacgtccaccgacttaatcactccaaaagtgatgtgaagcattccaagttcaagtcaaagtgtaaatattctggtgacaaatgtgcaaactgctcctgcaatgatgaggaagatatcggtggtgctattttcagcagcaaagcagaaacagtaattgctttaagattcattcatttcagttaatctttgacacctcattgccagtctggttcctcaaatcacatatgcttttctcataacagattgtggatgaatacaaccgtcttcttgctagccaacttgaaactcagagagaggttcatcccttattagtgcttatcttttgatgtcacaatctgtactaccagagcttgtcatataatttacattacagtttatatctgatatatttatctgcctatgtttccttatattcatagtattatgaggctcggctgtcagaagctaagaaagaaaaggaacaacacatttctgatgcagtggataaagctgtaaatgataagagtaaagaaatccaacaaaagattgagaatgcaatgttggagaaaaagaaacttgcagatgtgagcatctcaaatcatgcacctttcagttattatcaagcatagttgctgtggttctttgacatgacttggtactttgcctttcctgcagatgaatgaaaaactcacgaagaaccaggatatatggcgtcgaacactaaaagaaattgaggaaaggtatgtttgacccttccaccagaaaatggaagtagatggcacagcgaaaggtgttggatcgtgctaatttgtgtgtgttggttgctctttttttttcctttcctttttttttttggggggggggggggtatatctttttcatgtactactttgtaaagaatctgcttgagccttgtccttttctgttaggcaaaaattggttatgtagcacccaaaattctggtttttagatttctagttttgcgttcctatcataaagatacacaactttccctttttctttcctgataaatctacacttctacactcaacagggagagggctcaactgaagttgaaagatgatacaattcgtgatctagaagaacaggtgctaaactctctttcctcttgaaaacactggagcttgtacaaaggccattagttaacatgccttatacaatttctgcagataaaagatttcaaattttccatcaagttacagaaatcgatcgagaagaataaaaatgctgatgatctcaaaggaggtttgctggtgccactcccaatggtgccagattctggaaccaaaggtaaaagatcgtcaagaacaagcaagaggaggaaccagtagctgcatctgttgtacatgtaacaagcaattgcttggctaatctgtgccaaccaggataatatgatacattctgaaaaaaagagagagtgcaatattattctactacagatagctgccttttatggaacagaaaattgaaccaaaggatagcatagtttacaattttacattacatacaggggtagatgtttcagaaagctcttggctatattattgctcatacagtactacttttctgggtggactacattttgagtattgcagatcggccgtatgaatggcaaaatgagaatgcaacggtggcacagaacgccaacacgaacgaggcagcactgacaatgtagaggactggatcgtcgtatctctcctccacatcttcctttggcacatgaccactaggagagcaccagcttccctgtgatgtattatagaggttgttgttgcctacataactttccatgctgaacgaggccagctgaccatagttcggtatgcatcctgataagttgttgtatgccacggagaacgctcccagcgacgataactgagttaactgccaaggtatcggtccactcagatcattgtgagacagatccaggctttcaatctccttcataccagaaaatgttgctgggatttggccagtgaagaaattgtaggacagattgagggacttgatatggctgagatttcctagctgccaaggaatctctccatcaaacatgtttgcagataggtcgatgccggtcatcaaatcaaacaaattgacaccgtatatatacagactccctttagtagagaaggcgaagcctgataggtaatagtagtaagtactcatcaggtgagaatcgtacagctcgataaacggttcgacataaaagatctgcaggatatcatgatcatgcacatctccaaagaggatgttaccaatacatgctggtaccgagcccgataatttgttgtgtgagaagtcaattatcctcaagtattgaaggttacatatgtctggagagatttccccttcaaaatcatttccacccaaggaaagtatgtcaattcccaaattattctgtacccaattcaagttgcctgtgaatcgattatgtctgatatccataactataagctcggatgtattgaaaagggcatatgggatatctcctgacaaagagttgttagagaggttaaggaaattaacctgcagtgccatactacaatttggtaaagaccctgttaagttgttatttgatagatccaaaaggctaatgcttgtccagttgcataaatagggttgtatttcaccggttaaagtattgtcagcaagattcaggcccactaacataggcaaatcccaaaaagaaatatcaagtttcccggacagcttgttatcatgtaaatccatgacgaataagttcttagctgatagattttgaggtatgctcccctcgtatttgttgctatctaggtacaaatacgacaaagaatcggacatattatccattccaccaaatattagtccaccaagcttgttttttgaaaccttcaaggattccaacacagcatggtcagtgaataagcaagctggtacttctccagaaatgctgttattcgataggtctaaataccgcagctgacgtatctgacacaattctatcggtatatgcccgtaaatttcgttatttgaaaaatcaagaacaagcaagtttggaaatatcgaattgatattgtctggaagttgacctgcaacacggttcattgatacgttgatatatttgagaaaattttgagtataccatgttgactccaatgatccagttaacgagttatttccaagatctagcttataatgtcttgctccctcggtgaacaaccaatcgtgcatgctccctggcaagttattattggacaaatcaagtacctccagatgatgttgtgtgcgtagaaaatgtggttctgtaataatgctcttgtcaaggtcacagccagagagcgctagttctttcagttggaactgaggtacccatccaggaatatttacatcaacagctaaattagcattatctgacaggactaccgcctcaagtttcgtgaggttcttcagccaagagaaagaaaatttgccgctcaaattattatgagaaaatcgtaggctcttgataaacgcaggaaggtttgaagatgaacttataggaataggcccttctaagagatttcctgataggtccaatagttcaatatgtggaagtgagaataatgaccttggaatattcccagcgaatcgattgaggctcaaatgcaattctcgtaggttcccaagattttctattgctgcaaaaaaacatatgcatcaataagcagctccatggacaatcttacctaacattatttgcacttaagataatcagcaagtgctcatttttctgtaccttgttcagttggaagagttccattcatgttgttgttattgagatttaacacttcaagtgagactgggaatgaagatgaattaatgggaatgccaccctcaaaaaaattcccactgagatctaagaccttaaggtgaggaagtgaaaataatgacgctgggaggcctccatggaatttattgaaactccaatccattttactcaaattcagtgctctcaagtttctaagattctcgaaagctgtaaagcatgaactttcaaataccagcacatacaaggaatgttaattctttacttagcactaagagaggtaaaaaagaaattatgtacctgaagccgggagagtcccattcatggcggtgttgcagagattaacaacttctagcaaaactggttccggaggaacaggaaaccctcccttgatgaagtcatttccacagagatctaatactttaaggtgaggaagtgaaaacaatgactttgggatgctaccttcaaacttattcgagctcagattcagttcttgcaagtttgtaagattttcgaaagctgcaaagtataacagttgtttttttcaacgatcaattttatcatcgaggaggtacttagtgaaatctttagcttaacataaggaggtacaaaatacactaaaaacgtggtgcttctcggtacattctcaagaatggtaaaaaaatctctactatgagaagcaaaagatcatttatatacctgcaaccggaagagtccgttcatgttgttagagttgaaatcaatgacttctagataaaccaaattcccaatagatgacgggaaattccctccgaaccagttaccaccaaagtagagaaaccgaagcttggtgagtcctagtaatcctgtggattgagggaacagttcacgttagagagacacgatgaaagccaaaatccagcacgcatagactgatgctaattacttattaccatcaaaactcggtgaaatcagtttattctgtgataaatctaggaactgaaggtcgcgaaatgcagaaaaaactgtgatgtttaattcccaggagaaaaagtcatctgcaatcgacatgctggaaaggttgagctgatatactctccgtttgctactgtcacatcttacacgctcccacgagcagcagtcctcagtctgtccccatgaacggggcaccaacgtagagtttgcttgtatcagagaagccctaatatccatcagggcggccctttcctccacaaggcagccgcatgacatgtaaatcatgggctgcaatacacttagtatcataaccagtgacctccatggcaaccgccagctcatctcggaagaatgatctgccttcgccgcaagcttcaggtttgagacattgtaatcttctatgcactagtacaccactacgctggattgctatttgctggtagatgattgccctggtaaaccttttataatctcagatagccgtggagattacgatgcaaactgtccaaatcgattagttgaagattgatgacttgggcgacttaagcaactgcaaatctttatggaaaaagctgtgttgtttctccctctagatagcctcatagccatatgttgacagcaactcacgttgactttgacttctagagctctacttaacacctacaatgattaatatgatagtgaaggtaattgatagggacaagagtgtattagtacaattgtacaaaggtgagctatggtaatttgagtagcctgaaaactacgggctagttcagattgatgtcatttgaaaccatatcattttttagcagagttgtcaaatatgtgcatcaatttagtttcttgtcaaactttgataaatacataagaaatcctattaaaattttagcaatattaccaaattgctaaaaatttggtaaggtttatttttgctacaatttaagcaacccctactggatcaggcttggatgcatgcttcctcgctatacatttgaaggaaagcttgaccacctgcccgctgattcggtcgactgctgagcccattcgtcaagtccgcaagtcctgcacattgatgggtttaccgtgtgtctcaagtcatgacgtcctgaactggtaaacaggccgacagattcatcgtctccgctaggaataagtccacttgtcatctctcaactttacatcgaatttgatagctgtccgtaaaccacaataccaaaaatcttctcccccatctttacaaaaccatatacatcgggtctggtagtataggctcatatttctgcttacataacaagttgaccgggcccacctggccacctcgctaagtcaccaatgaccggacccattgttaacgccaaaatttagtaagcttcaaagttgtcatcggtctagagacaatatcagcttcagagtcccggaatggaccaatagaaattgtcagtcgacaacagttagattcttgatggattgggcaaggaaattcatatttaaatgaagtctatccagaagagatcgacttcaagtaggatatgacaatgtcaatttatttattaattatatagaattagttagtttctttttttatttttaggaaaatgtttttagtgtacgatcaagacttgcatatatttttttctctttaggaaagtttgagtagtgtccaattagaactctgatcggcctatgggtataaatatgtacactcgggatccctataatctatcttcacagaacaatatacatatattttcggcgcatctcatgaggttttatttcgacgagttcttgttttcgcgcatgggctgcatcgattgagttcgaccttcggcaagaagtgagttccatcatcttcgcttgcgctggcgtagctaggactttctcggttgggtccgatatactaattgggtcgacgcaagggttgcctatccggtatatcatttctatctttatttccattactgtttataatcacatcggcttagttaggacttcctcggtcatgtttgattatcataatactatctcgtgctgcatcggttacggttaggtccgacctactagattgttattaataatctaaatcttgttaagccgataggttcatactaatattttatcggagggttagccgatcttatctgttgtgttaattttctctttgatggttttattgtcttggttaatttaatgcatgaccagtttgatcggtgtcatatcagtttgcttaaggaaaaagtacgaattaccccccgaactatcgcggtcgtccgaattacccccctaaaccacaaaactggacattcttcaccctcaactatgcaaaccggacgaattaccccctcgacccaatccagggctgttttggtctacgtggcgtacgcgtggcagtccagtcagcactctatcaaaaaaatatttgtgggacccacatgtcatacacttcttcccctttttccccctctctctctgctccactctctctctctctctcttggcatgacatgacagcagcggacggcacagtaaggcgaccgaggggagccgacgactctagcggctggggcggaggagcgtggcagcagcggaggagcgcggaggagttcgggctcgccggagtgtggaggtacccgaagccggcgtcgcaggagatgtgccccgggtggacgcgccgcggtggtgcgcgtgcctcgggtacctacacccgaaacctgcgtcgcggcatggaggaaccgggcggagtatgctgggttggtgcggcggaacaccatggacgacgcggcgatggccgattcgtgtgtcgcctagccggccgccggcaccggcagatgaggatgaggtggaggcgatggccggctcatgcgtcggctagccggccgccggcaccggaggaggaggaggctaaggccaactcgtccgtcgcctagccggctgcctgcaccggaggaggaggattttggcactggccgttgtgccgccaagccgccaccgtcggcttgctgcccgtcacccaccatgcatccccgcacgccgccgcccccgcccgtccgcccccacgcgccgccgcacacctcccgtccccacgccccgcctcctggtggtgcgcgagggcgacggcgcccgctgcccgcagtgtatttccggccgccggccactggatgccaccggcctctcccccacgcccgtcgcgcccctgccgcacctagcgccggccaccaactcgccgccggacgccgcccgcctctccaccacgcccgcggcgcccccgccgcgcctagcgctggccaccaactcgccgctggacgtcgcccgcctctccaccatgcccgccgcgcctagcgtcggccacatctgagacatagagattgagaggaagaggggaagagagagagatattgagaggaaagtggggaagagagagaggtgggagagtatgacaggcgggtcccaccattttttaaaattaagaaacgctgactaggatgccacgtgtacgccacgtagaccaaaaccaccgcggattgggccgaggggggtaattcgtccagtttgcatagttggggtgaagaatgtccaattttgtggttcatgggggttaattcggacgcccgcgatagttcgggggggggggggggtaattcgtacgttttcctttgcttaaatctatcagacaattatcaaccttatgctgcatcggttgggttcgacctatgggtttatggttgtaaattagatttatttaagtaagtaggcatcaattattcttgcattgaggtttcagctgttgtgttgtctggatattgtttaagtgttgcattagcttataaggattatatataagttggttttagcttatgtagcaaatattttattgattaccagtcatttagatttaatgacatcagattttcagccgatatatactttaaccattagatcaatatttattctatcatactgttaatggtcgattggtttatattgttatgttattataatttttttatagggtcaaagtcctttgaaattcctcttgtttttcttttgttcgaaaaacccttaaacaggccgaattattcatcagctttgctgctaaaacagtaagtttaagggtttaagcttactgctaaaacctggacgctgttcttaagattaggccttctccatctgaccttgccgcgccgcgcccgagttggccgtcgattcagattaacctgggcttggcccagtttgcaaggcgatctgatgtgatacgtcttctcccctctccgcggctctccgctctctccttgctccgttgctctcgccaccacaaccaccatgggtccatggctacagccaaagctagaatttttttgagaattaatattatttttatggaaaatcgcaaaagtagtggtcaaccggggaaaatcgtgaaaataggtccctgtcgaacgggtgcagttcgatagggcgcctatcgaacggccagagcgcgactggcgacgacatcggaaggctgccgttcgacaggacctgtcgaacagcccccgttcgacaggcagggctgtcgaacagcccccgttcgacaggctgggccgcagttcgacaggatgtccgtcgaactgccgcagttcgacagggtcgcgttctccatttatttgtaataagttatttttttaataatatgtaatttattttagtgtgtaagaaaggaaaaatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgattaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagggggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtccccgttggcatgtaagggaagtgtgccgacccagatgctccctgcgaggggtgaacataaggcggagtttggaatacctgcggacgtggtggtgccgtactcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagttccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcgactgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggataagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcac

SEQ ID NO: 39467 - DNA, 1528 bp, Oryza sativa
tttataaggacttgtactcttagaaccggtaataaagcatttttaggctgtgttcgttacttatgtaggggagcaaatccctctcgcacggaaaacagagcggtttattagcacgtgatttattaagtattagctattttttttaaaaaatggataatatgattttcttaagcaacttcgtatagaaactttttttttaaaaaaacataccgtttattagtttgaaaaacgtgcgcgcggaatacgagagagaggggttgggaacatggagcaaagtactggtttttaatctagctgaaatatttttgtttttggtaccacaaagaaagatcagttctccagtagtgattacacacactgtaacagggaaaaatatataaatatgataaactaaaattagaattatttgggggaaaaattattttcactctggatccactcgtctcagttctttacctcgttaagagaaagaaaactcaaatgattgagaaaatataatagctcgtaatagttaattttgaagaaatcgtgacatagagcggtgtaggctcggtatgaacaccagcgactacttgttgacattgctgtcaagtgtcaacttatttattatttcttatttttgaaaccgagcctgcaattgctggtgcatggcctcgtcgagaacctatgggagcattttctccttcacgcgcacgacgttatctgctcaaggatgacatgcggcgattttgatggttttgcccaagactaacagacacataaacacatctagtaaagataaacataaacacaaaacacacttgtatagaaggaactctgctaactcagctcaactcaaattctcattcatatttacaaagcctgacatatatataggttagttgcagctagtgcatcatgtaattaattaggaccagtactataatatcccatatattgcctctaaaaatgtcacattagattgagtgacgaggtggagaaaagaagtgaggagagagatgatgagccacccctaaatcaagattcaagaggcaacctagctccacacaaattttaagaaatgtgtgaaaatattagagatatttgtatttgtatactaggggtgatacattgtatgggttgtctcttagttcatgagtaaataaaatagataaatttggagatggtagttacatctaacatagcacttgcccttagagcaagtttaatagtatagcccattattgcctccaattcatctatagccaatctaatagccaattcatacaatagttgcttactatactattaatatatggtcccacttgtcatacacacattgcgccttgaagtccgtgctacagctggctaagatctgtagcacgctgctattctctctcatctcttatctcatgaaaatatgtttgcagctaggtaataatctgctattgtacctgctatagcaggctataagccagctataaccacgtattgagaagaaaagagaagagagagaagaaagcagctataaccacgtatcgagaagaaa

SEQ ID NO: 39468 - DNA, 9288 bp, Oryza sativa
ccacgtaagcccgtcaacccggttagaggtcatttggacctaaatgagtcacttaaataagatcagggaccctaatgttgattttttttcaagatcatggatctaagtgacacctcactccaactttaaggaccggctgtgtattttactcttttgactatattggttcggttgaagttttacttacaagtgtttgctcaatatttgtaagtatcaaccatcatatcattctctctcttttaatatggtatttttatttctccaaagtattgatacaaagtcccgtagcaacgcgtggggtttcaactagttagtatgggcacatttatagtaatctctagcacgaatcataagacagatcaaatggtatgaagaattctttttttgaaaaaaaaaattctgccgacacaatatagccactccaagatatttaactatttgccacttataaatgggggcaaataactattgctattagacccacatgtcatagacacatgtgggtccacatgtcattgagataggggtggcaaataattaaatgccaaatctacaagtggcaaatagtcaattccagggtttcctgacccggtgacctagtcgtgagttcgcccgccgccgccgccatcccccatccatcccgcgagcgggcatgggcgccgtcgttcgtcctgctgcttccgcggcatcctggtgggcacatcctctgcctccaccgccgtctgcgccgatccccatccatcccgcgagcgagcaggggcgctgttgttcgtcctgctgcttccgccgcatcctggtgagcacatcctcggccgccgccgccgcctgcgccgatccccatccatcccgcgagcgagcagggacgccgtcgttcgccctgctgctgcttccgccgcatcctggtgagcacatcctctttcccatctctctgtacccgcgcactttttgtcgaatttgcgttaaccctagcttctgccttaaccttaatactaataacagtttggttgttcccaaaaagtttaggggttcccatgttagatccgcccctgatagacatagacatactttggtttgcagcgtatctacaagtatgcaaatatgtgcctggagcacaaccctgaggaatatagaactaatatgaattatcgcagatcaccgatttgaaaatcgccgctgatggaagggatgctgccatctgatcctccgggcagtgatgatgatggaaatggaacgaacatgtggacaggacagaaggacaagctggccctagacccttgtgtttccggtgacaccaatgagaatgcacatgcctgcacctcattgacagctgtgcatcaggttcttgaagaatctaccaacaatactgtgcatgctatggacatgggcgtagttacaaggcaagatgatccgctgaaagcctcagaagaagatatcaatcaacacaaagatgaacaagagctttggggcccaaacgtgcaaactagccaggacgactactttgattacgtcaagcagttgtctcccaacagtcgtcgcatagacaaatggtccttgctgagtcatgacgaaatgattgaggttaaggagcggcatgcacgctatcgcatcagattttgcaaggtttaatgcttttttgttagctaattccatcctctgtttaatttgtgttaatatttttttctactttctatttccagatgctaaacaaagaatttgaggatacgatgaaggatccagcagagtactctcgaggcgaactgttgaaggagaattactttttgcgatatgagcgggatgaaactcttggttggtacttccatcctgtccacacctggcttgcaggcttgaatgactaccagaagctcgtcctcgtaaatcatgtaagtgcttgccatgtatgcaaatttacaaatctgattggatttaataaaaattcttgtaagtaactagagttcattgttcatagctgtgcgcaccgtagcacccacaaactggctgtatggctgcttaaatagtaagatagttcttgggtctgaattgtgcacgaaaacatttagctaatctacatatattattttggattgaagtacttcaagtactccaaatgtgaacaatttaatgccttccccaccgcgttttacttgatctttgcactgaaacagcaacccagtgctgagtgctcttaaagaaaatgatgggaagcgtacaaccatagtacaataaatcctggacagatgagtgacagaaacatgtatttcagtctgttaacgttttggatttgaagtctgctagttacctgaatacctggtgcctaataaagatcagcggagtattccttgctgaaattaagcaagaagaattaacaaatcttcaactctctccctccctctctttctctctctcgtgcgcgtatgctcgtccagattctacccatcatacatctcctttctccgccatgcaccctatcctcaaagcacagtttttctttctagctgccatctttagcctcttctgtggtgtttacgattatgtgctaagggacttaactaatgccttactgttggaaagctggtctgattcaaatcaactaaatatgttttagattaaacatgttcatttttcatttagggcctgcttgggagttacagacttttttttctcccttgtaaagaaagacccctgtaactttcggttaccaaaaataccggtgaaaatcaaaaccctcatgctggctgtttgggagaaaacaatggcaaagcctatgatttgaataacaatttcatatctgaacatcaatttgagagtcgggaccaaaaactggggaaactgacaggtaaaatcagatcaaataatcaaaacaagttccccatcatcaaaattggtccaacaattgtgattcaacaacagatctaaaatataattttttaacaacaacatcagaatggcagtcaacataagaacatcagtatgtcacctggacggatagatcagaagtagatattggagggggacgattcagcatccaagggagatttgagggcataatgagaagagatcatgtctagaacaacagcaacgacatagatttgaaagcatagccacattgacagcaagggcatggctttgaaaccaatcttgtgcgtcgtggatctgaaaccaatcatgtccaggatggtgccaacttcttggactgtggccgcaacatgccagctagagaggccggtgccggaatattgttgtggttgctcaaagggaggtcggagacccgaagagacgttggtggcttggaggaaggtcgggatgttgtgagaagaacggcgatggcgctgtgaagaaggaagaagtcgactcaacgtgcttggaccttgtagacgaacccgataagtgtcgtaaaaaaattgtggcctctgcagatggttattttttcttcgtggaatgggccaaaaccagtgtaaagttatttgatttccaacccatccaagcgcattttttctggcccagtccataaaactttttgggcttgtattttacacctgtattgggccaaatactagccttccaatcaggcccttagggtaaattgcaatatagccctcccccctcaaaacctgcaaggttgtctcacctggcaccctcaacttgcattttactttggtggccccttatattctacccttgtaggtgaaagaaacgttacaagtcactaaaacacattggaatggatctaacatggcttagttcatatactgattccattttaagtgttgctgagttgtgtagacctctttgttttcacaaggttgtggtttaagctttgaatcctcttgctgtaagttgaacaaaacagactttctcttttttctctttctttttgcccaaatagtccttaagataaccaggctctggtctcctatgtcagacactgacctagttcagttccaaatgtagttttgtcatatctttacttgcagaaatattatagaagcaggacagctactgatgaactccatgtctttctcccctaacaaaaaatgcttttaccatcggagatgggtggtcaaacattttatcattttggtgcatctttctagaatctagatgttcggattggttatattgcaatcatatgatatgataagagttggcacttggcacacagagcatcattatgatattacattaaactgttattttttatgaacatggctaggtcatgtcgcataccatgagaagtttagacaggaggtttttcttactgtggggtgcaagcagaaagtacccttgtgatattaaactgttgtattttttacgaactcagcttaagttgcatacctcagaccatttgataagatcaagatctttttgctagaagttgtggtccaacatgttcttcagcacatgccttgctcttttggagtttattaattagaaaaattattatcagctgcgtggtgatggacactgctctgttgaaacttgttagcattttctattattatcatctatgtcttttccccttctgaatgcaggatgatagcactgaattccttgccagggatgactaccactcatgttttaatacatatgaagttgatgaggattatgtcaaatattgtgaagaactaccaaagaaaatcaaggtatcaaccatgtgatcaagttattaatagttggtaaacttagccagtaacatggatttgtttttgtgctaataatcttttatccttggacagtggattggagactatgtagatttggatcggtcttctcaggaggtactaatataaagctggcctatagaaaattatgatttataggtgtatttgtccatacatagtgcatatcaggatgattaactttgctctttagtggtcaaaaatggacaacactacgtttttccaagcgttaaagattgcaacaaacttttgccatatgactgttggtttagcccaatttgcatacatggtaagaatttttctgttctatttagttttggttttcatggctggttttaacaattatatcctttcaattcaggagtatgtatgggacctgcgtgaaattagtcgccttaaggaatggccttatttcttacatgagatttggaagctagttgctaagcaaaaggttagcatcctagtttaatccattgttatttataaataaatcactaatgggtgtctatcagctggttatatattattgtttgtttcctttatatgaacatttcagatgaatttcaatgatgctttgaaggtagtctatgaaatggatatgtttcatagtttcaaatttgcagtggaggctgaactaaatggggacaaattgtttggattggaatatagggtaacttttattttggctattctgcaagctcatcttttaagatccgattaataattattttgctcatcttgctaatatttaatttttttttctccacgtctagttctctatgtgctctaaggatatttctggtgatgtaagtacaatgtcgtatagcatatatgtgtagttgaaatacattttttatgacgataatgtcatataatataatatattgttattttaggttgaagagggtaaagctctagatttgattacaaaggcagtttacagagaagtaatcagtgaaacacttaagctaaaaatgtttcttattctacaccctgcacagttctaattgattttgttttcagtttcatcacactcagaccatgtgtgggtatgcggcgaagaagatggatatggcgaaaaagattggtttggtctagctggtatgttattctcaatttcttataaagttaatgctactagcgtgggacgcgcgctgcacccgtggcattaaaaatggcagtctgtgattagttttgactaatatgattgggagaatttgctattgtaattattttttttagtgtagtgaggaaagaagtgttctgttgtgatgtatataagtcaatagttctgcaaggtatgaggggccaatttacatcatgaaatgaagtagtatgaaaaataaaaagcgttataagcgggaataaagattccaagtttctaggcccgaccatcctataatacactaatttcagcatgctattttgttgtacgaaagacttattaggttgatgcattgcaataattgtttcagatttgccagagaagaaagaaagaacattcaacaacagaagatcaatcctattaaaatttaaaatgctaactgagatgcattatgaagtttttaactaaatatttgtacattagatcactggcatatatcttgttctatctatgatgtacatataaaatgaaaattgaattttttgcagaatatcaacaatacatcatattgatcaacagaaccaaatttcaatagtaaaagtatgaaatcatgagcagtgcaaatttgggggaacatagcactaaaacataaagatggaacatttactttcgcttccttatcttcttctggtattgagcacggatgaactgtagatcatggattaaaagtaaacacaggtgggcatgaaacaatgaaatttatgtgtctagataaatgaagatgcacaccaaattttaagaagcaagcatgatggcagaagtgcatgctaaatttcatatagcagtggcctgcaaacctgatttcattgcaattatgtagctggcaggatagagggttgatagctagatatgtgtcatagttgcctaatgttccatgtaggacgcagtacttctattagtaaatacatagcatatgttctagcaaaggtgaccccagcatgaccacttatatacattaatattaggatgtaggtcttcagcaaaagagtcttgcttttaactttgtagctttattttggatgcctcctttcttctagcatgtacataggctttgtacaaacacccaaaatatctgttggatggctggacacaagcatctcattcactgcatggaaaaaaaaattagagcctaaagcttgtctatagctatatattgcttttgtattatggctgtcaaaatgcttaggtactgtcaagaaataggaggattacctttgatcctttgtgtgctgggaatgttctttgaatagcttcttagcaggtggagctggaactgaagctatagtgttggtcctgtgtaatattaggttataacagtcagttaaattaccaatattgtaagcatctatcactgatgcgctgtaggcaagcagtccataggtacctttttttgcttgcacttttgctaggcacagaagggctaataggtggatcatcaggtgtattgacaaaagttcctttgatcttataagatagataaatgtgttagtatctaatatgttatatggaagcaaagagatgtgacagtaccttatgttcagattcagattcagatggtccagctgcaggaagagatggatgttccaaagttttctgtccactctttggctttgtggccttgcaaaattaagtaggagattagattgcttgtaaggtagtgctgaaaataggctgaatattagtataactggtggaatactaaccttatcatcaatggaaggctgcattgtttgagattgcataggatatgctaagacaacatatttctttttggtggatcctgaggggttggacttgctagttggtgtgtcatctgctgcagcgctaacaacatattttgttggtgttgatagacttggctgtagagatgcactttgctttcctctggttgatgactgtgattcaatactgctttcgcttgctgcgggtggtgtttggagtgaagtgccagggctcagtggtacgatagttgaggtgcgtcctgaagcagacggtgagataggcaggaagtgctgttttggggcaccagatgatacaatgctattgacctgtaaggattcttgattccgtttaactgtgtgttcagtgaagctgacattccatacaaaggcttgatctacaagagcttggatctcagctgggataaagtcaggtggattttcttcgattagagactccactggtctgtgtattaggcgatgtgcaattcgtccgaagaggacaaatgcagcttcagaagtgttgtctgcggtagtgagcacaactttgtatctgtatgtgtacaatatatatggtcattacaatttgtattgggaattcataaatgtgtagaatattgtgtgcggtgtttttctaaccttggcactggcattcctatataacaacagctagagcatctataggtagaaccatatggctttgaagttctgcagcatcggtcacatgaattgtaccaccagcagttttcatcatgtatgctcttgatagtaacattgacaataaaacgtgctcgctgtagagaaagagaattgtcggttatacaaaacaaagcaaaagtatgaaatgcatataaaaaatcatggagtagaatagaccttatatttgtgcggatttagttttagaatttctttaatggttttttcctctggagtgtcttggttgaatgcaggagcagcattttcaacccatttgattggctggaagttgacactgaagctgtaaagaaaagcaatggctagtttttaatctatgttttagagccagcgagaattaaagcactgcaaatgaacctgatatatgaaaaaaataggtgataatagtacctttctttcaatttgagcacgtcaggtatgtccagattgatataccatttgcatggtgagctaccagttattgttaagcctgtatacaatgagctagagattcagattgtagtcattgcatgcaatatatagtaattagcaatttagtatgcatagggaaatttacctatccctgcataatctctgacaagtgttccaacaaacacgacaacctggggtttagtttggccatccttatatattttctctgcatcaaaagcagttgatcgatctccccacagtgtgacaggcagtgttgagttgctgtgttttgcattaacagtaaaattagtgtagctataattggaatataaaataaaagattgacacttcatcgaactgctatttaaatgaaaattagtgtaaatattagtttataacataatgcaaagcttatttaaatgaaaattattctgttttacataactaaccttgcatcacagatctgcaatgttctttttaaactatcagcatcccttgaccttggacgcacgatagatgtggaactgatctcagtaatgacgcccataatatctgtttgcacatgaaaatagaataaatcagtcttataaggcaatgtacagat

SEQ ID NO: 39469 - DNA, 7730 bp, Oryza sativa
gccctgcaaattttgaatatgatatactattttagtaatacgtgtggtatactaatgtacacaaataataagaggcatgagtagtgatttgataagtaccacttcatcaaggcgaagcggaagagagtggatgggacgaggagctcccccgtgctaggccgccgccaccgccgtgcccccgcgggtggccgacgatgctaggagaggcaccaccggcgggagaaggggaagaggcagaggaagcgattgtttcttggtcgccggccgcctccccctccctcccaaactcgctggccaccgcgctcgcgctccgctactctgtccacggcctgctcgcgctccactgctcggcctgccgccgcgctcgcaccttccgctgctccgttgctgcgctcgccctccgctacgccggccgcatccatgctcgccgctccgcccgctgcctccgctccgccgctggacggccgcgccgcgtagcctcgcccacggcgacgacgacggcggagagccgacgacgacggcggccacggcgcgcggctgctccgcccgcagcctgaaggagaagagaagaggagagaaggagaagaaaagaggagaaaaaagatgtgaagctgacatgtgggcctcacgtgtttttttaatattttttttgctgactaggatgccacgtcagcaaaaccgggcaaaaatactgccgagggacctccggtgaacggtttgagtgagtttaggggtacacatttctggttttgtggttaagggacctcaaaaaatctcgctgttaagttgacggacctccggtgaacttattccgccatgtaaacactagctagctggcctggcctggcctggcctgctattgagttcaagtcactgtgacaaggaataagttcatttgaggtccctttttatgccaatggtttggaacacgtgacgcctacgtcttcgttcgtatcacgtggcagatatgtgatgcttacgtagcaattcgatatcgcaaaaataataaaaaaacataggcccacatcagctgcacacacaaaataattttaaaaatggtggggccatgtgggcctcatatgtcagccacactcctcccttgttcgctctgccctctctttcttcttcctcgtctcactccactcttctttcctattccctctagggaggccaaggtgcgcgccgaggtgactgggcccgggtgggcggcgagcaacgcggtgacggcgcccggagcgaggccgccgccgccgtcgaggcggagagggcgtcagcgggaggagatcgcggcggcgtcggagcagccggcgtagacgtggtcaaacccgaggagcgcctagagcatgcaccacctgccgaggcaggagcgtgagcgccaggagccacgcgtcatcgcccggcacgcagccgcgccgcctcggcgtccgacagcgagcagtacaggttggcggcgcgcgacatggcgttggccacctcgaacgacaggatgtcgaccttccgtcatccaccccctccgccgccgcacgcaccgcccttgccgctgctcgtcactggcttcatcttcctagacgacgacgtcgccatggacaataccttgtgcacagctaaccggccaccatggcgatttcttgattttcttcttgaaccaaacaaagattcaccaaaaggaggctaaaacgtagtaagaaaaatatctccgcttttgcaccaaatccagctaaacaagaaaccaaccacgagcagtcaaaaaagacacaccgatttgaattcaaacccaaatcctccgatttcttcgttgtctcgctagtagcaagcagcaggagcaattaatggcggggagcagagcgagcagagatgtcaacacatcgccgcaacgccattaacaaacccaagggagcaaacaaacaaattaaacaaccaagtgacgagaaatggaaaaacaaaaaccaaaggaatttcctcgggcggtgttccagtgaaagaaaaaaacaatggagaaaggcgaccacgaagacaatcatggcctctcctcccgctgccgcccttactgccatacatacaaaacacatatactactactatattacctccatctcatgacgttggtcgtcaaacaaaaagaaatggaggaggaggaggaggaggctgccaataaaatcttgcaggttcaaatcatgccaggtgacagcgaagacagattatactggaagcacagtaggattggtgactgcaacacaaagagtgcttataaggaattcatgaagagagataaccctatcacccaccaggtaagtaggcaggttattgctgtgattaaacaaatttggaaacacaagataatccctccaaaagtaaaaatttttgcttggaggctcatcagggaagcacttcccagagctggcagactccgtcacaggatcaatgacatttctgaaaattgttgcagatgtggacaggttgaaactggtttgaatgatatctgacctgaattgctttattgatagatttcctgataatgcaccgatggctcacatcatttctttcatgataaataatggcaatggcaatataggtctttgcaggattctagcccttatgtggcatatctggaaagccaggaatgacttcaaatttcaagcaaaattcagagagccctctcaagtgtgtttttaagctgaggctatggcgaatagctaccacaaatttctatctaatgattgtttacaggatgaagagcccccaggagaacagagcaggaaaaaagagccaattccacaagggaatggatgctgcattgatgctgcttggggagagggtttgacaggagttggtgttttctttcatatgccaactaatcataatgcaatctttattaaggccttcagcacttctgctagctcgcccttgcaagctgaattaatagctttacagtttgctttggaggtagcaaaatgtcttgactttgcaggtacggttttcctcatggacaatgcaacgattgcagataccatcaagaagaaggatttcgaaccagactcaggacattggagcctacgaccgttatggtcccaaatgataattgactttccacaggattttatgaaggtttactggattccaagagagattaacaaaatgcttgacaaattaacaaaagaagctagacttttagaaagggcaaatccgatctttgattgccaaaacatttctcaccttgcttatcccaatcgaatgtgctttgcttcagctctcaagaacaattttaagggagcaaactgtgttatcaagcatgtactatgcttctagttaatataaaagcttggttttcaaaaaaaaagaagcgataaacctcataactactcatttcttccttcacttcactaggacacgacgtccaaaggaaaaacctaaaaagacagctagtataatattgtggactggatttggagcatgtgtaacagtaatactactccgtacacggcagtcaaaaaagggataaaacaaaaaaaaggatatcgtttcctttttcgcagaaaaggtgttcatgctggggagaccagcatggaaggcatgtactgattacatcatctgattgtcttttcgcgaccactgccaacatctattttactgaacaaaaatactggcgtttccactaaacacaggacttgttaaccaacaccagctcgaggttcctgagcggcacctgagttccttcaatcttcttactgccaattttctcatagtaatatcaacaagaccattaggagagcatcggcaatagttatgtattcaatacaagtgatggtaattatgtatttactgaaaaatgatggtacataacctaagtaatacactaaggtatacctggtcaatggatattccaaaaaaaaaaaaacagatttatcatcaggcaaacaacaaaaaaaaaaagtgaatcctaactttgattggctaaaggcccctacatgacaatacaacattctcataattacatatttccatctgacttcaaatagttctttactcaacatccatatatacctaatttatgagttcagttattcaataaggagatgttattattacaaaaaaggaacttaataaacacgagtcttataaggagataggaggtataaagggatgcataagtccaaatggtctgcaacaattggtcacaagggcagtatgatcaaaacataacagaataagtgaatccagattgaaaaccacaataacatgagaaagctgagcgcatccactaaactcaagctgttcaagcaaacaaacaaacgataatacttgtccatgttgagaggaaactacaaaaatgtcatttgatggcaataaacttccttattcatcagtaactgtcatgtgccatatgtgtcactcaatttattatatactactagaactctttaacaaacagagcatttgataaatattcatatatacatttttatgacataataaactaaaccaaagatagaaatggagtccacatacctcgggtgacaggcatttgtataggttgaggcataacattggttgctcagattgaacagcttcatcaacagttgaggacatcccattaaatgtaagatcatcctataataacaaaattttcataatataccataacttccttttgtgattgtatcagaccaatttatatttgtgtgaacaaatatacctgcacctcctcttcatgcgtgtatgctccactcacaaatttcacattctgaattgggtcatttccatcataagcaggcaaattcaaatttgttttcctatacctgttcattgagcctagaagtccgtgatgtggctttttgtcccattccagaacacatgtttgtcctctgcggacattgttacagaatgcagcatcttttaaggcctttgggatatcatagatgaagaatctcttcctcctttctttaaaccagaaaaaaacatgatctagaatcacgtctttgattgttcctatttgctggctgaaaaaaaaatgtgtgtataaggctaacatgcaaagactaggcagacaatactgattcaatgaacgcaacgtacttacgtgtttgcaagaaactccaaattcattgccaggtgatcaactaacatgtatcgttctgcttgatggggtacgcctatctttgccagagcggaaatagacttaagcatcctaccaattgcattgatatcttccaattgtgctgcctctttactcattgcacctggaaatgcaagttttattatatctgtatgtcaaactatctcgctaacataccctatacttgttaataggttcacctttgctttggaagtttgcaagtttgatggtgatcttttcattatctttgcaataatatacattttccaagcagatatttccatgataaagcccatttactcgaagctcctcccacccctcaatgatttgcctgcaatgatttatattttagtgcatatacacataaattacattacaaacattgagagcattaggcacagttttaaagaaaagtaagtaagttttatctgactacgtcagcaagctcaaccgaaggaagaatgtcagacatgccgcccagtttcatttttcgaagcagtgctggcaaacgcccagtaaaagattcaacaaacatagctagtactggtgtttttgcctctccaattactatttgtttcactgcctccatttgcaaaacgttcctgtgcttaacattttgcataatcatcagacagtgtaggttatctggtttattcacatccaaacctatcactggcaagtgcagaggtaaagtggaaggtggaatattagaaggcttcttgagctttagtctagccacataactagattgatccacctccctcatatctaatcgggtgatatgcaatggaatcacctgttgatgtacctactattagatcccatattacaaaacaaaaaaaaaaggaaaggggagggggtgggcatgcagttcatattaaaaaaaaactgcaatagtgcatataccgtttcttttcctttgttcagatctggggtaatgttgaccttgtcccgacttttctccatgtggctgtcctgtcaatacgaagtaattgcacgcatcagcttatgatgtattttcactatcccgtcattacatatatacgatagttaaccacccagacaccgggttatcagctcaccttcaagaggtctggaacacgtaaattaaacaagcccatctatacaattcaggcaaactgccatacaattcaggctgcgaagcagaaatcttggcaagaaaaacgtagaattacactcacccacagctccgccgctcaacgcccgcaaccgtcgaagaacccgcaaaacctcgcccccaaatcgccccgccaagctccgccgcagaacgctccgcaaccgtcgacgagcctgcaaaatctcaccggaagcggcgcggttcagcatcaagaattggaagtcgctgctgtaccacggcgagacgaggagtcggacgctcaccggcggcgaccggcaagcggatgaagagtactagtaaaaccctagactcggtctcggtctcggtcgcgtcgccgaaatgaccctcctatccttttgccaactgtcaagccacggtgcgcgtgattaaggcgtgggacccctggtcagcctccctgctccttctcatttcttgtcggtttctcccggcgtggggctggctcgaggtcgagatggaggcggtggctgggcggagcgagaatgatcgatgtcgacgagaccggcagtgtggtgcgcgcggaatgggaaacgccaccagagccctcctgagggagggtgggcgtgcggtatgtatgtgccagctgtgaacacacatgtatttttttttaagataataaaatataatatcccagcctttactcaaaaaagctacagccaattattacatattagttttcatgatgaatatagtgtaaatataagagaaaaacaaagaaaccaacctaacgtacggagatcacgattattgaagtctacttgtaaatctccaatcataattggcaaaaagttgtataaccgtgctctccaattttcggcatacaactttcagaaactcttcatcttcatcacacctctgtagttgtgcccaaaaccggagccaataagctgtcctgaaaatgacctgcatatagaaaaatgatggtgaacacacatgtatagggaagctaagtagtcaaagtgtgtcaatcgaagcgctagtatcagagaggattttaaactcttaaagatagtttaaagctccgcaaatatacaagttaaaataagtcacaacgaaaaaaaaacaaattaaactacagctagttaatatatgttcacaactaaatttattttttttgcaatatgtaaaagttaaaattgatatattgcatgtttatggagcgatctatcacatactcctattaaactatcttgttgatttttattttaaaaaagtttgataatcatttaagtcacatataaacaacgagtaaacattctctcagtattctctcagtttagaatagtttctggctagtatcgtgtgtatgtcattgattgcttgcttgcatgcatgcaagggaaccgaggagccgttcttgtgtgtgcagagagcaacaaagccaagacacgctaagggtctgcttggtacaactccaactcctaaatataacttcaggaattaagtctggagtggagttgt

SEQ ID NO: 39470 - DNA, 21061 bp, Oryza sativa
  unsure (1)..(21061): unsure at all n locations
accgcaccttgatgacatgtttagtgccggttgggacattacccgggactaaaacttagtcccggttaatgttaccaaccggtactaaacatgttttcaaggttagttaaaaagaaagcatctctatccaagtcatatatgtgtagtaggtgggatggtaacatgtgtgaggactgaggtgagagatcttgagtttaaatcccacatcccacatatatttttgatttagtatacatcaatctagcggtggagcttgttatactactatggttaggatattattatgaatctagtttttttaacgaatataaatctgttttctatagtagataggatcagtttttatgtagggcactttttcactatattttatctgtgtaccgaattccagatgctcatgagcataatcaatccacgcgcgctctctctctctctctctctctctctctcattatacgcttttacaactcgatcacagattcacaacaggtggtgatcgtgccgccgcgcatgcactcgatgtagaggtttttttttaaaaaaaaaaactcacgtacgatagcattttataaaactagtacttatcaatgatatttattgaaattggatgtttatcaacgatatttcttgaattttcttaatgatgaccatgtggaagtatgctgcgaggaagattgaaattgcaaaacagattgttttgattgatcaaccactatgtatgcgcgcgcgctctctctctctctctctcttatcaaaaaaacatatgctgttgactgttgtttctctgccctatagaaagagtataatttacacttgttagcgtttttccaaaagtctagttttcacttttcaacctgaattttgaaacctctcaactttgttatggaaatttcagagattgaagtgatgctttggaggaggcgcatcaaatggagaagtttcacgaatacaaacatgcagtggagactgatacgaagattggttcaaaaaattcagtagtcccacatgcttgataaacggattttgactggaatacaatttccgtgtacaagaaaattttccaagctggttgaatcccttatttatatcacacaaggttgcaaaaagggtaggaaggctgaaacaagaaaactcaagaaaaaaaacctcaaaaaaatctttgctccatctgtctcaaaataaaccaatctaaaattgaatgaaacaccatccaatcttacaagctttagcacgtggaaattctttctaaccatagtccacgccttattgctgatgtttgacgtgtttgtctcctacgtatacaacacatctcaccttccggagaagaagtaatctttacaatgttgatgtgttgatgtatgtgtgggaattaattatagttcagaacgtttcaagtagaagattacccccatgctggcaaccgcaactgcaccagctgcgatgcctagccggagaaatgaccgccctgttttcaccggtgaagtatttacaagcgatgtggtgtgctccccattgctccagggctcatccatatgcagcctcagaacctgaacaggaaaaacaacctccaaaaattagcggaatgccgcagctaggaggctgcaagaacagtaacaaactaataaaggaatgctcagttgtgaccttccatccagctgatctcgcatgctgaattgccgcactgaggtcaccgtcggtggtcagaaccaccctgtcaccttcatcgtcatcatactgctcaatgcgattcaagtaagggtgtgtttagttccacgtcaaaattgtaagtttgactaaaattgaaagtttgaaggaaaatgttgaaagcttatgtatgtagaaaagttttgatgtgatggaaaagttgaaagtttgaagaaaaagttgggaactaaacaagggctaagattcagattccaagacggtaagatgtaaaagctagagaggtccgataaacagattccaaccacatgcttgcttggcttcttgttcacttggagtaacattgcataaacaagctcggtttaaaagccgttttgtagtaaaagtttcctttaaaactactgaaaaatatattctgaatgaacagggaaaatgaagtgccaatcaacaaaacagaatgggcttggttttaacatgttcgatcttgtatatcttaagcactacatattactgtacctaaatcgcgtgtataagtacaacgcagttctgctcttaccagaagattaatcttctctttttccattcccagtctgtacgatacggcagaaacaagctcatctaagctttctgaaactgtataaaggaagggcgcaatcaagtagaaaatcataattttatactactgtatcaacaaactgcaatcaggaaataacgatgagaatagaccaaccacaactgaatctgtgcatacgcccttttctatcttgtagtttaaaggagaatgaattgccaacatgagggggtatatgtttcccttcagcattatctgatgttgccattcgagattcttcactgcgctataacagaagactaaccatgaggctattgaaaatgaatcgcaaactattcaactaagcaagtaaaaaaagaaaagaacaaacctacgggcatccgattcctctgcaggctgcagggcaagagctgaatcccagaacttctgcatcatagtatttgccatactgttcgcttcagaagctccctcaacctaacacaaacaaagtgacctttagtacatccaaactccaaagtactaaaaataaatgcagccacagggactaaagtgttacttcttttcattcagaatggatcatttatcttgccggaaaaatactgttttcttagcatgatggaacaccgaaaaaaaatgtacactggcatgatctggtaacgaaaacaaaactgtcccctaccattgaaatagctgcatgggttaattgtagagcatccaaacatgcgatgatctgtccatctattcaaaagttaagttagatatgcacatcgaaaaaagatttccctgttgttagaattcggtacttgcttttgtcggcaacaggaatatgcagatatttcccgtcttgcattgaatgcagggcctcaaggatcgatgtatccaatgtcgcacaatcagggtttgtagtcataaccttcagaaatgtaccagcatattgaatcaaattgtgaaaataataaaaataagacatgaaagcaacatgatttaaaatgcagaggtttcaactttgtaaaggtaccttttctacaagagtcacatctggggataaactttgggccactaatcgcaataccaaatccttggaactacagtatatccagcacagattccattaatcacttaaatagaattatatcatagaaagcagtctacactatcctagtgttaccattgagcagataactgtgttaagaaaaagaagttttatgtaaagaaaaacatacgtaagaattcctagcaacatgttccctgtcatgacaaccactgagttgactcggtattctctcatttttttggcagctgctattacaggatctgaaggagatactactggaacactagaaaaaagagcggtgtgaaaattcaatgagaaatagttcaaaacataagtcttcctgggaatatagaactagtacctgttattttctgttatgatggttgataaggaaggcttgaacagctggtctcgcagattttcgataaatgaatgtggacctgaagtagcccaaagtgtaacatcgtttaatcaaaagaaaattgagtggaatgcaccatgattgttatgtagaaaatagataataccatattcaaataaaactaaaacaaattaacctggaaagtcatttccccactgtcgttcaactccttccatagcagctgctattgcactgccttgttctgcagccttttccattcttgaaattgcatcataaaggaacttggtaatgtccagcatggcaattacctcaccgtgttccactacaggaagatgtctgaactttcctgttaatgaatgccatgttgccacaagagagcattcagacccaaaaagaaaaggaaaataattcactcagaagaacataagaaagaatctatctaactttgcaattatcaggaaaaaaagaatcttactttctcccaaaagagcctaacatttgtaattttgcaagaaacatttttatcagacatatgatcccttagcctatatagctgctgagtgcctgagtttcaacatggttcataggccgtatttgataagaaaaaagtaaattatactccataaacaacagtaaagcgaagaacaaatgatgatgttgagaagcaaaaatggtatcaatacctttgaccatcttttgtaatgcttcaatggctggtgagttggacataacaaaaactgggttacgcgtcatcgctttggccacatttgtttcgtcaggcctgagtccctctgctatcacccgtcctgatatgtcctacaaaacaaaaatacaaaaaatccttccgtaaacttgatcgtcatcattaacagcattaaaatgttaagcacatcttgttctacagtaaaaccttcaaaacttatccgttttatgttatcaagtcttaaagcccaatatccctgaaaataaaatctaatttgtctcatgtgacatgacaatgagctacagtacccaatcaagctcaggttgcataatcgtcaccgctaaatctgaatgactgatgaatttctctgtaactcaaaactgattgaacacaaaataaattgcatttggcattgatcagttcacgacgacaaggcaggcaaataagtgattcagacctctgctgtgagtatgccggagagcatcccgttggaatcagtgagcaacgcggcatccactcgcttgagcgccatcctccggcacgcctccgacaccgaggtggcctccggaagcgtgagcgccttggccaacctcagcttcttcaccgtcctctccggcgacctgcgcgccaaattaacaagcacaaaaacgcaagctccaaatgaatcagcacggggcgaaggtaggtaggagccaggaacgcccttccttgcggcggaagccatcgcgatcgcgaggggaggggcggcggcgcttacggtgcctggacgggcgaggcgggcttggagttggaggccttctcattgggctctggcttggccgcggccgaagaaggtggcggcgcgcggcggagcgaggtgggctggtggctgcgaggctgggaggcggcggcggcggccatcgcctcaggcctcagccgtgtacggacgcggcggcgatcgccggagaaggtgaggggggaagcggaggcggaggaggcaggggatttgaaatggtggagtccaaggcaagctgcagaggaggaggaggaggaggaggaggaaaaaggctcgttgcgtgcggcagcgggaggggaggaggcgacggttggtgggccagggtaggtgtggggccgacctgtcagtggctccgtgggacggtgggacccacctcgactagacgggtagtgcgcgccaagcgggtcataggaggaggaactggttggcacggacggtctacacgttgtgtccttccggatcatctgtgactattttgattattactactagttgggttccagtaatctccttaatttcgtttttttgttctttcgaacagactctgaatacatgatattagtgttgtatacttgtagtacattgaggtcctcatcggtaagccaaaagctttggctaattagttaaagttggcttcttcaattcaactaaagaaaatccgttgattggcttatttgacttaaatggcttgatgaggattttttttctccaactcccttgcaggccctacctatgttcggctgaaagctctcagcccaataagcgagacgatggactttggctgtaaaacttcaacccaaacagccatccgatgagactttgataaagccatcgccagtagcttcattcacaaaagagcatgttgtcttgataacttgattgctgatacaataaagttaacaatgaaagtaggctcggtaacattctgcaaagtaaaactagatggtagagaaatcagtttggaaattatggattgaaaaccttttattattaaaatataacttgtacatattattctattaatagactaggttgtaggaaatgaatatgattataactacttgctcatgtggttagaggaatgtatcatggaataatattttatttaggcaatgttgatttacattattgaacgtatgattgttatggattatttacgtgtatatggataaattaaataatttaataaataaacttaatagatagttcaaaataagtggtctaactaattaatgcaatagaagaatttaagaaaaatatttttcaatgtgtgtagcaaataatctatttcaataatccaatgaataagctgaaaataatatgacaaaaaacttagtctaccaagagatctactaacacaatatatctcttaatatacatggcacgtactatcgcaaaagaaaatggtacagcgtacatatatatatgttgtcccatacttgtactactaaagttggttagcaaaatagtacatagcatagtcatattgctcatgagttaagtttcctctcttgatcgaagacacgtatagctaattgtacaatcgattggtagctagtctgatatacactggatagttcaaaggtaaagggtatatggttttaactctgagatcatgtgtttaatcctcaacatgctcaaatttttttaaaaaaattaaaataaatctcattctttagtaactaaccccaatggatacactctgttctccaaatcatccaccaacacaaaagcacacgcattacccacggtccacaaagaatcaaaatgaagtggagaaagtggcaacagagagaagggaagtcatgtgttgagatgctgaggaagctatttttctccacagaaaacacgctgacgctaagctggaaagcaacttcgacatatgattctgaacttttgcaatgtagcacaatgcatttgcttcaagtcatgtaaagcctgaagaatacataggacattttaaaaaaaataaataaataaagtgctggttaaaaaatataaattattctagttaagcacatgttgctggatttctagaagagggaagggagatgaagcctgattgaccagacgtgacaagaaactgtcatcacctaagacccattctgtggtactttgccttgagcatgattctccatcaaattaattaattaagatggtaatatatccgaaactcaaaaggctgtccttttccagttcagaaccacaacaattcgagtatataaaaggagaattacaggctacagcacatggtttcatgtcggacaaatgcacgacttaatcttcgttgcagaaagaaacagagaaatgtcctgatctcttttgaaacgcacgcatgcctatcgcaaaaaaacaaacaaagaaagaaaaggcttatattttgatttgtttgacaatgtcagttaatgatatatgagtgttggcgacataagttttggtcagcgtattggttttttcaatcgatgaccgaaaatgttaaaacacagaactgttgcaaacggaaatccggaaatttgacctgagctacaggtttttgcaaacaacggcacgtttgagtgtaccaaatccaaaaggaatgttgggccagttctctgattatatatgggctgacattttgacgggctacactagcttgtactgcacgaaagcccatatattaatcctgcatagcaatatttgcctattcggcatctgtctgagaatctctttcttaattatcatcagggaattagggcccttcactccttcaggccctctggattcatttcaacgagaacctcatgctccttgtctacctcctcttaatctgtttttcttccggcatttcatacgtacattcattaattgcttctctttggcttttgctcaagtaaaatatggttaaaaattaatggatttacaacagaagacagtttgtacatcctaaagcaatgtacatataaggcttttatcgcgggaatttgaacttccaatcaagtgaaaccgattatatatcttccaatgaagaaaagaaattttacttttaaatgggaatcgggaggtgctatttcttatcagtctgttaaatttgatctcctaagtatacttcatttgtcttgttaataatgacaatattttcccatcataattaacctagagctagatttgctttgtatacctacttcttaattagccagcaacatatagacaaatgcatgggcatggaatgtttttctttgttttgtgtgaggaattaatagagagagggatttattacaaccaaggaaaaaatatatccagagagaaatcaataaagaaatatttccatggatagagaaatttgagacctcatcattcatcgagacaaacatacgatcggctacaatatatcgaggttccttctcaaggaagatcgatcgagccaccggccaccatgtgtgtgtccatgtccactatacgtgtacacgtacgtactctcggcgcaataattaattcatttctctctatcttttttttcatttttttttgctgacatatatagttaagcaattgttttcagatacttattattagtggacacaattttcaattgcgaccttaatttttaatcatgaatttgttcaatattattattattgtacataaatatttgtacatacctaacactcattacttaattagtcataatatatcagctagccatctcggcaagatcaggatatatatgaaggattatatatatagaaggatgggattttataacctccgtttgatattatagatgcattgttttttttctaagccagttttttttaaatatagttaaccatgttcacagacaaacttagcatgaaattagtttcattgaatgtgatatgaattatttttttaaaaaaaaatgttgatacatttttctagaaacttgcttaaaatttagagaaagtttagttttaaaaaatcaaagcctcttataatataaaacatagagagagtagacgttaaaataaattgagcctcaggataaaacaggccatcactgtatcatgtcacaatagtgatttgcctggaatttaatctatttctctgaaggaagatcctaattaaattaagagaaaatccataaaatgccatcaacaagcaccctaatcccagaaatgccatcgacaaagacaactttccaaaaatgccattgcacaagccactttctcccaaaaatgccatcactgtcaactccacaccgttacaaccgttatttttttaataatgactattttgccctcagtgcaaaatatacctagtttttactgtcaaagaaaaaaaataaaatttctaaccctaaccctaccactaccgatcccgatcccgatctagcgctctccccggcggcgtctcggcgacagcggctcggcggcgatcccctgctgcggcggcgcggcaagggcgtggcgaggaggaccatggcggcgacgcgacaggatgcggcgaggaagaccagcgcggcggcgatgcggcaagggcacggcgaggaggaccgcagcaaggacgcgacaggacacggcgaggaccaggacggcggcggcgcggcaggacgcggcgaggaggttcacggcggcggcggtccccgacggtggctcgatggcggtcctcgacggtggctatggctcggcggcggtcccttgctgcggcggcgcagcgaggaagaccatggcggcgacgcgataggacgcggcgagggcgtggcaggatgcagcgaggaggaccacggcggtggcgccgcagcagggcgcggtgaggaggtccatggcggcggtggcacggcagggtgcggtgaggatgtccacggcggcgcggctattgcaggatgtggcgcgggggccgtagacgccggcgaggagggggagaagaggcctgcagccgcagtcgctgaggtccgtgaaggaggaagctgtagtcctagcaggtgttgcaactctgatgttgaaattttcccttttgtttgattttatttgaagactttgtttgatttgatttcagtggatttaattatgaaataacttgattgatagtaaaataatgatgtttgtgaatttataaactaacagaaatataatttattgtgagcaagcaatgcaaaatgatgatgtgtgagtaaatggttgtctaggggtaagattgtcttttcatgcaacttaacggaaagatgctaagggcagtttgacggtgatggcatttttgggagaaaatggcttgtgcaatggcatttttgggaagttgactttgtcgatgacatttatgggattagagtgtttgtcaatggcatttcatggattttctcttaaattaatctctaaattcagaggatcgatcgatctttaattagtttgtactgtgaatagtcccttgtttttgttaacctctgtattcactattcagcttatatcgttcagagacctgccagtactgtattttgaatctttttggtagttaaggttgacgcatacgattacacacacataaattaatcatagtttggaaaactgtaaaggggaacacataagaaactaacagctagctggtacgtagtgaaaaacgtatctttttgaatctcgatgaaatatatcatttgcatatagaaggagagatctaaatcaatagagctatccatgcatgatatggatgcatggacgacaaattaatttgcattgggacctccagacaaacatgcgatcgatcagctacaagatcgtattctcaagggaagaccaccatgtgtccatgtccactatacatactcagagcaataattcattttgctcctcttttctgcatattttttgctgacatgtatagttaattacggcattgttttcagatgctttattattagtggacacaatttgtgttgcgaccttaattaattcctaaatcgtgaatcttgatctcaatagcattcgtattgcatacgtacgtatatatgtacctaatactcatatatattattacttaattagtcataaacaatttgtgttgtgaccttaattaattaattcctaaatcatgaatcttgatctcaatagcattagtattgcatacgtacgtatgtacctaacactcatatatattattactcaagtagtcataagatagcaatcatttcggctagacctggacatatatggattatatgtagggaaagatggaatacataatactccctcaattaaaaatataagtctattttatttcgttaagagaaggttttgatgaccaacattatccattaggatattattttttatacaaataatcatgattaagtaagtgtgtttcaatacaaatttaatatatttcagttttatataagaaaagtattacatacgtcccaaaatgtatctaactagtggacgattagacatctcttacctattactgtaaatctggataattagtgtccaatcatgtactaggtagctatattttagtacgaagatagaatatccaaatagagtatttattggtcaaagtttatcttaatgaaacaaatatgttcgatacatatattttgaaacacgatggagttaaacaaatcgaatcccacgataaaacagtccgtgcatatatgctgccacaatatatagtgatttgtctcgtatttttaatccacttctctcaaggaggaccctaattaatctctaaattcagaggaaatgatctttagttaatttgctcgatctatgcataattcaccccttcctgtttttgttaacctctgaattcgaagttcagagatctgccaaagtgccaatatatagtgtattcttaaccattttggtagttaaggttgaatacgattacatacagataaatcaagatcagcaaactgaaataaaaaaaatcaaatgaacgcacaagaaaatattaaggggtaaccagtaagaaacatatcttgaattaatctcaatatatgtctcttaagatttaagaaacatatcttgaacctcaatgcattcgcgaaaaaatatcttgaatctcaatgaaataatcatttgtatgtcgccacgcaattttaatctttaccatttctcattaaacaatcaattgacatatccatatacatgcctctaattgtataaacagtactcaactcaatttgattctcagacaaattaacgatgtgatgattatttaacaaaggcaaagcatgatcgatctgtgtagctcaccctagctagtgcctgtcaagcctggacatgccgatcatggaggccaccaccggcgagtagtagtacgtcgtcgtcgtcgtccttgatgcggccgccggcgaagacgtcggcgtcgtcggccggtgggaagccatgccggacaaccgcaccgccgcgaggatcgccgcgccgagctccaccgccacgcggaagacttcctgcagcctgcagatgctcctcctcaggaccacctgcatcacgatctggaccactgcgcagtccatggacgccgccgccgcccccgccgccggccggccggcggccagccgtcgtctcgaacaccggtagctagctagctaggctagctgatctgagcctggatctacagctagctagctagcaggggaaaaaattgccctttgggttacttcaattcaagctctctctctctcttgtttggaagggtagctagcttagcttcttgccaagcgatggcagaaggtgaggttggatttgtcatctaaccatccaataataataatgcaataataattcaataataacttggctgatagcaacaggcggttacaaacaggaactgatataatgtgatttggacgtgtcttatattatcgatacgatgcaattttttggatgactaaggatatatacaaatatgaatgatatttttcaagttgtagcaatggggtagtttgaaataaaaaggatacattgagctagttgggacctcatgagatgcatgaaatcacgacaaaccgaaaaagaaacagctaagcattatacatcagctgacaagtagctatagcagcgctgtagaaaattgcatacaccaaataaaaggacggctatgaatacatgctgcacaggaggtagctttaatcgacggtcaccggtggcagtgtgaattggacatttgggacacatgatgagctcatacccatgtggttgtaccccggctgtactgtatctttctttttctgtagactactggtagtaaattagtaatttgttaagcaaagttgctgaatttgtaacgatttaggtatgacctgtactaaaagaatgatttctcaatcttttttctcacaagtactgataagaatatgcttatcagtacttaaaaacatcaccagataatttgtactatattcttcgcatatacgatccctatataaacatttttataattcaaattttatacgcgatactggttctgatatacgggaattcaaacatttcagtcaattaggttcttaattaggaggaaaacccaagcaatttaaaatttggcaaataagattttgttgaaaaaattctacgggaatccttcttttccttcacttttttggtggatttttagcatgatctcaaatctcatgcatggtttaaattcctttaagaaatcggaggcaccatgtctttatctatctgctcaattagtctaatgatatttctcctctaaaattcgtacgagtttcccgcggagtatctaaacaaaattcaataaaatatgttttaaatatttatgtagaataattttatgtctctttaatttgtcgctaaacgggaaccacgcgtgatgaacttactatagcttatcatgtgacgatcattggcaaaatatatatggtcggaagttcatcgacggcgtgtcggcgagaattaagcagacagacattggctttaggctttgtttagttgaaaaaaataattaaccagcatgtcacatcggaaatacggatacatatttaaagtataaaatataatctaataataaaataaattacagattctgttagaaaactgcgagatgaatttattaagcttaattaatccataattagtaatgtttactgtaagagcaagttcgatagtatagccaactattagctccaattcatctatagctaatctaatagctcattcatacaatagttacatattacactattaatatttagtcccacctgtcatacacacactgagtctgtgctacagctggctacaatctgtagcccgctgtccttctctctcatcatttatttccttaaaatatgtttatagctggcttatatgtttcatggcgaactatgtaattaatttgttttctatatttaatactacaatgtttcaaacattcaaggtgaaagcgtgcaaatttttgttttggactagacatgccgttaattagcgtatgcatgcacacagtacctggtggggcccagcagcagtggatgaggacagccatgtgctcatcccgcgttcctcgcgcggtggcacgcatctcgaggccccgctccgcccggactaaccaacgaccaacaacgaaccaacgaatcagcgatcaagggggtgtcgacatacatggcgccatcacgatccatcgatcgacgattttttttcttttttttttaataaccatcgacgatcgaattgatcatcatatatatcgatcgtcgtttgccggaagtcgtcgtaccgttatattcgatcgatatatagacgacacgacatgccgggtccatcagtgcacacacatctggctgcattctttaatttgcttgctcaactttgtttatttcgattaatttgctactactaattaagtagctatagatcgacagatgcattgcatcgattggtgacaataacacagagcagctcgatcgaatataatcgtcgttagtttaataaatcttgtgagacaaaatgaaggtatatatcctctcatcatctcagtgatcaccagccagttagtggcagacctatgctttagctccatggctgcagatagatacagtatatgatactccaaatcaccggtaggcaatggatgaacagtaaatatactgctgctgtttttatataggtagatctgtatagcttagggtcagctagccgccatgtgaaattattcccttcatcattgtacgtgcactaccttcgatcgatcgatagatatgatattccattcatcatgtgtgtgcatgcctatatatttcaatatatgcatacgtccatctcagtaccatgaccaagtagctcaatcggttaattaatctctgctacttataattataattaattgattattagtcacaatccagttatatcaagctagcttaattaccggtaccaggccagtataatatatggcatccgaccatgaaaaccacacgaagaaaggaggctggatcactactattccgtttctcgcaggtctatataccatctcccatgcacttgcattaatttcattttgagtaattagctagttattatagctacacattagagtatacacatgcactacatggcttgacacgttaattaagtttcgtcgtacaaaaatttgtgcttttgtaggtgttttaataaaatgttactacgacttaatgtatgtgtgcaggaagcgtggtagggttggggatggcgatgagcgcgacgagcagcaacctcatcgtgtacctggtgcacaagtacaacgtgaaggccatccacgccgcccagatctccaacgtcgtccgcggctgcatgcagctcgcccccgtcctcgccgccgccctctccgacgccttcttcggcccctatcccatcgccgtcgccggcctcgtcttctccctccttgtaagcatgcaacctcatcgtttttttatactccctccgtttcaaaatgtttgacgccgttgactttttaaaacatgtttgaccgttcgttttattcaaaaaatttaagtaattattaattttttttcctatcatttgattcattattaaatatatttttatgtagcatataattttatatatttcacaaaagtttttgaataagacgaacggtcaaacatgtgctaaaaagtcaacggtgtcaaacgtttcgaaacggagggagtatatgtaatcatcgtcgacaccaaataattaaggatttactccctccgtctcataatataagtgattttaacttttacttgcactgtttgaccacttgttttattaaaaaatttatgcaaatataaaaaagaaaagttgtgcttaaagtactttagataataaagtaagtcacaaataaaataaataataattctagaattttttgaataagacgaatggtcaaacagcgtaagcaaaaagtcaaaatccattatattatgagacggatggagtaaatagttaacctgcgtgtggttcgtgggttaataataaccaattataacatactaagtacatatatcaatttttttagtgccatccttaatttattcttcacgggcggtccaaaataatatcgtagtgagaatgtttgaggctgtctcaaatcatataccattaaaccactagtgaaaaactgaaaacctacatttacacgttctattgtgtctcgtcatcaataaaactaatatcgcaacgtaaatgtttgaggttgtctcaaatcataaaccattatatcaccagcgaaaacctatcttctgtgttctattatgtcttgtcatcaatagtactaaggggctaggcggttaacctgcgcgtaaatatcactgcaaaaatgtttgagctgtcccagatcgtaaaccacctttgaaaacgagtaaatccacctgagaaaatatgtctgtggaatcaataatgtcgtgatgcaaaaatgcgcatgcagtcatttgtactgttcacgttgacggccgcgctcccgtcgctactcccgccgccgtgccagcgtggcgccggcggcgggggcgccaccgcgacgtcgtgcgaaccgccgaacgccgcgcaatccgccgtcctctacgcggcgctgtgcctcctggccgcgggcaacggcggcacgcggtacaacatggcggcgctgggcgccgaccagttcgccggcgaggggcagccgcggcggcggcggcagggcggcgggttcttcagttgctacttcgcgttcctgtacgcctcctacgcgaccggcgacacggtcctcgtctacgtgcaggacggcgtcagctgggccctcggcttcggcgtctgcgtcgccaccaccgggctcgccctcgccgcgctgctcctcggctcccgccattaccgccggcccgtccccaagggcagtccgttcacggccatggccagggtcgccgtcgccgcggcgaggaaagcaacggtggatttgggttcacgagtccaatattaccatggatgcaatcgtgacgacgcagtgccacgagctgaccaagctccaagtgacagattcaggtatgcaaataatcaaattcagattgttcaaaaacgtatgtacatgaacgaattttgaagaaatttgttaggtttttgaaccgagcggccatggtggtggcgggggagacgagggaggaggacgggtcggtggcgaagccgtggcggctgtgcacagtgcagcaggtggaggacgtgaagtcggtggtgcgcgtgctgccgctctggtcgtcggggatcctcgtcagcgtgacggtgaacgcgcaggtgagcctcaccgtnctccaggcgctcaccatggaccgcgccgtcggcccgcgcttcgccgtcccggcggcctccatcacggtcaccgtgctcgccgccttcgtcctcgccgccgcgctcttcgaccgcgtcgccgcgccgctctgcgccgccgccggcaagctcgcgatcaccccgctacgccgcgtcgggctcggccacgccctcaacgtcgccagcatggcggtcgcggccctcgtcgagcggaggcggatcggcgccgcgcgcggccgcgccgcggcggcggcggcggtcgtgccgatgtcggtgctgtggctggtgccgcagctggcgctgaccggcgcggaggaggcgctgcacctgccggggaacacggcgctgttctacggcgagctgccggcgtcgctgcgcggcacggcgacggcgatgccgccgctgttcatcgcggcggggtcgtacctgagcgcggcggcggtggacgcggtgaagaggggcacgacgtggctgcccgacgacctgaacgcgtcgcggctggactgcgtgtactggacgctcgccgtgctcgccgccgtcaacttgggctacttccttttgtgcgccaccacgtacaagtacaacaattacggtggtgacgatggcaatgtgaaggcccagacacagactgacgacgtttcatgactgactgtttgacttatctttagtcaaggtgttttgcgagatatatataccttaatctgtacatatatgaattgtgtgcgatagcacggcaatgatgaactggatatgaattgaagctcaattgttatttgaattgaatctgatctgatagcacaatacaaataaagcactcttcaaaatcaaaaaacaaaaagaaagaaatacttacagtccatgacatgtaatgggcctgaatgtaagaaatacttacagtccataagatgtaatgggcctggatgtaagaaatacttagtccatagcatgtaatgggcctaatttaggcccagtaatagattgtacctttgggccgaacctagtgcgggttccactacccactcgtctttcgtgcttcccaagacgagtccgaatccacaaagccaaacccgagcgctcctcctcctcgcaaccccgattcacaaagccaagcccgacacaaacaccaagccaccgccgcctccgcctccgccgccgagagagagagaggaccagccagcgattcgccgccgtcatctccagcttctgcgggagcaacaccgccagcgcgctctcccctccccgccacgcctcgcccattgggattcgccgccctcaccgcgagctcccacgtcgaggtcacacctagggttccatcgccgccgccgctgccgccagcgaaggaagaggaggatacagcgagatggtatgctgataatggattttcttttttcggatttgttttttgctagtgttttgttcttgttaatccttccccttttagaacttagccccaatgtcgccgtgcttctaatttacccttttttgaaactcctaatttgtcaggctgctaggcttctcgcgaatctcctcgtcatcggcggcaccgtgctgggcagggccgcggtccaggcgtatcgccaagccatcgtcagtgagtatcccatctcttcctctcatgagctgttcttactcaatctcaatcttgctgctggtaccccttaacatgctgttttacaaatcgtgattgatggccacagtaatagttgttgttaattggattcgttgtgacctactcattgttgtgcagcgcaaatggtattttgagtactctgaacatacgcggcatgttgcactgttccttgtggtttctttgttagcacggtttggatgctagtatggtggtgctgggcactattaaacacgatttttttgccagtcaaattgaggataccaaaaaataacttactgtcaaattaatggacaagaaataagcacctaacttgatcctgacctgtgttatttttcttgttggcatctgtaacaagcatgtgctatttccagtctgttagtttctttcatatatttatcactaactgcttgtactacaaatatgtgttatgttgtgtattgattattgaagtcatctgatgatttaaataaccatttgataaaatcaaaatgatgccttcaacttgattcagcttttgcatcatggttctttagtagttcagttcacatccttgttatgcctatgtggatcatacaacaattttaggctgtgcttttaacctgtaacttttgatgattctcgatcatgactgagttaatgggatattgcatatactgttccaaatagtttgcttgaagattagcagactgttgattgcatatgattgtgaactgtctgataattttccagtacagatattgttgaacatagctttttcctgccataaccttctaccaatattcatgctaaaacatctaattcttttattattatctaaagcgacatctgtgaatttgtgactgcattgctaaatgttccatggcacacatttttttctgaaaggcaatcaatgattttgcggtccattctaaatgttgctcaacatagcttaagtagcctactttatatgcttccaatttatatggaagcatttgcttcctttgcatctcttttgactataccatccatgccacgcattccctaatgaaattaataataaattctacctttgtcctgtagatgcaaacaaaactggagctgcccaggaagctataaatggtattcgaagggccagcaaggccatgactgagcaagaagcccggcaaatactaggtatcagcgaaaagtcgacttgggaagagatcgtccaggtttgtgacaatgtgctttcattaacttgatacattccagcaaatcaattttctaccaattaagactgttaaaagcacatggcagtcatttgctctagccagaaactagcattgaatttctgtcttgttgaaatactttgcagaaatacgatactatgtttgagaggaatgctaagaatgggagcttctatctccagtcgaaagttcatcgggctaaagaatgtctagaagctgtatatcaaaagcccgacgtacctagctgaggtcgagtagcttgcatttgaagcgtttgagatctatctaattgatcaacctgccagtgtggctgaagatcgcgattattgttaattggttgtaacgggatgtcacttaacttgg

SEQ ID NO: 39471 - DNA, 24093 bp, Oryza sativa
cttcagcgtgtcattattattattattattattattttctttttggtatttttaagcaaaggctaattgctgccatcgtcagcagcctaacaagcagacttgcatccacgaatacgtgaatactgagacttgaatttttcagatttcgagcttctgtttggggtttgaaactcactgaaaactcaagttccaaactgtaacattagtactccctccgtcccaaattatagggcatccttttttttaaaggaaaatcaaactcggtaacttttgactaataatcatactaactatattatgcatgttatatcactaaattcatattttaaagtactctcatgtaatgctaataatttcatatttgttgggatcatagaatggaatacaatactggacaaagtatgttatttaaaaccgtgtaaaaaaatataggcattagggacagagggattatatttcatggaaaaaatatattataataacctttttaaaaccaccaaattaaagtgccaaagattgattgggccaaaaattatacaggctcctcggcccggcccaagccgaggcgtctccttccccttctccgactcgcacatcgccacgtccaactttttaggtttcccctcccctcgcgagtcgcgatcctctcggtcctgacacgcaagcgtctccgccaattcctcgccttttaggcctcgattcgatttgcgtcgggagcttgacgacggacagcaatcgcaatggcggcagggagcaagaagaatccagaaccttcctcttcttcttcttcaggcgatctcggcggcaagaccgtacaagagctcctcgacatggacaaggatgccgtctctgagctagtgtccgaccacttccatcagctgtactctctccagaaccatcttgatgttgatgatgatgatgatgaccattggtctgaacacaatgagcaagaggatcgatctcagttgcaggagcggctagccttctaccgcatcataggttatcaggtagtgtgtgtatctaactatcccttactcttaatcatcattatatgtagatatgatgagccaaatcctgtgtatgtgttttttgttcgatgcatcttctcttctttgtgttaaaattactctatgatgatctgtcttctgttgcagttatcaatgggtggcaagattgacgaactggacattgcaaaactgaaggagaagtactctcctgaaatgctttataacaaggggtatttccagtactatgaggatagtcttgaatggtacttcgatcctgaaagatgcatgttgactagccttgatgactaccagaggctagtgctttgtgataatgtaggtatcgtcgtgtcaaaattttgattcctccatgacaactacagaaattaatgcttgcttatttctgtcagttcttggtacaaccaactgtgttgctataatggacgatgccatagtagatggccgcttgtgcaattaatggaccatgtattattctttgtgtagggtttgtacatggactgggatcaataccactcaaattatagtacctacgagagtgatctagcatatgtcaaattctgtgaagagctagcaaatgagactaaggtatgactgactcaaggtgaaaatactggccatatgccatctaatcatccttgtctgatgtcatttattcacatggcagtggtttgaagattatttggtactcattgctgttaaggataaggtaaccattggtcaggtaaccatcccaaaagccatttgtgcctaataaactgttgtgcaatgtatatttatgttataatgcgtcaattgatggcaactgtttccattgtttagtgggacaaagttaaaaatatagtttaccttcaagcactgaagatcgcactacgcattcgtgttgtttctctaatgcaaattatggctggtttccaggtaatgcctcctgttaattttaattggcaagcataagtggtgatggtatttaacaatagtactatcttctaatttaggaatatatatggagcatgcggtttgattgttgtaactacagggattttgatggtgtgtattttgaggtttggaagcgggttgctaagcaaaaggttagattacttcaatgtgcacaaccatgcaacttatggtgcttctttttctgtccgtcatttgctttatattcttacttagtgacgtataattatgctatttcatcttctatcagatggaattcactgatgctctgtcggaactctatagagaagatatgtttcccttgcgcaatgttgatattaaggatgagcttgacaacattcgagtgagagcgggattccattcgatgaaggaaaatgtaggttcctcttctcagttttgttacatcaggatgattttgaactcgtcaaatcatttcgtcaatccatccatccttatcacaattttgtttctctgttgtccagtacgacatctacgtggcttgcattgacgaaacggtaagcctgcatttgcatgagattcatccctcaactggaatatgttcttcacataaatcacactgatggaacatctatgtgtaggtgccagaaaatgaagctcgtcaattgatcaaagaggccgtcataaaaatggttagtggatttatttccctatcaagcaaacctatcctgggtagtagttgataattttcctaattgattatggtgttgagtgccttctccgaatcggtcctattttgctaattctgaggcgaactttatcttcagaatcgaaaaccagagacttatttggattacgccaggaacaagttgcaaatcgcacaagatatcggtttgatcaccaaaagtacgcatacacttctcaacagtgggacatgatttatatacatctttataatggggacaaatctgtggattctaatttttcttgtattatttacttgtaggtacacaggactagagccaagatcctagaggtcactgcacaaaacaggggagacaatagtgaagcaaagcttgccatggacaactaagcaaaaggtggccgaaagtgcaattcttttgctgtgttcgcgaaaaaaaagatggccgaaaaactattttctttagtactaagaagaaaaaggatattgatgctacggtttattatctgtagttttatccattgttacactctgcaactatattacatcccgatgtaaattgaaatttatgcattggccatatgtcactggaaatctggaatgctaagaatgggactatgggagctgtattagctgaggtctcggtagattagcttgcattttaagatctggggtaccaaattgatcaatctgccggtgtgttataaattaattggttatatgccgggacgtggttcacttagcacttgacacgatacacatcgtggtgcttaattcctgcctttgacatggagaatcaggtgcaaatgtagtgtgatccaatgtatccaccaattgaacagtaattataatttcagggcttcttcacgatgtaggataggaaaaacgtaagaacagaaaaggcataaaaatatgataggaatatatgtgtaaaccaatatattcctcgtgcacaggatttttacaacaaaaaaactttagagtggattccttttttcatgtgaaaacatgggcaaggaatagtgttcctctggaattgaaggtagccaattcttcgaaatgaatgcatctgcagtacctaattcaaagaaatcatcaatcctctatttttcgtacacatttcctccattctgaacgagccctgatcactaggggtgctcctggcgtggtggtttcctgcatgagatgcaatcatttaactacacatcacgatccagcagttatggtcaccaagcgaaacgacatatctacgagctaaaaataaattatgaataaaacacacacatatatatatatatatatattaataatttaaaagtaaaggctgaaaaataattttggacgaaagaacaatataatcaactcaaatttaagggggaggaaagatgaggccgcaatagttagttgtagatgatttttgttcgccttcagtcatataagcgcccgtggcctaatggataaggcgtctgacttctaatcaggcgattgtgggttcgagtcccaccgggcgtgttttttatttcttttttttttaaatcgagggcgtgtattttttgtgggtttgaatgttttttatttctttttttttaaatcgaggtgttttttatttctttttttttcaaatcgagggcgtgtattttttgtgggtttgatactaatattctctactttttttttgtgctcccgaaacatcatcattacttagtagtaccatctagcaaaaaaagagaatgtaattaaagatgacggtaggggcgggttgagtgtaccacaaaaaaagcgaatttcttgaactacttttttcgggtaagaagattaatacgatgacacgacgagtgtgtcgtctttgccatcatcttgcgacgtgcggcgtcgtctaatatgtcatcatcgctctcgtgatggttgctttcacgcaatgttcacctaggagtatctcaatcaaactaatttagcaacatctaaaatattaaattaattttattaatctaaaattgaaaatatttgttttgtattaaattacaattacatttttacatgaatttaattaaaattaaagatgtttaactaacaaaaatatagatttataaacaagggagtactccctccgaaaaaaaaaactaggttttcgtgtccaacgtttgactgtccatcttatatgaaaattttttataattaatattttcattgttgttagatgataaaacatgattaatactttatacattacttatcttgttaatttttttaaatataacggacggttagaaacctagggtttatgggacggagggaggagtaccacataagcagccttgttcgttgaccattcgctaatccagctcctctctctctctccagttcagactccagccctcgtgggttccttccaccacttaattttcagaatataacacccaatacgcactacttctaggatttatcacccaattcgcactgctttcagaatacaccactggaatgcgaattttcttctttccgtaacactccgtcccctagcgtcagtcggcctgtcgtcctccgtcctcccggtgccgttcgtcgtcagttcgccgccgctcgcgcccgcgtcagccccgccatcaccggtccatcgccgcccgcgtcagccccgtcgtcgccggtccgtcgccgcccgcgtcagcccgccgtcgtcgcccgcgtcagccccgccgtcgctcgtccgtcgccaccatcggcgcacgcggtggagggccggcggagaggggagcagcggtggagggcggagggcgtcgagctccagcggcggaggttggaccggcgccggctcggggcgcggtggcggcagcccggtgcggcggcggctgagctcggggacgagctcgctggcgtggggaaggacgagctcgccggcgtgggggaggacgagctcgccggtggggggagtacgagctcgccggtgggggaggacgagctcgccggcgtgggggaggacgagctcgccggcgtgggagaggatgagctcgccggcggccagatttgtgcgggcaaacggcgcgagatggatgaactgacgacgggcgtcgttgggaggacggagtgttacggaacgaagaaaattcgcactctagtggtgtattctgaaagtagtgcgaattgggtgataaatcctgaaagtagtgcgtattgggtgttatattctgaaaattctcccaccacttaattttcacaccacttaattttcacaccacttaattcgagtgtcccccatgtagtacagtagtatcttttccttgctcttccttctgcttggctgtggtggtggctgtggtggtgggcaaagcaagggcaaagggcaaagggcaaagcaagcttaattcgagtgtcccccaacgtacgtattgggtgttatattctgaaaattctccttccactgccaccgcacaagcaagggcaaagcttagcttagcttcgctggtagtggtggtggctgtgccgtccagccgctgccatcttcctcaccagcagcagctagcagcggcgcccttctccggcctctccgtgctttgctgttctttgctttggttcggggatccgatttccattccatccatctcttgctcccgcgggtctcgtctctgtctgtgtttccctggtaagtgctaacatatgcgtctttccctttcttcgggattccttgtttctgttccttaattatttaggaattattttctgctctgttctgcgccaattcaatttgggcctatgtaaatcatgcttttagagctcgtaactggacgagtaatactactagctgaatgatttcaacatgaattttatatatagtttcattccatctgtgttccaacatgtctcgccgcgccttatcgatttctacccatcataattgttgttaaattagggttaagcagcttataaatttattacaacgtttgcttatgtacaagtgcctctcctgtcccccttttgatttggcctttaatttgtagcgcaccatatttcaagtggtcaatccagaacggttctctctctcgaatcgatttttctctctgtttccatccaaattactactaaatgtctgcaaatttagctgaaaaatgtactcctagtttcttctgacatcgataattacttgtggatatgcttgcagatcattcattactggtcatgtggggcgatcggactcatcacaagcactggaatcaagctcatgttccctctggaacttctaaggacaaattccaggccaaagggcaaccgaagtttattcctgacaattacagttcagtggatgaggtgaccaacttaccagcaaatcttttaattagtattcttgtgttcatgtctcaagtctaaacaaattaatctgctacctttgatctctcctttagatataagtttattctccaaaatttcttaccaatatttttcaagctcgaatattcttcactacaggaaaatgatgcctgcagcatctgcttgtacgtaacctgttacctgttttgattttgaaggttactgctgcgttgagagacgctggtcttgagtcatcaaatctgattcttggtattgacttcaccaaaagcaatgaatggtcaggtgatgctacttctgtattgatgttacatacattggctgtttcctttaagccttgctatcaattttactcgaggatccgttttggtttaaacaaacatttttttccctgctgaatttctgtaggcagatattcctttggaagaaaatctctgcatgccattagtgccacccctaatccatatgagcaagcaatttctataattgggcgaacactgtctccttttgatgatgacaacttgataccatgttttggatttggtgatggtaagttatatctggatttcctcttttccccttacaaatttgttttcactagtatacttcctgtatgaactgctactatctaattcattatgtagcttctacgcatgatcagtccgtcttcagcttctaccaagacagtcgttcttgctgtggttttgaagaggttcttgaaagatataggcaaattgtcccacatttgaacctttcaggtaagaagggcatcatccccctttattcagttcagattgtagaatgataacaggttatgattttcacttactattttatttcagtaaccaccaaagaacagttcagtcaatatttagctgttcttttttttttgcggggaatatttagctgttctttcttctagcatggattatgatttagagtaaccaatgttttggtgtgccattttatttgtacaagttgtttttaaaaatattcaatatttcttctatcaaattgttatagcatagtacacacagagttgtccttgagaatgctcagcaatttggaaactagttttcagtcatcacttttgcagctttatttgctcattattcacggcatcatgattatatacttcgttgttctattatttggtcttgatttcattgaattttgaataactcctgtaaatgaaaggtattgtctaatgtagctcatttgctgtgtttcaccgaataataataactcaataagctgtttgtaagtagtaggtaactccactagcactgctgttttgtgctttttgcctggttcattattttgttcgaccggtgtgtgcaggaccgacttcttttgctcctcttatctacgcagcaatttctgttgtcgaaaatagtaacttgcaataccatgtcctcgtcatcatagctgatggacaggtaattgtttacagccactgaaaattacttatatagcattgccagcatgtgacttacctaagcaaaaactgtaggtgaccacctcaaatacaaaggatggaaaattaagtccgcaagagcaagcaactatacaagcaattgttgatgcaaggtaaattaaattcgtccttggttagaacttggtgttaaagttttactgaaacccatttggttgctcagctactatcctctttcaattgtgatggttggggtgggagatgggccatgggatgcgatgcaacacttcgatgactgtattcctgacagagcttttgacaattttcaggtgattataatactactattttgtcatttcaattccgaaatttcaacattgctccacttatgcatgagcaaactgatgattccagtgagaaatcatactacgttgaatgtaaataatctactttctgactagaagagacttgtatagtgatttcatatctatttatttagctagaagttagaaccttactaataaactactgcagtttgtgaacttcacagagattatgtcaacaagtaaggatatgccaaagaaagaggctgcatttgcccttgcagcccttatggaaataccttctcaatataaagcaactcaaggcctccgaccactggagtacttgctcttctcagttcattgcagccctgcattagtttcatagcatccttatcacacactttgtttcttcatttttattaacaggaagcatgcgggtcatgtggccagtcatctgaggattcttcctcctccaaacaaagttcttgagaacgacaacgctgcagcctcacgtcctccaactgcaagctcccagtcaactggcttcggaaagaataccactgatgagcaggtaggcacaatttgggcaagtagctcttgatgagtttaaacatttttttttctccagaactgtggcataactcttattattttcttttatggcatcatcaaggtttgcccaatctgcttaaccaatccaaaggacatggcttttcaatgcggtcacctggtaaggttttctatgctgtggcatgagttctgttggtgaaatcaaattatgaaatctatgctggcatatgtataactatatttctagtgaaactgtaggtgaacatagtggaatcgtattttttttccaaaatttgaaatgattaaatcagtagtagtttgagggattaacagatcttctttacttctgtttgttcaagacatgcaaggaatgtggcccaactctatcaacatgccccttatgccgcgtgccaattacgatgcgtgtaaggctctactcgtgaggtcatctgaccttctagaatgcaggaacaaaggactcaattcaatcagtatagtgtatatggtgtcgaacagtaaggagatgaagaactcggaagcacaaggactctcaattcatgccaagatgcggatggcgtgaaaactatgtgaaaaaaaaggctaaattaaactatgctggattagtttcagtttcaaaggacaggtatatcctttgggatattgtatttgtttctttttcttgtatgtagtaggaataagctgacctgtgatgcttggcccaaagaacttaccgaaggcagttgcggagatggctttgctgctgcattgttgatcttcagagacaatcctaattgggacgatttcaagtagtgaagtaccaatacatcctttccttttgtcttgcagatcaaattccctgtgactgcaatcgacctgttctaattgcagggatataaaagtgtgaaacaatgggagaaacacacggtaccagtcatcttattctgaaactcgtaatggaggtcgatctgaatggatcagctacgttacgtgctcagctcgttgtaatctattttagcagctgattgtgttatttacttcatcttttcaatttctactccctagtttttggtccttaatttttagggcctctaatttttactcatggtgacgtgaacgaatctcagacgtctattttccaatcgaacggtacatatatggtacgcaacatatttttcccggtaacgggacgtttgaccaattggacaaagcaaaatagccgaaaacacacacacatgagaagacaatctttctttatcataggttggaaatgattacattctcatctaaaatttaccatattacattagcaacatttttatttgttgtaaaattctccggcaaaaaacacaagtgagtacccacatgtttgcttcatctccagggatggcgctacctccagactctctctactttgtttcagagacccaccttttcgcttattcgtggaataagcgatacgtcatatttacaaacgaatagtattttgtgaataaaacttttatataggtgttcttaatgatctaaatgcaaaggctgaaaaataaatttcgatgaaaaaaccctcaaaatgagcttcaaattcaaagttgaaaattcaaaatttgattgataagcataagtataagcgaaaagatgaggcccttagttccgtgacaatgcaccggcaaacctatataccaaaagtaaaaaagtaccggcacccctcctcgccgacgtctttgtaggtcttctcgtacttggctttccactccacgacatctgccgggtctctcactcctcgtacggtattgtccatgccgccgccaccatcgccgcactcatgagagtacctgtggaggagaccctcatcgatcgccggcgctgcaaccacgaggccaacgacatcataggtgggccgctttatacatcgtagacagtagtctcatggggtcatagacagtgtatgaatatagactacatagtttaaacaattatataaacaatttataaaatttgataagatagattatgatgatgtaagacactatacaaatatgcaagtctaaatttgatccacacataatgaaacaagaataacattttgttctgcgttgtacagttactattcaccgcctaatttcattttttttgtttctctagttatagatcaaatataatcttgcatgtttgtttatagtcttatatcatctcaattgatgttactattttttaaatttttctataactatttaagttgcatgcaaataacagacaacatggtatctgtgtagaaatttcatgtccgtgggctcatcccaagatccgtgggccgtgtggcttcctcaccgtgggctgacatgccgcggcagccgacttggagcagccccgaccctagctggtttgggtggatgggattgctttcctcggcccgaggacagtatgggcctagcccatccgcactgaaacgcccgctctactgtcgaagtatataaagttcatttctccccccacctatataagccaaacaaaattccgttaaaatcagttttaaatcgaaaccatcaacattaacggcaaatcactgtagcacattcattcaatgcagaaaatataaacacgcggttttgtgttgagcggagagaagaaaataattgggggatcggaagcgtcgcggcgacgctacagcgcggggagaaatctgatatggttgcggcagcttgcgaagcatggggatggcggctggtggctacaggaagaggatggcctccttggctacagaaggcttgaccctttcttcttcttcctcctccgtctgcctcaattcttgctgttgttttacttggtccaagaatccaatctggaagtcgtctgcctttaatattgttgatatagatcgatagatatttccgtatagataggtggggtggcgaagtcgaattcaatgaatttgcgtgcgctgctgaggtcagagggagacagattggttgatggatggatggatggagaggggcgttgccaagtccaccatcaccaaaccccgaatttactacgacattttccatcaccttttcaatgttcttgtcatcactgctcgtgtcacccgtgggccgtggcgaaaagcagaaattattcaggatttgggatttgagatttaagagtttgcgttgtggcagctggtaggaaactggaagaggtcaatcgattcagttcgatgtagtgtactacttccccctatccctttcctacctcttcatggctttatttataatattatactgtactttgctcgctcattttcacacccaagcggccaagcccaacttaatccccattatatagttaatattcggttgattattatctctgcttgactaatactactcaggttgtccttttctacaacaatcctccattggtgtggcggatcgattgattctttctttctgctgcctcctaccagctggtgagttcatccttctttctctctttagttttctgctgagtggtatgcttgttgtatctatcgattccttccctgcatcggtgtttcaatcgacgttatgcacacatgttctttttccataataaacaagatagtacagcaggctttcttcaattctcccttcattcatggtatgatatgctatcgcagcatgattgcaagggattcatcagcaaacacgtacttcgttgaaattttagctttcatctcataacatctcttctttattgatctctaattgaaaaggttgaaatttatgttttattggtgttggtggtcggcagtcgcttctcagctgctgtttaaaaataataagaaaaaaaagatgctcctctgagttttcaaaaattcctagctacactggtgaaaatttatgcttaactttttttttacaactttactttgctcaaaatttaagcagtaatctggtgcatccctgactttatatggtcctctgtgcacttttgggtctggacaagtaaccgttgcccctttgttccatttcagggactggattatgctatcaaagggaaactacatcggtgaattctcaatatcctgccaaactgagcaaattttctgtgtagtagcatcatgcggcagtctcgactcttctatctttgctccattatcttcatgttctactgggtgcaaagaacagaagcacagatcactgcaccttgggaaggtaatatccatcattctagccatactttacctccctcctcttattgagactgatctctacagtctacatgcacatatctctttcaatctttgtgtcataagcgtggcctgctcacttgagacgcataggagagcacaagccatggttctaaatatattagttgttatggttacgttattgagtgttattgatttttaccttgcattatgaagctaactaggtgtaacatcggtacatttggtctgcagttgatgctctgaaagctatcaaaggcaatctgatagatccgcaaggacgtctaaacaactggaaccgtggagatccgtgcatgggaaattggtcttatgttcactgttacaatgaaacagcaagtgatggatatctccatgtattagaattgtatgagcataagtgatctccttgttaactgtgtccttattataccacatttttccgttgcttatcttatggtttgcttttggtgtttagcttatgttaggcgtgcttttggtgatgaatttgttgaatgtcataacataatagatcacattccgccttcatatattctgcattttttcgagatgtaaccagatactttccactgctgctgatagcttctcctttttagaagtagaataatgttactgtgttctttatgttcttatttttttgccttgtgaaaaaaaatgccatgctatttgaatattgattgccttgatggggcaattagtgcagtacaaaaagataaactttgctcgaattttctctctaaagatcccatctcttttttttttcccaagtggatctaattgccgtgatgcatttatgtgattataggcaacttctaaaattgaatttatctggatctttagctgctgagcttggtcggctatctcacatgcaaataatgtaagttggacaagtaactggatcattgatttgttaatgggttagcttttaggtggttggatgcccactcacaagggcgctaacttttttttttctttttgttctttccactgaagggattttatgtggaataacatcagtggcagcatacctaaggaggttggcaacatcacttctctgaaattactgtaagttgaaacccgtattacttcaatttcaccaatacgggtttccttcacatctttttggttagaattgagcctatcttctttctggggcttcttgttcaacttagttttgtttgctataaaactgtagtttaactgaatcagtatcttcatgtccttctggttggatggtgatgttagcatttttcatgagttgtttgttcagattatttttttatgatacagctgtaattgactgaatatatatgtttccattgtaacatgtccttcataatatatatattttttgaaaacaattatttctttgagataaattgttggtaggtgaggtgtgattgttgttgtatcctctgttatctggaatggaatctgtgttttcttgtcacttataggtaagtatgtgcggatgtgcccatcctatttttgcaggctcttaaatggaaaccagcttactggttctctaccagaggagattggtttccttcctaatctggataggattcagatcgaccagaactacatatctggacccatacctaaatcatttgctaatctgaacaaaacaaagcacttgtgagtagcatctggttttacatctatgccaagcatcagggaattattatccttaccctaatagttttccaattttcatccagtcatatgaacaacaattcattaagtggtcaaattccacctgaactatccagattaccttcacttgttcacttgtaagtttctgacaactgcgtctaccatatcggtattctttatttaaactctacttacaatgtaattaatttacagattgttggataacaataacttgtcgggctatcttcctccagagttatcgaagttaccaaaactacttatcatgtacgtaaacttctgtgttgcgatagctctttctttctttctttcttttggttactttggttgggttcaatgtcagtctttaaccaagaactagattgtgtcttgttattgcatgaagtttacaagcagacctttgcctatatgtgttgctttactaaaatttaactagaaatttagcagcttagagaaagagtctttcggctcttcgctgtgctgctctcatttactgaaaagtagctactggtgtgtctcttgaccattgtgattttattcaatcattttcttcactttcttttaaaggatagtctctgatattagaattacacacatatacagcactctctaataatatctgttcaaaataatttcagccagcttgacaacaataatttctcaggaacctcaattccttcatcttatggcaatatcaccacacttctgaaactgtaagtattttcttacctctatctgcaattccacctctcagtgtagttacttcttggctgtgtggatcctagtcatgcagaggctgagtgttctcagtgtaatcgtatcatgtaattgaccgagttcaataaatcttctattatctaagagaaattactatacttctgaaagtacgctttacctatgtctgcgattccacattctgagcatagtgctgagatgaactttgatgtcaatcttggatgtttacgcattgtctggtctcttgaatatttttaggagaaccgcccaggggtcttccggctagctccacaaggtggtgggctagccgggtctcaccccttctatttatttgatattagatcattccctaatattcgcctttttttttctcttgaatatttttaggtaatggtttggctaacattggttgacctggcttattcataacaaaacatatttgcagaagcaaacctgtatcagtgtgcatattatggcagtagaaaggtgtttaagtatatgttttttttttgccatttcaatctacacaaaggccagctctgctgtgcaaaagtatgaccatgttagcatgtttttacttattttagaaatgcatccaagtcactatcattacttgatattataattatccatgggaacctgctcgatagacacatccaaaaatagcttcccttgttcacaaatggctggcatcttagaaaggttgcattttgaatgctttgcaaatcaagtggtaaagttgcatttcaagaatacaggtttaattcagacttctactctctctgtaattatgaaagttttttttgccggaatgaccgaaggaggtcattcaatgaaattaagataggaagtaattatgaaagttagagactaatctattggatatgatcttcatcaggagtttgaggaactgcagcttggaaggacctgttcctgatgtcagtggaataccccaacttggctatctgtatgtgtcgaattccaacactgcaacttcacctttttgggaacagaaaattaccatattcgtagttagcaaaaattatatcatgtgtggcagctttgatccttgtcttatttgtgttcagggatcttagttggaatcagttaaggggttcaataccatctggccgaccagcaagcaacataaccacaatgtataaaaatagagcccttactaacaacttgtcatttttgtttattctattttactaagtatttggcaaacaagctatcatttatatgcatgctcgtacaatttgtgcagagatctttcccacaatcttctaaatggatcaattcctggaagtttctctggccttcccaatctacaaagactgtaagtatgatagtatatctttctttattctatttcaagttcggtgagtacaataggtatatgagtatcattggtagaagcagaataataggatagatctctagagtaaaagggaataactttacaggggagaaaagactagcacttttttacttcataacttttcagtagtgacgattacaatattatgataattatgcataatattagccaaactgatatgacacccaacaggtaaaacttggtttcatctttctgtcttaaacaatagctgcgtgatattgtaccttctttgctcaggtcattggacaataacaatttggatggttctgttccatcagatgtctggcggaatattgatttcagtggaaatagaagtcttatattgtaagaccatgcataatctaccgttcttttcactttctctggaattagttaattgataatctaattctctgtcaatattttgtagggatttccagaacaattctctaaccaatctatcaaatcctctttcaccacctgccaatgttaccatcctgtatgtacttctatttcattagtttccttgttaattaaaatgcaaagtaccaaatccattaatttcattattggaaatatgctatgctggcagtcagagattggtctgatgatctttgtttagtagaggaaacaaagggccctgatctaaggcctatctttttttttaattgtagtttaccttcttcatactgtttggaaagcacaactgaagactattcttgtttgtatttgggaacttaaaagtagactaccttgtaaccacaaaccttagcttattggataaatgatctgtataactaaatgaatgcaacaaaggaatcatctccctggttttcgttgtgaatatctttactaatgccatgactctttaggattgtgaaattggatagttgcacgagcctgtaggtattataagacccttctaagccagtatcatagaaaagtgatgcgaactgataaatgaataggtgtaatttcaagccttgacgtaatgctcaactggagttattttagttaatgttaacatggttgaagatggaggcgatgctatggagtgggtaaagattaatgtgctactctttaaagagagttatgcccgctgtgacaattacaatttacaaagtcatacatgcaatagggttaacacggtgttcagctgtggggaagcttttatctactactgtaaaagcagacttgtcctccttccgtcccttcctcccaccgcacgtgcacagcgtgaggaaaaaatggccaaactggtaaagaaactgccagcccatttcaagtggtatgggctgttgcaatgcatgggcctgttactagtgctttaaaccatctatcagaagaaccgagaatggctttctcaagtcttctttcatggaggagaaatgtccatcctgctatgtgagagtcagaaaaataaggttgatcggtaacctggtgaagtagcaaatgcatgctggagaagtcttaagaaaactcaataggtgatttgatagagacgtgcaaatgctccttgggatagcatggtcgcactaattcaaatgcttattaagcaaatcagaagtctacttctcatctatatttatttcaaatctggtgatcattggttggtgttccacccgaaacaataaaatatgaatgaccaactaaacctttattatcaaaatttgaatacacttgttgcaatttggtgaggtgaaagtctgggagaaaagaatcaacatagtagtaacattggggacatgactgatgtgataattaaaggattttttttgtattgatggtattgtgatgtactctgcaactttgctctttctaaataaactaatggatactttggccaaggttgatatgaaacagaacatgtaagtcacataagaaaatgatagcatgtatgcatttgctgttggagttttgatatcattcagatatatttctagtaccttatattttcttaacatctcatgtataggttatctggaaaccccatctgcacatctccaaatcaactgaacattactcagtactgtcaatcagtgccagttattgtgcctgacggttctgcaagtaatgccacagtttgtccgccatgctctactgaccttccgtttgaaaacatactgatgtcaccaatacgatgtatatgtgctattccactttatgttgattaccggctaaagagtcctggattttgggattttgttccatatgaaggacagtttcaacagtacttgtcatctggactttcattgtcttcttaccaattagaagtttctcaatttatgtgggaagaaggcccacgggtgaagatgaatctgaaactgtttccaaataacactgcttattttaataagagcgaggtgttaagactgagaggaatgttcacaggctggctgattccagactctgatatattcgggccctatgagctcctcaacttcaatccagggtggtataacaattgtatgctatattgactctatacatttccttcttattcttgtattggcatttatctgatttgtaggggttttaaatattcaatatttgatttcaagtatagttctggatctcaccaggattaggatgtctatggtagttaacatgcaaatgaccagtaactgtgagaataagtatgtgaaaacagttggtttgatctaagtaaccaagttatgaaaaatgatgtcggttgtaatgggtgcactatttccactgtgtaatgtctagtcagaacttaacaggaacaaccaatgaaatttaataccctgcctagctaatctaagtttagggactcacaaaattcaattcagagagtcaatgaatttccattcattcattggcatttcaggatttcccatatcattgtacatttggtttagtattcacatttcaacgaggttctcatacaaatcctgaaggaccacccaaaggagtggtgaatcatgacaattcttttactttcttttttatccatccatctaaaagaaagttttatttcttatatgccacaaaaagtttacaaaatttctcattgtcccaaactcctaatgacaaggttgctcctggtccagatgccattgggacagtgggcgatataagggatgaggtaaactgaataataagttttcagactaggatggctgatttggaccttataatgtagagaaaccaaattcaccatttacacatagcttgaggaggacatttgtccccattaatagtagatgcttactgatgtgtcagataccctattccctaataatttgtatcaaccctctgtttccaaagtcaggtcgttttagagtggttgacatgaattaagaaagctgttcaaatgaccttgttgccctgcaactattatacatttaaaatgatacctcatttgtacatgagtggtagaacttaattagcataagaggaatttggaataagaggaactattatacattgaaaagtgcctctaagtcctataacatcttacatttggaatcaggggagtaagatgtaagcatcactgcatcagaaggtggtatactcttgcatcacgacatgccaggccacaccgccacacttgctggttgttgcctgtagctgggattgatttcttgatttcttccatcatccagaagtttcaattacttgtaacttgtgtttcaatgtacccataggggctggatccctggatatacaagagatggctttacagaaagaaagcccctatactacagggaatacactctgcacatatactacttaacaagaagcatgcatgggtggtttctggatatactagagatgaattaacagaaaacaccttacagtcctacactacaggaaaaatacactgtgcacatttactactaaacaaaaagcacttgtgtatggtcaagatatagtgagtctaatgattcagttacagtaccatgcagttcaagtttaattccataattgttaacaatttttcaagagagtaatcttatattttcttatgctatccagtatttccagatcgtgcaaagtccagcctaagtacaggtgccattgttggtattgtcgtggcagcgtttgctgcagcagcatttctttcatccctcattactctcattatactgagaagacgttcaagatattcttcaaaaagacgctctggtaaaccctccatttccgctatcttcaatgaaacagtttctttttttattgttatgttttccatattttatcagttatcttctgttcaatcttcaatatgtcatttttttatcgcatttgcagcaaaaagaattccaatgaagattgatggtgtaaaagacttcagttttcaagaactgtcacatggtacaaacgactttagtgactcagcactaattggtcaaggagggtatgggaaagtgtacagaggtattctctctgatggaacaatagtagcaataaaacgtgcgcagcagggatctcttcagggttcgaaggagttcttcacagagatagaattgctgtccaggctgcatcaccggaaccttgtttcattgcttggttattgtgatgaagaagatgagcaggttgttcctggtacttttttttttcaatagaagtccagggcattagttttgtcgagcgttgaaatattcaagttctttcttgttttcaaatggattataaaaggctgatatcaaaattcattgaaatacattcgctgcgttgaagtacataaatatgcatgcacatgttctcagccgctatcagattttattttggagaacaggtaacttttcgttacctggctttgggagaaagccaaacagaacatagttcagcctatttcagataggtgtgctggaaaatggtagagcagttcagtgcattatttttgttggctagtatattatttttgaaagttcatatttgaccaattttaacggtagaaactgaacagctgcctatcaacttctgttgcggagttggttgtgaatagatagtacctcacatttggttcaacattaattatgatataaactcatactgttaagcatgtattgcagatgctggtatatgagtttatgcctaatggtactctacgtgatcatctttcaggttagaactttatttctgtacctactgacaaagctgctcttcataaaattttaaatattcattaaacagaagtcaacagataaaaatatcataaacccgcagtttctttgttagctagcacgttcttaattactagtagaagaatattagcatcttgtgctaagctccatggcagtgctatatatcgttacttctgaagttatgttgctgttatttctgtgtacctagttgccctaacaattgtctcatgtagcagctcgatcaaaagagcccctaaattttcccacgaggttacgaattgcgctggggtcgtcgcgaggcatcctctatttacacacagaagcagaccctccaatatttcaccgtgacatcaaagcaagcaatattttactggactcaaagtttgtcgcaaaagttgctgattttggtctctctcggcttgccccagagccagaatcagaggggattgctcctggtcatgtgtcaactgttataaagggtaccccggtgagtagctatgccatctgtttgtacatgctctgtgagcaactagttgagcagaagtctgccacatttgccagcacttttatcagtttttacttcagttcatattctgatgtctgatcccggtgttgtgtgcaaccgcatatggtgaatgtgaccagaaacttgttcaacttaggttaatttgattaatggaaagagaactataagttaaatgtcattgcaaagcttgattaattaagggattcttgagcgaaatttcttactattaccaattgataaggattagcacaagcaaaagcaactattttgccttgttttaagtttccagctaataataaattgtttaaagcacagtgttctgcaatggtgttgatggtatatattcctttctttacaatcgcagggttatcttgatccggagtatttccttactcataagctgacagacaaaagtgacgtgtacagccttggtgttgtttttctggaactgctgacagggatgcaacctatttctcatggaagaaatatagttagagaggtatagatttcatgcttccttgcatacaattttgcttatatttcattggaaaatcacatgcggtgcacatgaaagagactgaagtgctccctctgtttcttttttttttctttgccgggtcggctgaagacatggccggccaaatgttatgctctctccgtttcacaatatttggctatttcttggaagtgcaatatgcttaatttagagtgaattgcataacggggcacctagttttacctacgtttcaatttgggctaccccttaaccaatcttttcactttagatcatctttcttttccttttgttttcatcttggacacctatctttcttctccaactccgctatgttagggtctgctataggcgagtggtggagaggtcaacagtgcatgtggtggagagattgaaggcatgctaccattagttgctctagctctatgagaagaaagatataggaggagagctagatgagaacagggtccaaaataaaacaaaaaggcaagaaatagtagtctaaagtgaaaagtttggttgagggttggtccaaagtgaaacacaggtaaaaataagtaacccaatgtgcaatatacttaatttatactccctccgtccctaaatatttgacgccgttgacttttttaaacatgtttgaccgttcgttttattcaaaaacttttgtga

SEQ ID NO: 39472 - DNA, 25114 bp, Oryza sativa
  unsure (1)..(25114): unsure at all n locations
aaaataattaataattacttaaattttttgaataagacgaacggtcaaacatgttaaaaaagatcaactgcgtcaaatatttagggactgagggagtattatttatgtaaactacaagaatcaagtgtgtagtgttttgggatcatactcctaacataattcttgaagaggttgaatagtcctattactactatatatattcgttgtactaggatatgtcacattcagtactagattcgttttttatgggacggagggagtatgcactagaagtagtaaattgatttgatgccctgaaactaattacatatataaatgtttgtgcgtgtaggttgttgcggccaatcagagtgggatgatattgtcagtggttgacagccggatgggatcgtacccagcagaatgcgtggagaagtttgctgcactggcactgagatgctgccgagacgagacggacgcaaggccgtccatagtggaggtgatgagggagctggagaagatatggcaaatgacaccggacaccgggagcatgtcctcactatccttggaacctagcaacacagccaccccatcgtcgggatccaggatgatggtttcatcgtcatctggggttggaaatgatgatcaccatcactacaacatgtcatcatccgatgtctccggcagtaacctcctcagcggtgttgtacctagcatcaatcctcgctgaacattatttgttatatactccatagtgtaagacacgcatgtatttaaagatttaactttaaaaacatctgactaacaagtagtgtaatgtaaatcgaattttatttgctgaaaataatatcattggattggtatttcaatatattttcatatgttataattttgttgctacaaactctatatagtgtatgagaagtttataagttaaaaattagttttgtagatggtgtcaagtttgtacttgtacgatcgataatactccctgtacaatatactactttgctcttgtgatagctagacgtacgaatggctttgacctcctcacatcgggcatatgtgtggtgctcgtccggtccaaatgttgtctgccttagtgccttgtgcatttgttcttaaaccgtttatgggcctttcttttttggcaacaaacagaactttgtttgccctggaaaaaaattatacatacaacctcatatacgaaactttatacatgtaaactttgtacataaaactttggtatgaatataccaattttatacacatgaactttacaccggttttcaaagatgtgggatacgttatacccgatttggcccatattttctgggccgtatctggatttcattcacgtgcggcccaagaatgggattgcgactttccgttccagcctcatcctgagccacagcgagccgcgaaaaattccgccgccgccgtttcgtcgacctcatcggcggccatgctgctccgcctccgtccgccgccgcagccggccgccagcctcgcatccttcctccccttctcccccttcaggcgcttcctccactcgccgtcctggcgccctcctcctcctcctcctccgcgccgccaccgcctcctctccactgccgtcgcctcctcctcctcctcctccaaaggtaacgctgctcacctcgtagtggtcgatggggatctgagtattcgcgaccacatgaaacaagcgaaaacgattctaattgatggatgggtttctgctattctggcattagtctcgacaagtcttgaggagcgatacgatgtgattgtggttggaggaggccatgccggatgtgaggccgcgcttgcgtcggctcgtcttggtgcgcgcaccctcctccttacgcttaacattgatcggattgcgtggcaggtctaacactgagctccattgcaatttttcacttactagatttcttcatttgtgtactaccatatccttccattagaccaaattgtactttctttatgattcctgtatcttggttacaaaagcaaagttaggtagtaaaagatcatatgctaaaaatatgtggtcattgattccttgtggcatagttagttaaaatctgcaatcatataccccatacaacatgaagcaagcaattgaaccatgtttcataagacttgtataagtgcatgtcaaatccacggatttttcttagaaaattatgatatggcatgtatagtggatgaaatgcttacatacatacatttttggaactcatagtacaaggatagtttccaacgtggtatgtcctcagtctaggctataaggatcttagcaaatcaacctttttaacaaagggaacattgtgttactattgtaatatggctacctgtcctaactcttcttttattccttatgttgcatagccttgcaaccctgccgtgggagggcctgcaaagtctcaacttgttcatgaggtagatgcccttggtggtgaaatggggaaaattgcagacaggtacatttaattggttcattattttagatagatagattttcttttcccctactttttggacttttagttggtgtgtaggtctgagagatgaaacctgcaccgaaatcctcaaagatctattgtcatactgattacttcatctcttaggtgctacctacaaaagcgtgtgctaaacagctcaaaaggccctgctgtacgtgcactgcgtgctcagactgacaagagggagtatgcagtagagatgaagaaagttgttgaaaggtcaatatgcactctcgtcttttatcagaatttacaaactatattcgaatttgtttgccttttaggtaaatcaaaagacaccaaactactccctcctgatttctgaataagagcgagcgtgctgtgtaaattctgaattggctggagttattcacgcgtttcagatattcttaagttgtacatggttatccacagagtcacaaggcttgtgttttattagtttaacctatgaagacaacttcattcatttgacatgtgttttgattggtcctgaccaaagactattgactagatgttaattctaatttcttgagtagaggtgaatctgtttctgcatatcttttacctataaattcaacaaatatagttgatgtgttcttgtgatatctagaaatatgttgttgttgaatgcaggtactttagtgtaatatctttcatgttatttactgattattgcatatgctatttttcagcacacaaaatcttttcattagagaggcaatggctacagaggttatgataggccagaacgacaatgttgagggtgtccgcactttcttcggcatggacttttatgcaccatctgttgtacttaccactggaacattcatgagtggtaagatttgggtaggtaggacttcaatgcctgccgggcgagctggagagtcagcttcacatggactcactgaaaacttgcagcagttgggttttgaaactgaccgcttaaaaactggcacaccaccacgaattgatcgcaggactgttaacttttctggattggaaccccagcatggtgatgaagaggtatggaacatctgacaatatgtatgagtgaagttttttgttattcgttatatacaagtgtcatcttccacttgtatctgaaaatgcaaattccgtcattcttatatacttttgcttctctctttcatttgccactttacatttcattgttaaagcaacgccttttgtactcttattagtaagatctagaagcactgtgcttctgttgtgacagttaatttggtttctctctgattagaagtcaaaatttcaaaagcaccccttgaatacagtgttcgttttatgtaatgattgatcaaagttgtgaacccttgtggataattgattcttttgctatcgatctggcacagaaaatagattgaatggactttgcacaatttgaaccttcttgttcaaatatttccaaatgtatgtggtattttctccgatagactttgaacaacatttcctgcacctgtagtatctgctgcatactttgtgcacttagttgcgtttatgaatctatgacttatcagctgcttaagtttgcagttcaagtttgctttgaccatatatgtaaatgttcaaaagatggtttctctttaaacaggttggctggtttagttttgatcctgaattccatattgagagggaccaaatgtgctgctatttaacaaggactacaaaagagacacatcaaattgttagagataacttggatgaaacaccaacttatggtggttgggtagaagcaaagggaccaagatactgtccagcaattgaagacaaggtataattctaccatctgagttttttagtttgttaaatggcagattattctattttagtacgtgtaatcaaacttattattgctaaggaagaggttgttcacgttatggcacaatcatgaggataaccagactatctttgcttcagattgtaaggttcaaagacaaagagtcccatcaggtatttcttgaaccagagggcagagatgttcctgagctttatctgcaggtcaatctacatccagaactccctctatccattcaacatattttatatcatggttgtatttattaatcatctattatggttctcttgtcccctattttttaaaaataatgccttctgcactgttttgcactctctagtcatatttattaatcatctattgtggttctccaatattctatcccccattttattgaaaataatgtcttctgcactgttgtttatcccaattccgaccactcaagatcatttgtacatcgtaagcaggggttttccactgggcttcctgagcgattgcaattatcacttgtgagaacactaccgggactggagaattgtgtgatgctaaggccggcttatgctgttgaatatgattacttgccagcttaccagtgctcaagatcacttatgaccaagaagtttgagggcttattcttctctggccagattaacggaacaacaggatatgaagaagctgcagctcaggttaatttattttctttgctgtgtttatatggttgttcaacaagtttttttgaatcctaagcttgcttacttttgtttacagggtataatttccggaataaatgcagctaggcattctgatggaaagccacttatcattcttgagagagaaagcagttatattgggactctgattgatgatcttgtcacaaaagatcttagggagccttatcgcatgttaacaaggtatgtttttttttctgtacgaatgctattagtatgatggttgtatttttcttttttagaaaatgcaggagaggtgtgtttcatttcattaagaaggaaaaaacaaacacccatacaatcagggctcacaagccctccacccaaacacacccacaaaaacatcacacaaggtgacgcacggccaatgatggttgtattaagctgaagcaattggtgatataactgtgtatcctaattagtactagattatgtgttactctgagaagctaagagtctgtgggcgccaatttgccatagaataatggtcataattctcattagataatgtgtaatcaaatgaactatttaaatggaggggccaatggtaacctgattagagatgtgttgcaataggatgttaatttttgatactctcttcggctaaatatcagaaacatgctatgctttgtacattgtgtaattcattagaaactagaaacttaacacattactagttcaatatgatcagggaaaaacagtcagccggtaagtggctttaccagtaggtactggtagcattatgatttcttgaatcataactttgttgacctttttttttttttgttgctacatacatacattcagccgttcagaacaccgtctattgcttcgagctgataatgctgatagtcggttgactcctttgggacgagatattggtttgatagatgatagacgatgggagctttatcaatcaaagcaagcccggattaaagaggaaaaagaacgattgaaatctacaaaaatcccaggtaaattctatcttttttgaaatgcttcatgaattcatgccaagttttaaaatgctagtaccaacatgcacttgctcagtatagtcactagcatgaattcagatgctctaactcggtatttccgttctcaggaggtgaatttgctgctgcggttacctctgtatccaaccaacctgtaaaagaatcatctacacttgaagccatactgaagaagccacatgtacagtataaacttcttgacaaacatggatatggaaatgaacatttgtctcgaattgagaaagaatgtgtggagattgatattaagtacgaaggttttatagcacggcagcaaagtcaattgcagcaggtaatttgctttgtggatcatgtgcatttgtcctacttcctaagatgcacttataagggaggctctttgaactgaaagaaaaaatgtgcataaacatttaagatgtaattcaatgcatattgaggaacttgtttagctctttggtagctgtattctgttgggcttcccaaattgggagcactagttgattatttatcagcttttgtgtagctgtgttctgttgggcctcctaacttgagagatgtagttgattatttatattcagcaatgtaatatagaattctgatgttgtttcatattcctttgtttaacacctcttgttttttctacctagaagatatgctgacccctcgttttatttttttctcttcatcagattgtaaatcaggagcacaagaagcttcctgaagacttagattatcattcaatgacaaacctgtcacttgaagctcgtgagaaactttcaaaggtgtgtgatcttcttcatgttaagaaccttatatagcagatgacctgtcaacatatataaatgaaatgcattatacggttctctatttgttgacacatgttatctacacctcagtcatctgagataatttgtttttaaaatgctttagaattctcaatatatcagctgctgaaggttctggtgatcatatcttgcctgaaattgtgtcgtgcacacgttatctaagttttacaatttggcaactgaatatcattcatgatctgtaagaaattcaagctgctagatttgcatttaatacaactaatttttttcaccgtgcaatgcaatttatattatgtggtatgtttaggtaaggccacaaacaataggccaggctagcagaattggcggggtgagcccagctgatatgactgttcttctcatttggatggagagcaaccgtcgcatggctaactacaagagacagcaaagcacgttgagatctgctgcgaccaaggcagatgattcttcagacgaagtggttcatgccagtgccaccaatgcataattgagcgccccccgactatatcaaccaactgaattggaccactggacttttctgagccaaaaatgtgtactctctgaagataatttccagacgcctgtggaagagttatacaggacatgcatcaaggcaccttttgctacttgaaggaagttggtggtggcctctgtcagttatggtgtttctcccctacgacgctgaattgctgatgtggttttagaatgtcggatcgtattggtaggatttactatatctttatagtggataagaatgtaaagagcgacaaaaatgaaagtggtagagcagagtagcaatgtttatgtatatatacatctaattcgcgaatgcaagggagcaatgtcatttacagagaagtgaatggtgtatgtaatctgtaaacagaatgagtataaagaggttgcagtatcactgtgtcctatcacagaagaggttgcagtgtctttgtgtcaattgaccattgctgaactgaacaaaacgctactagtttgcaagtggaatgtgcagaatgagtaaaatgctggaacttctgaataacaaacacatggatacactaagtaatcaattataccatgaaatgagcaaagagtcagtaaatcaccttttccagttcgcaagctttatttcaaatcaaattgacagggtaaacacaaaacagaacgtaaaacagattgaagctagaatgaacaagtcacttaatgaggcaagtgttatgtacagaataaatgagtaacatctgaaacttctcaataatacatcattagtctactctctgtactcagctttcagcaatttagcaaagagtcagacaacagtaagaatatatggtctatcgataacattaacatcataggtaagttggatatcagtaagaatctatggataacactaactttctatctaccaccgtccactgtaagaactgaatgcctaaaccccaaattaaaccaattactctacaaaaagaatcccagcactgtcctcattcaggacagcaaccaaaaaattctcctttgtgcatgcaacaagctgttgaacctttgatcatctatcacacacttctgtgtaaaacccatttctcggcagtcagtggacccgggcacctcgggttctgatgcttgtgtacttttgcacattttcctgggagaagctgacgatctggtgcagcacagggaccaacccgactggtagagtagctgaagctgcaagatgggcatgttttacaatctcatcatgcttggtcttctcctcatccttctttctactcatcttctctagctcgattacacggttgtcatggctgtggtgagtgttctccatgactgcaaccatatcaagactggtactcaacccaagttccctctgcagaactttgcgccttttgttataatctcgggaagcatgatcagcttttcgtttctgcctgtgctccttttcctgggtcttcttgtactcatgcacaagcttggagaattggtcaattgtcttcaacacttcattcttggaaaccatctcaatcacttggagccaatcatttgatatgacaaacacaggcggggcgcctagcttgcctggggagaaaggcggggcgccatccggtgtgttttcctcctgcacctcaggctcagtgagccatttcctcagccatccgttcagtgcttcagcataagacctctgtgagctgatccacttgttgaagcagcggtaccattttgcaagctccctctctaattctactgtggctactgcagcagcattggattggctaatggtcactgccttgatcaggtgcattttgctgtcctgaatggccgatagctgcttctcgtgacacaatagaacagctttccacattcttctcaatctgcactcaagacaacaaattgtattcattagatgaaactgtcatcagggtgaagtgttgaagaatagtagtacaattagaaatcatgaagtttcatacccaatgatgagatcaacgagttgaggatatagctcttcatctcgaatattctgtatcttcgatgagaaggcattggctgttctaatattgatggtaatcctggattgcaagttccttactgataacctggtggcgtcgatcgtagttgaatctaatcctcgttcgtccagagattttagcctcctgtacttcttttcataaagaatcctcagcttctcttcatcctagaacaaccacctaaccatcaaacacgtgttcggcggtaaatcatatagcatatgaattaacacctatgctttgttctatgatgcgataactggtgcagagattatgtgtgtaccttaatctcctggtaaagcttcttttcccaagcacatagcttctccagagttgatgagagacttccagcactgtttcttctaccagctactgatggatttgatgaagtgctggcctttccgctcaatgttcttgactttctacgtggcttcggcaggcacgaagatgaaggcacggtcagagatagaggatccatcactctggaagacaaatctgcagagacaacacgagaaaatctataaatgctctagcacacattacctagttgcatcaaaatgatactggtagctagtaagaaacacaatgcaaatgcattacccacatctaagaactcggggcgtggaactctgggggggaaccttccccacctcaagaagcttggaaacttcttcgccgcagttcagcgcctcatcgaacctctccttgatctcgtccatggcctccatgacactcctgttcccctggtgaagcggcgagaacgactcactgctcacagcagtcgactgcacagacttgccactcccaccttccccctgagcagcagcaatcggttgctcaatgccatcgaaggctatacctttcttcttgctggtggagctgccattgttgtcaccactaccactgcccttcaagctggcattctctggctcgccattgccaccggatcccttcctctgcagcagcttcccatcagaagcctcccccttcgagctgacgtctgaagaaattggtctcttccctttcccaccttgatcagcaacgacggaggttgatggtttggatgccttcgccttcgcctccgccgcctcgagctccgcctcgtcctccagctccgggatcccctccaccctcctcagctccgagtaattcgggctattggaaggcaagttgccgccgtcgtggcccttgtaatcctctatgaattgatcgtaggaggtgaaggggtcgaagaagtcccacgccgcgacctccgcggttggcggcggcgtcgccgtctccggcctctcctccgcaaccacctcgccgtagggcccgtacgaatacgtgtacccgtagccaccgtagccaccatagctggcctcgccattggggtcctcgtacaccgtggtgggcacggtgggagagttcctcatgtagtggtagtgatacctcgtcgatgacgcggcggcggcggtggcgtgtttggcggcgccgtgcgcgtccaggtcctcgtcggagagggtgtgcgagagaggcgagacggtggaggacgaggacggcgacggcgggaggctcgacctggcccggcggccgaggcgtcgaccggcttcgccggggacggcgggagggtgagcaccggggaggaaccggacggcggggtgcccggcgcgagcgcggccgccgcaaaccgccgcagcgcgcccccgacggcggcgagcgagcggaagtacgcggcgtgcgcggacgccagcgcgtagcgccggtcggccgcggcgcggatcagcgccgcgcgctcgcggcacagcgcggccgggtcggcctgcgcccgccgcggccgctccaacgaagacgacgacgcccgcgcccgcgccctcgctgcggcgaacgcgtcgtgcgaggtggtgcagcccatgcgtcgaacaccctacctgagcagcagctgcaggcgcggcgcgtgagcgggtcggtgctgtgctccggcggctcgtcggcgtccattacatacacacacacactcggacgccgccggcgaggcggactccgactccgactcctcgtcggcaccggaaattggcggcggaattgggagaggaggaggaggcgccgcgagcgagaatggaaagagtagttgaacctttttttttttctctcccttggttttcatgttttatgttcatctcctttcgctttcacccccttgtgtttcatttaatttagggttgaccactgagatttctttcatacggagtatttcttgtataagtataaatgctcgcaaagtactgaaattgcccagattgcaccgacaaaatttgatgaaatagtttgattagggaaatatggatttgaaaaatatacgaaattgattgtgcatgttccaagctgcatagagatactagtagggttagtaattaatcaaagtgatactatttggaggctatatcgacgttcaaaagaacatacattaaatgatcggcgagagtaaaagggttgcctttacatattaggacatgtttggaatgtggttagccctctatcaattggaatgatacaagacaaatactccctccgtttcgaaatgtttgacaccgttaactttttagcacatgtttgaccgttcgtcttattcaaaaacttttatgaaatatgtaaaattatatgcctacataaaaatatatttaacgatgaatcaaatgataggaaaagaattaataattacttagatttttttgaataagacgagcggtcaaacatatgctaaaaagtcaacggcgtcaaacatttcgaaacggagggagtacgtagtagcaaaattttgtgtaatagttgcatggtaatcttttgatgctcataaattgatatcatgaaaagttttccaccgtatcatgtgtttaggcacgttgtttttatttttaaacactgccgtatacaccttcttctcgaatcttaacttgtgactaacgaatcgataaccccacttacgcaaaaaaaaagctaataagtataagcatagcttaaaaaaaagacatgacacttcgcaaccaccgttttgattacaaacatttggttccatggcttgtccaatgtgtccaagttttagcagaatgtggtagtgaaacaagagtagtatacatttttgcctggaaaaatacattttatgttagtacatctctaatgtgtttcaaaaaaaaagtagtattttttagatatatataaaactataaaagtgagggccctttttaaggttacataacaatgggaggatgcatatgcaaaatttattgtagcaggtgtacttttttttccttccgcgatcgatcgatcactcgcatggacgcggaaacctcaagattttcgtgtacgccgccgccgaaatcaacagcgaaaattacgcaatttcttccatccattggaccaggctgcgtcgtctagatgctgcagtacgtgtgttcttgcttttcagacatgttcttcgaaacagatttgaactcctcttcaaaaacagatggagaatttcagagccaattcttcgtcgtccttgctttgaaacgaaggaacaattcatggcaaaggtgttttgactcctctctcgttcttgctcgtgttgacaacttagtataacagctatgcctacacctagttagtgctaattaaacattattaaatctttaacggtttagaacaactgtgctacaacaaggtataaaaaataaatgcgatgtcttctgtataaacctccaaatggatctagtttgtccaggtcagacaagttcagtcaacagattagaggccaaacaagccacatcaagaagtagaaactcaacatatgaaaggtatatatgaacaatatagaattcgttacgcgagaaaaaaaagagagctaatcaatcgaagtgaattactgagaagactttgacgcatgatctgaagtcatctctccttcgatcgatctgttagtgagttgaacctgacatcagttggagtaataatcaagaacaattggacatactaaaaaggaaataagatttggtgttagttgtgctgctgatgacgataatgggaattaaagcttgcctacacctactgctattcttaagaacaagaacaagaagtgcaatcccttcattttttgggaagaaaatggaaaacgagaaaaatgatatataaaaaaaggcatacacttgttaaataaattatgagggcattgcctcaattttgctggtatatactgtactatatactactactagtagtagtacttattaaagtttttgttaattgacatgtcctagtattattgatttgtacggacttgaaaaatccgtagcaagaaaaggatatgggatctcttaaaaggtatgaggttgatatggtatcccttgtggcacactgtgctttgcttgttacctgagtgtgtttttattattattctttttaataaaggaagtactcttcctatttcgtattataagtcatttttactttttctaagattgtgttcttttcttgtttcacttttgtaacttcctcatttattataagcatgctcactaaactattaaatggaatgtcattaactttttatataaaagtttctttaaaagacaaataaatttattttaagtttataaaaaatcaataattaattgatcatacgctaattgattgctccagtttccatgcaacttaatagctcagttgttttgcaacagctaacgcagcctctaagtcaaatttttataagtttgactaagtttgtagaggaatataacaactctatagtactcccttcatttcataatgtaaggctttctagcattgtgtacattcatatagatgaatctagacacacacatatatgtccagatttatgaaaatctatatgaatgtgagcaatgttagaaagttttacattgtgaaacggaggaagtatgaaattagtttccttaaacttaaatatattttgataatatatttgtttggtgttgaaaatagtgttatatcttttataaatttgatgaaacttaaaataagtttaactaaaaaaaatcaaaatgtcttataatattataaaataaaaggtatgtattactttggacctatacgttaaatatgtacgcaactatatttacgtgcattaggatttaaactccaataaatcacacaaccacaattaatctactactaccacacgcttttacgattgtagccataggattaagacttaagaggatcagagaatcgtcctggtgtgaagggcagtgctccatcgatcgccatcgtctcacgctcatgcaacgcaaaagcaagtacacggcgacggggtatgcatcgcacaaaacacacgtcggtgtacacgtacggcagctagcagtgtgtggaatccagccaaaaagggcacccatcagaaccagatcgatatataagatcatccaacgaattactgcacgacagcccagctctatctgacgatcgattgaccaaatggaaaaaggctagatagtgcgattatatatgcggcgccggcgtcggcttgcttcaccattaattagttagtactccccctgattcacaatgtaaaattttctaacattgaccacatacatataaatattaataaatctagacataaacatatatctagattcattaacatctaaatgaatattagcaatgctaaaaagtcttacattgtgaaacagaggaagcagtactactatatcagttgtaaattgtacttcatctgtaccactttaaatgcaattataagtttttatatccaacgtttgaccatcctccttatttaaaaatttataaaaaaataaaaataataagtcaagcatagattattattcatgttttatcagatattaaataagaaaattttaaataagatggatgatcaaacattggagaaaaaaactcataattgcaccatgaatggagtattttaaaacatgtcatgcaattgtaggaccattaatttcgatcaaattaaacccaaatctcaagtcgaccagccttcgtgcggatcctatcctttattggtactccctccgttttttctttaaaaaaactcaacctccctttctaggttaagttttttgggacggaggggtagatgtgatggatgcatggtggcctacctgtcaaactcaaaactaattaccccaggtccaagtgacatcacacatgtagggattatgcatttccaaaataacttaatcttttatgcaacccacacaccaatagaaaataataataaaaactataataccttccactttatcaaatcttaatataattgtctctcagttgattaccccttccactataattatcctactttttaaaactccataaacaataaaatgactacttaaagatgatcttgttttggacaaataaaaggaaaaaaaaacaatcttatttctgacggagggagtacatatgctggctgttattggccttaattggtgtctcatcagttagagagttaggtcaccaacccacaagtttctttttggctcggggcctatatgtctctttttttgtgtgtttgtgttgttattaatcatctcaatcacacaatccctaaatggctcgcttgtctgcttcagatcatcaaatctgatcaattgtcagttaatcccacttaatcatatgaatcaatcactcggtctctcaagtcttctatatttgaagaacaaattgctaatcagtctcgatctctcaattatcatggaaaaacggacaaaacgtcatcgaatatcactctaaaataatactccattagtttcagttcatattataagtcatgttaggtttgtcttaagtcaaacctctttaggtttaaccaagtttttaaaaaataactaaatacactatacaaatttgatcaatcctataattaattgtttctacattttcttataaatttggttaaacttgaagagttttaaattagggtaaatctaaagtgacttttaataaaacggaggagggagtagaaaacatcacggtatgttattgaaaaaaaaattaggaaatgatctaatatcaaataaacagaagatgtgatgcttcaaacttaggcagctacctcaccatcttgtggagctagatggaagaccctcgagcgtttctcaatgtgttcttgaaacagccggcaatccaaaattggtatatatatataacacataccagaaaatccagtccagcaatttgcattattgacacatttgatctactatcaccatcgatcgatcaagacatgaattcaatacacgtagcgactatattaattaacggataactaatgatcaatgtgttttttttttgtataggtgtgactgatagatgtaccggttgtttatttgatgagtagttcactgataatgaagtgaactactcccagattgtgttgggtgatggttaggagtaatccctgctcaactatcgtacaagtacagtactaatgtactatctacccctcagtccggctggatctcgatcgactgatatacagcttgaaagtgagtgcacattatacacgtatgatcaaataattaatttcatgctactcattctgattaggctattaggatatatatctagtacaacataaatcaagttaaagaaataaacacgtgtacaatatttaagcccagcgaaattcgatcgacacacaggtgatcggtcgttgattttgaaagattgtatttttttttaagacaaggagtacatacaacttataaaccactcttggaagaaacaatggttatgcatattattgccaaccataattaaaggtttagcaatagatcttatctctgtctttaaggagtaattaagttgttattttgtagtttgcagtcgtctatcttgcaatatttgtataattagttgtaacttctaagcaaaaggcggaataaattatatattatcatacgttacttccgacatgcgcaaaacagagcatcatatatgcaatcgaagattagctatcacggtgtttctgtgttggtgcacgtgaagctgtggagctggattagtgatgcttaatgatgcaggccaactccgtcgcaatgatatggaacacaagttaataatttggtctactctggctagttaggaaggaataattattgtggatttcgaaaaagaatggtttaaggcttcctgtttgaatttaaaaaaatgctaaatatgagatatatgcatatcaaaatagagggggtgagatctgaacctaggagctcattagttgtccatattccctgaaaagtcaaaacggtttattagagaataaaaattaatttgtaagtaaaatttttatatatttgtttgttgcgacttgaagaccaatgttaaaaaaatacgttaaaaatatcttaaaattaattttaaaattaaatttgaaaattcaaattttaacttctgctttggcttattaggaccgatggggatcggctatctcacaccttatggttttagccggaagaaccccaccccgagccttttctcactctaattgaatcaaacttggtctagctagagtttgccagtgaattaggctagttcgtgcttctctaatttttcctcaaatatatctggtggttacagagtttcttcgcaggccaaagagccaatgacgaagaagtcaagcattatcgcatcataactgcatctacgtggatccaactgcctatactagctagttgaccttaacaatattagcctttgactttatattttaactttacatcgacgagtctgactttttttaaaaagaaattttctcgaacggattataattatagttatctaggagcaaataattagtattgtcaatccaggaataaagaaaattataaaatggtcagccatttatagagtcaactaagttaagtatttaaccgatcaaaaagtttagattattttgttttcactttctacttataatactaggacccaatttaaaacatgataattgaactgaacctatttgctggggagctcctacttgttgggctctttcttgtttatctgcccaaagctagctagcaactcctacaaaaaggatggcccttgtgtggcgtttagctagttctagactcttggcatgtggcagtttgggaccaataagatataattactgcttgaaaatcactggagtaagttgcaagttaacgcggttaattctatacctcaagtattaaaaaaaaaactactagtagttgtagaacagtagaagtggatcgaagacacacggcatgagcatgacttgaccagcggttggtttgtggctggctgtacatgtgtgtacgttgctggcttagttagttagcaacttgaaccactaatcacgacgatttgtagctgacaaagattatcatcggcaattgcatcttggcattttgggaacgagtcgtagtgtcattgtgtgttttctctcgctgtagtgaacaaaccagataacttaatcactgtgcggggatagctcagttgggagagcgtcagactgaagatctgaaggtcgcgtgttcgatccacgctcaccgcatttgaatttttaatgtcttttgccatctatctgtttttttccccatttctgtcactaatgtaaatttcagttcaccggatttgaattcgccgttctttccaccactagcgtgtttggaattcaccgctatcttgttcgtcatcgtcgtcgacggcgtggctgaccggtgaacagaccagtcccagcggccaaacacgtgaattctccagcgtatttccgcgcttcttcttcgctattgaatctctctctatctctcgtcacgatgagctcatgcccatgacggcatgatggttgaatggttgatcggccgttgctgggctcaatctgctgctcctgtttgggcttggttataagtccagttgctacatatgcctgaacaagggttcgaaacttcgaatacaaaactcattgttttcacacataatttcctctcataataaagagtacagtaagacgaagcacattcatgtcaggtctgggctgtttgttatctcaaagctagcacaggtttcaggtagatagacatataatcttgtgacaaacatatgcacttaggaacaatctgttttctctacaaactcaagtcacagcgatcttcagtctaaccactagtgatgaactgatggctgacattacactacatcaaattgtatcaagaaccaggaagtctatcaatgtgggtgaaacctgctactacctttaccagatggaaacatcgtcttacagagtacaggaactgagacaaatggtcagatgaagactgctcaaaacgaggcataaaatggaagctatcccatgaacccactgataccaagcttgtctgcaacgttgtacatcactagatcgttccaccctggcccaaataatcgctcgccaccaattataaatgttgtggcccaggtgagtagaaccaccgagaaaatggtaaagccaattgctgaccggacaacatctgcaaaagaagctaaaatgtgtaagaaaaatgtagaccacacggttaccacgaagttccataacatcttatgctagtcaggataacatatgcagtagaaaaacttgcaagacatggaaaactcaagagatgaaaagacatatgctcctcatcttggcaagggtttgggataacgctgtatttcatttacaggttgcagggttcagaaattaccccaaggctatggcatttgactaaaccaaaacaatcactttgaaacattgtgatactggatacccaattagttgaggcattttatcccttattgtctgaaagggaatcatcgaatttctagtctgcatgcctcatcaacaaatgaatactatgactacaaaaagaaaatatatctataacctctagaagtgtaagaaagcaaatgccagcacagagaaactgatagaattatctcttctcgctacaaagtatgtgatagtaatagtatcatggtgaaatatctcatctttactgctagcatctggaataacccagcaatgccactgaaaagttacttcaaagtctgttgaagttggtccagattaagatgccacaaaattctcattactatataatcctttttctttactctagtttaaaaaattagctaaaaatttctgcaaactggtaatgtgatgaacgacatgatgatcgcacaagaatgatgctgctatttcaagcaatccccgatttcaaagcattgcacatttgcactatcacgacctaattagtttactacaaactggacagattttgattaaatgttgatgctccaacttgttttcctaagtgtcaagatgaagcaaatgtttccctagattaaattacagcaacattagatttcaaggatcgcagattgttcctttggtgtatcttgtctttactgactttgatcagtgagctttaatcctaaattcaattaccaagtacacacactgctcagatttataggcatcaacagcttacaacagagtgacgtttattctggtgtacaagaaattcttttaatgccaaccaaataattgaaggtcaaaagagagcctagtggtcagattcattagatgaataataataactaactaactaaaatggttcaaaacccccttctcagagtggaaataaccatatcctatcagtatattctaaccaagatagggagtagcagacaccgaatgtgccccaaaacaactacaacaaatcattaacatgaccaagtcgatctttagtaatcagttgccactaacaagtagggagcaacaccctccaaggctccgttagcagcctctgattatagcactaaattctacaccaatcaagatcgtacggagagtcttaagaccagctaatttctgaagaatcgctaaattacagagtagcactcccatgtttgcacaaaattagatacaatggcaatatatcagttaacagcttctgattaataaataataaggacttcattgcatcacagattcacaagatgggttactacaaaacctacgagacgacctagatagatccaagagcaactcaaaccacgcaaacgaaatcgcacaggtgatagatgatgagatcttaggaggcggcggctcacaggggcggattcgggagaaggcggcggaagaggggaaggtcgccggcgagcggaggacgggccagaagtagcagcagttgatggcccagaggaaggggaggcaggcgaacccccagaggaagaagcggcgagcgtggccctccgcctcctccagcggcagccccaggggcccgtccacggtggcccagactggaggcggaggcgcgcggcgcgcggcggcgacggatgggcggcggccggcggcggacgggcgggggaggaggccggattcctcgtcttcgggcactccggcaacccttgcctccatcactgtttttcctcttttctccccttccgcgctacttctctcctttttgtttgtgtgcccctctaaatctaaatctactgtacatcgtaatcgtaatcataaaaatctatagggagtataattttaaattaaacgtcacataaacttaaaaatctttcaaattaattttaccctgcttggtattttgtattgtacgcgtactgaagaaccccatttcatactagaagacgctttgacttttttttctaaatcaaatttcgtttgaccaaatttataaaaatgagagtaattttcacttaaccctatgtattgtggtctaaattgcacaaatcatatagattttagcatgtgccacttaaccctcagtattatagctataaagtttcataaaacaacactatcgatcattttgattttgatattacaggcttttgagttcttcaatcacatcttaaatttatgagtttttttatttatcatataatacatgcttgtaagtaaagccttttaaaattttgatataggagtatgtaaattgattaaggtgtggttttatgaaacttcaggactataatacccgaggttatgtccatctgctaaaatccatatggtattgtataacttgaaccagaataggtgagtttatgaaatttactacaaagaaaacctagaaatctatcacatcaaattaatttcacaatccatcattaaatacacttttatgacatatttgttttgtgttaaaaaacgttgttgcgcttttttataaacttagttaaagttaattaaaaataagttcaaacgccttataatatgaaacggagagtattaattaacccaacaaagaaatggttggttgtgcacgtggatgaaaattcacttgattatactccgggttccgctggatcaaaaaggaaatttcgtgcgagtcttaagagattcaaatatttataaattccccctgcatgactgtttgaaaagcataaggttttatggttggaaaaattatatgaattgctttcgtttaacgtatttcaatagaaagaacatgtatgatctcaactgtcatttcattattatttttccttctaacaaatctaatgcatcattcattttaccctctacttctatcttattttacttcgagccagcaaatccctgtgtttcttgtgaaccatccatacatatttcaaattttcatgggattaactcgtaaaaataacatgcgttccaaaagagcttcataacaaaacaaggtggtaataacatgtgattaattaagttttaattattacaaatttaaaaactagattaatctaatattttagaacaactttcgtatagaaagttttcgcacgaaacacaccgtttaacagtttgaaaagcgtgccacgaatatcaaaaaaaaaatatcctctcttcctagaggattcaaacggggcctagtgatggatttgtgcgtacagaagaagtatgttcattagagtttaaattctgatatccgcagttacacgtacaatgagtattctttcagtagaacttttagttatttcatgcattacgaacgtgtttaaaagagacgttctcatgggtatgtgcatccgttagcctattctatatcagtatatctctaacattttttttttgaagcttacagaatacgatcagatggcacgataattagccatctcaaaaaatgaatctgaatagctctgaatatcatcacttaacttttgttaaatttttcagttcagtataattaatttagatgcggagcaacaggcaacagcaaatcgcctcatattgacatctatatacaacacattgtcatatatcacgaaccgactgaaaacatctgcagattaatcgtcggaagaaccaaataggggaagatctgcaatgcagggaagaaaacaactgaaaaaacgctagtctggcaggccaaggaccgatctcccacccgattgctgagctagcttgaacgcaaccttcgatcctgtgcatatcatattctctcgtagtcgagtttatccgactgtaaaaatagtgttaagattaagtggtcaaatgatggtacattctgcattttggcaatgctgcatgtgtgatggacttagagatactgtaattaccttgatgagcatgtaagttggcagccatgccggtggagttgggattccaacccaagcgatctgtccaaacatatgaatgagattcagaagtccaaatctacaaaatatacagaagaaatgaagtggcaggtgactcaccagggcatactcccctgtttcaaagattttgatgtccaaaacctgcacggtaatgacgaacaagattatgaccgtagctagaacgaagatgttcttactgctaggtttaattagctgaaattaacttcaggttcagtaagatgggctaaataattacctcgccacggtcctcgtatatgtagtctagccccttgaagaaaggcgggtgtccaactgacagatactgaatcaatgaaacaaatttttaaaaaaaatcatgtgcaggggaggaaatcatagactgaaattacagcacaaagagtagaaatgaatgaagcatctatgcagtagcatcgatcagtgtgcttacgttgatgctgttcaagtacttctccttgtcgacgcgcacaatctggcccttcttcactgtggcgcatcatcaaccaaatcaattggatgaaaataaatggattggttaatcaagtataaacaaaaaaacaaacaagaagctaaatggctttgatgcttgttcagaactcagagctgaaatgcaaagttgcaaagcgtattcattactcgagtagacaggtttcttcttgaggatcttcttcggcgccggcgcagccgcctggccgtctcccgccgccgccgcggcgccgccggtggcgggctttttctcctccccggccggctcggcggcggcggcggccgccttgacaggagaagcaacacgtctcctcctcctggctgacgccggccagcacgcggttggcgtgacggagaagagagcgcgcggcgaggagaggagagcttccatggcgagaagcttagctttggcaatggcaatggcaaaaagcaaagtgacgaagtgcacgtaaatatgtgccacatgaattgcacgcggcagataaggtgaccactgggcctgagctagcgctctcagttttgggccaactgtcacannnnnnnnnnnnnnnnnnnnnnnnnnnnnnnnnnnnnnnnnnnnn

SEQ ID NO: 39473 - DNA, 8995 bp, Oryza sativa
  unsure (1)..(8995): unsure at all n locations
tgttgatggctcccctgaaccccttgctcatatctttggatcattgttttacctggctaaattatgttatattgaatggaacatcatattttgttctttctattggtgatatcatctctttttctgttattggtttggtgcttcatccgattatatatgtttttctgtctgaaggctcaatagggataattgaaaaaggagctccagcctccaggcaatggcgttctatggcggtgtgtgcaatattctaattgctaaggtcaatattctaattgctagggtcaatattccgacggacctaagccacaccgctcgcctcacctcaccggcgccgccatctccatagccctccccacgccgccgtgccgcccgcctcacctcaccgctgagccgcctccccatgccccgccttgctcccctctgccctactcctcccccaaaccgcatcttctccccgactctcccaagctcccaacaactgcatcggcacttcgtcaccgcgcgccgctggtttctccgccgccgcccaccccagttcctagccaacgtcgtcgccgacatcgtgcgcactccaaccgttgtctcccccgcttgtgcatgcctcgccgccgatcccgcctacacacgtcgctgtcgacgggggatacccgtagaccggagtattggggtccgttggtacgaggatctacgtaggacgacatcaagcaaacaaaatacaaggattatactggttcaggccccttggtaggtaatagccctaatccagttggtatgggattatatgatggaaaccacatattacaaagggaataacagaactcaatgataccgacgagaccgtagtcgagttggtccgactagatctcccggcgacttggctcctgcatgctccggctctgtaggctatggtgggtgtgttggcgatgatatttggtgccttaggtcttgcccagagggtcccttatataccgcgggtccgttgatctccaagtagaactcggagatatcggacccctcacgatatggtaaagacccagtcttgtccgagtagaactccttccatccgtagatatcatatctatcacgtgatagatttccttaatgtatacggaaactatccgtatacgcgcgggtataccgtatcagtatacaacgtacatccaaggatagagggtataccttatccgtaaccctgacagtagcccccgacttctgcttaaatgagctcatgctatcgatcgcgacttctgatgtcggaattgttatcgctctcatccggtcgatctcggtgtgaaaaccgtagagacaaagagccatcgacaacaccgcgtgaagttcaacggtcatgagtgaatttaaattgaagtctgaaaaactaccacatgcaacggacccaaaattttctggcggcaatctctctcctttccttggaatacgcaccattggaagtgcgtttatttaaagggattttggggatccatttgaagtccgtttgccagaaaactctcctgccttctagcgctcttcgtcttctccgctcctcgcaaagaaaaccctagctcacttccttcatcctgttctccggcgatcctccggcggcaatggaccttgagaagtcttcctcgaacaccgtgtccatgaagaagctgcaggacgacggtgccctccccggccacgggaccatgcagagggaggctggagatacaaaacctgaacccatcttgggcccatggttgtagtcgaagattatgtttcttgcggtttacttcctccgccttccgagtttcttcttcttgtcttgaatttctacggcctttctttgcttcacttgaaacccaactccatcgcttttctgggcatcttccctcgtctttgcaaggcctacatttggggtagtgcccttccttgacctcttccgtttttattacgagctgcgttggatggaatccaacagggtatctggatacgtcgggttccgacttcgggatggcctgaagtcgcgttacatccccttccagtgcccctcttctcgcagcaagtggcggacgagatggttctatctccagatagagaactcggaccccgccctagttattcctgaggaccagccagaaaagatcccagagtggactgctaaacatgccctcaccctcctcacctctgcatccgcttttgtcgcccctctccctcttgtatccgttaactacaaaattgatttcgatttgattgctcctaaacgttactccctcgcgcgccataaaatcccacctacaggacaagacagaaacatacatctgaagctctgctctgtacctcctctcgttggttcctctccgttatgttcctgtgctagcttctgcctctctggttctgatcatctgtgcgtacgggtgctcggggcgagaaggcctccctttttgttttgttcctgcgctagcttctgcttcccctgttctgatcacctgcgcacacgggtgctcaggatgagcaagcctctgaaactccactcgcttgtgtacctgtacgggtaggggggtgatcaagtttttgggtagtgcttttgcgcgctttctcttggctgcaacaactacttcctgcaacgccactcgccactgcatcctcttcgacaatgctctgcactgcgacatcttcttcctctacatcaatttccagcatgtcgaccggaggaggcatcaacggaggatggactagaggagatgagaacgacaacaccaacggaggcaacaacaccgacaaagcctcattcagtaccagagcgttctccgggtatgtgatgttcttcatatttgtgttatacatggtttttgatgatgcttttctagctattagcatgttcatgtttatcactagtatagatcctccaactatgcaaatgtcatgtttagtataatattcttctggattaaaatatgtcgaataacatccatatttccaacagcagataaactaataaatctaaatcaacttcagtgtcagaaaacgatgaggaggtgcaggtagagccatcctctttgttcatctaatcatcttgtgcttcttctgtccagtccacacgccttctgcatttccatcatcatcgaccatgtcagaccttgttctgcaacatctcttccatcaagtcaagccctaataattcagattagtttcaggttcttctggggagatgtttacctgtatgatgtattgctgtgtacttgtaaaaacgatgcaatgtaaatctgtggtaaagttatgttcgatttcactcgaaacaaacaaacaaaaaagttcggttagtgatactatcagttgcaaaattgaccccgtttgtccaaattagacatgaaggaaaggaaaggaaaggaggtcgtctgcagatcgggggctcacctcggattatctcaggtttgccggcgagcggagtcgaactcgatcgaaccctagactgatgatgaattgatgagtgaggaagaagagggggggagggaaatccacagctgcaagcctgcctttaattcggatctgatcgggctcgccgacatgcgcgcccaaactgttactactacttcaatttgcgtttacctgaaactaatttttgaaatgtgagactgattggagcttgttcaaaattcaaactcgtccagtgcttgaaactagcgatcctggattctgaaagttcacacatttcttgggcatagacagactgaaacaagtggaaaaggttttctttgtctcatgggttctttccattttttttttatcatcaaacaccacctttttatttagacgtttggctcagcaatgtcacgagtcaccaggtggtttacaaaaactgggagggggtcgatccaaacatcagactgacccgggtccctactcaccctactgggcaagatcatgggcacaacgattacatctccgaggaacataagagagaacaactttaacaaaatctgcttaactccagtgcaggtccaaaacttgcctttgggtgtatgagcgtgccagttgatttgatcttgcaatcaacaaaaaagaaagacaaagaaaccgcggttaaacccataaacgataaccgaccggctaggtgccgatgacatatcatttatctttgagccgatgttatatatgcatcgatcggcagccattaataagtaagaaagaaccaaatctactcgatcggctgtagatattaacgatatacaatctttatatcgatatatacttgaatcaagtgattgggatagatcggtcgccatgccgagacagtataaatcacttagatcgaaatatatactaacgagaagattatatatgttcatagcatagccgatcagatagatctagcatatatcggctaatactccgataccactctatgttaatatattaaagctagtaaaatataccaaacaaaagcctaatatatttaaatgcaacaagatcttaacataaatgacagatttaacatgtcaataaagcatatgaagaaaatatggttaaatcaggtaagatcggctgaaaccccgatactaccctaatcgacaaccaagaagcaggctagagattgagattctaattacgactcataagatcaaactcaactgatacagctataagtatgaaaagaaggacaatatctagacaatcaaaccattgaaagtgtcatagaatggtagataccttatataatctaagccaacatcggtatttaacctaatcggctgtcctctattggcagatgttagccgactgtaggttagataacgatattgccgaagattatgtaagatatatgataacttgacgaattacataaacgagattagagtatcataaagatggaagcactaatcccgataacgcaagccgccataacaagttttatctcttgttgaagatcgaaaccgatgcagctcaacccgaaagcaagaactcgtcgaaataaaacaaaagcaaaaagggtggcgatgcgccgagattgtattgaacgtgtgttagtttgattacatgaggctcaagtctatttatacccgagaattacaagatatgtccatctcggacacgactcttatctctaacaaactctaagataccataagtctttgcggcagacttttgcccaaatatatctctaaggaaattacataaaatatcctaattaatagatacaattgccttcttaggattcaatccgcgtgtggcaattcacgtgaagcacattaactcaacccgatgatgtacaccgagttgtattgtcggaatcggctgtatcggcttatccagtctgacttgaactcaaccaaccctggtcatagccgatttggactccagccgattcttactctgtttccgaaacgatcttcatcttcgattccgcttcgatctaatctttatccccgatactcatattaccaaatttggtcgttaacactacctcctttatctccttgaacaaaatacctcccgtcgcttgatcgtgagagttcgactggacagcactcaccagaatttttgaatcagtctccacttccaccttaggcaccccaaactcagctactgctttcagagcgaacaggcaagctttcgcttcagcgcaaagagcatcatgaactgaacataaactccctgctcctgctaacagcccctctccttcatgatttcgcaggacgaatccccagccacctgtccgtacaacccgaggctcgtatgaagaatatgaaagagaaaaatattgatacatgatactatctagttcgaattcgaatccgtaaaaaaaaatatatgttaagatacagaaagacttatatccgtccatatgtcccataatataaaacatataaaatctattaaaaattcacctataaatatgataaaagattagttaatcactattttacgagttcatatgtaatattgtataatttttttctcgatgtatctctttaacactttaattgcctcttatatttaatatatatgaattagagatgcaaatagatatccattactgaatctgattcataggaaataatttgacaggatacatgatgagtgatatattatccgacattacccgtatccaacttcaaatttaaaaaaaaatatatgttaggatataaaaatgccataatccgatgtacccgtccgttttcacttagcattactatcaacttcgatctaaaatgttgctagaatacatactgaaatatttttttagtactgtagattttggacaagtaaaaaatatcacatcctctattagtagatagtaaggttgtgtttagttccacgctaaaattgaaagtttaaagaaattggaacgatttgatggaaaagttggaagtttgtgtactactatgtcccataaaaaagccaatcctggctatgaatgtgtctaggttcgttggtaggattaggttttttatgtgatggaggggatatgtaggaaagttcaatgtaacgaaaaagtttagacccctttgattcaaaggaaattcataggaattttagaggatttcattcctataggaatttttcctatatagtcctttgaatcaaagaaattgatcttatggaatcctatgaaattcatatggaatgcctaatgccatgcaagttttggaggaattctaacatgaggtacaacctcatgaaaactttcctttgaatctttatctctcctctaatttttatgtttttcctgcggtccaatcaaacggccattcatgtgtttttcctgtgttttgcaatctctgttttacacttacattcctatcaaaatcctatcttttttctattcctatctttttttctattccattgttttctcattcatacgattcaaaggagctcttaaaatttaaagaaaaaaagttgaaatttaaacagttctaaacctttggacggagatcgtacattgtaccaactgtgaggtggttcagacgttgagaagacagaatgggccgtgtcactgtgagtcgacagatttgcaagaaagaaagaaaaaaaaggaggatcttgtccacatcggatgcagggcaggatagagaagaagccataaagaaagtgcatcatcggtcgcaatggataggaggataggatcgcagcaatagcaataccaacaacgactgacgagtcgacgggaaacggtgacgcggcggcctgagacgccctctacgctgcggctcaacgtgtcacctgatcaacacgccacctcgctaaccgtacggtcactaagcttccccaatctggaacatatcctctctccaatcacgcccatttccatttccagctgctgcatccacctcactgccgtcgccgccgccgccgccgccgccgccgcagcagcagcagcagcagcagctaagctatgagtccaacctggtcgatctagtcgtacataagggtggctagagatcaaccgatggtgatggttggctgcttgatcgccatcttggcgcgttcttgctggcacctcgccgtcgccgccgtcaagctcccggcgctgctctgctgcgacgccatgctctccaccgtcgccttcctcaccttcccgctccgcctcctcgccgccgtcgacagagagcgcaaggcaaaactcgcactggtcttcttggagatttttagttgctgcttttgtggttcctgaatcctttcttgatttgttttagctggatcggctggtgggggagatgcagaggcagatggagaggttggtgtgggagaacagggagctggaggagaaactgggcatggcgctcaaggagagcagggccatggaggagattcttgacgagatggaggaggagcacgacgacgcctttgccaggatcactctcctcgagacccaggtaataaattttaatagtattagtgttaagctgcttagagtgagttcataatggcggcgaactgatgagcattgtgcggcgccatagctgaagggccctcaagctggagaacatgcggctcatcgagccacnnagggggattnaatccanntgtgggtnacaagatagccgccggcgacggcggtgcacgcggcgaagcttaccggcgtccacgagccgcccgtcgaacacgaggaagaggaaggaccgagaagacgaagcagaggaagccgccgccgctcaggaggaggagggcggcggcggcgtcgcgacggaggaggattccgagatgtccgtgcagatgcggcggggcaaggcggtggcgcggcggcggagcctggtcagcgtgggcatggcggcggcggtgggggcggtggtgtgggcggcngacccgccgtgcctgccgctgctggcggggctgctcgccacggtgggcgtgtccatgtgcagcgtcgcgcgcttcttcctcctccgcgaggaggccgccgccgcgctccggggtggcagcggcaggccggcctcctcctcatccgacgccgtcgttctactcagcctcaactggttcctcctcggcgttctcacctcccccatgctccccggcgccgcccacgccgtcttcccgcgcgccgcccgcctcgtcgccccggccgtcgcctggttcactgccactgcgccactctcaagctagctataccccttgtattgtacacgtctcctgttcccgtatgctactactagtagaatatactgactaaaatacactttgtatttgtttttttttctcctaccaagagatgcctggttaatcatacggattaacaagcccttagacttgtctcgtgtgatactttcgcaatgcacaaatccctccgttacgtaatataacgcaatataaagcccataatataaggaattttgaagcttctgtacagattcgtagtttcgtagtaacaaatgtgtcacatctctcatattattacggtacggagggagtatgatcgagaacacctggccagccaaagatatgtattgaatgagaccattagaggcgaaactacgcgtggatatcgttttgagcaagaataatatgcacaagatttatt

SEQ ID NO: 39474 - DNA, 1927 bp, Oryza sativa
aaagtcatgaaaaataataacaatacatctatggttcaggtgtagtggaaactgcaatatagttgtagtcgactgtattcctgtccttgttgaatcgagtctctctcactgcaaccaacttgaccttccaccgctggaataaacttaccctgcattccagaaaaaaaaatatcatgagacacggggtagagttatgcaagacttcataaatttaatcatgatattaacagagctaaaaaaaaggctgacaaatcaatcaacagacaacagatatcgtttgcaatggaggggataaaattatttgaaatatgctcatcctaagaagcaaagatatgggactatgggagaaccaccatggaattactggcgaaacaaacaacacactaattcaaaagttacaacggcatttatgaatttattctaaccgaaggaaaacaaacttcattcttttcccaaaaacaaatagtgattgcatttgcaaaattaatagaacagatagctcaataatttatgatggaataattccttaagacaaagtaacaatgccaacgcaagtatatcttctgaattctgaccaaggtccattcaacagcttaaatagaagaacagttcaagagttgaacccaatgatgcacttatcgaagtaaagacgtggttcttaaaacgccagtatataaagcatacctttctggttcaacagtccttttggccagcatgagtgccaagaacacaggcaccattgcagcagctagatgcttaagagtatgaccgctaacaatttgatgggtccatttatatataggtttatctgcggcctcttctaccttagcaaggaggtaaaatcctggaattgttttgagaaatcagaaaacagaaaaatatggtgaggtgctgattgtgtatgaatttccagaaaaccaatcaattaacttggtcactgcgaatcaatttatgatatgtagaaatagattaaaatgaaaaccatttaagtatcatcaacagttattaggtgcagagaaatgatcaattgaatgattcataatatataggtgaaccacaaataccacatttttcaacctaaatgctaatgaaggtacatagatcaaatactattgatcaagaataacactaacctgctgcccacagccaatagctcgaatgtgtatacattggtggaattacaatagccatcacaggtattgcaatgcatggaacaaactgaattactgcatatgggcgaagatcgtcaaagaacctacataagagttaaggcagcaaaatggaaggtgtgaaagaagtacagaaaatatttctgaggaaggatggttaaacaattggagaagcttgcctccaatacatgatgcttagtgcaccagcaataacaagaggtgctagggactttgttcctgccctatcatcaaccctctcaataatgaaaatggccatgacagatgtgaaagcaattgtcatctacatagaacaagcaaatatgccatcctttaacatattaaatattgataaaagcaagggtgaaaattatgaactgatgacatgctttatgtctctgacaggcaattctgaagaaaacaagccaaatatactagagcgtatcaggcaaaagatccaagtggattagttaccctgttttgattcaagcagatcacacccaacagaacaacactatctaaacagggccatagcatattcagattatactacacaaggatctgagttgaattctatcccaccaaaaaaaatgtatgcattgacattctgagacagcttcaacataatggggtgtgtacaaatcctagagcaaggcaatgtaagtctagaaacaactcaccggcaatctgtcccaaactagtgtggcatcattcggtttgagatgataataggatgaaccaaaagcaacagcagtcacacc

SEQ ID NO: 39475 - DNA, 41989 bp, Oryza sativa
  unsure (1)..(41989): unsure at all n locations
cctccatggctacgtctcgagctcaagtggtgacgtgtccatgtcgtccctgcatgaggtgcacgtggccatacacgtatatggctctgcacagttgatccagcaggtttattttattgatttctttttcgttcattagcagagttgatcagatttcgttatctgatcaagtgctcgagttcatttcatgggctagtgaccctggaagattatggcattgggataatcatgagagatcagcgagcaggtttcattgcatttgcagttcatgacagtttcagataaattaagctctcatgtcagacagtcagcggctgaagctttgtgaacggttaaacgggtactgaagactgcgaatctgcaactagataaacaaaggaagaacatgtgtagcctactaatttatgccattttgttgtggctcttcgtgatatgatggagctgacgcatcagtttcagaaactgttgcgtcaaaagaaaaggtttcagacactggtgtatctgcattctgttgtgctgacgctcaatactatttctcactggaatgttatatacttctggaatattctgttgtgctgacgctcaatattatttctcactggaatgttatatacttctggaattttggtctagttttaatttccctctacagaagatatgatgcttattagtattagcagtatctgtaaaagtttcaacttagaacaaaacgggtccttctgtccaacggggacgtctccgaaactaatcataaatcctgatgacggtagtactcaaaactagtagtgcctaataacgagagtcgtaaatcaacaaaactccaaatgcaattcatacattgtcactggatatattggattcaatgccgatccgggtgtgagagcccacagaggcatcgtgatcgatcataattcgtaatgaactctgatatttaaccaagatcatatggacgctgcagatgcacctccttgacgcaaatatctctccctccctcatcgatcgatccatcgccggcgaagagctaccttagctattagtatcatcgatcatctccggcgagaagacatgtcttccacgttcaacggcgacgagttcgccccgttcttgggcttcatcggcgccgccctcgccctcgtcttctcatgtaagcatccatccacaaaaatacgaacactagccagctcgatcaatcgatcgtagctggcaattggcattgctaattttagagttttcttaggagggtgtagttgctctgttcctttccgctatttagagttgagttgagccgtcttttgtttttcttatgcaggagtcacagtaatcttttcttttgtttttcttatgccaagagtcacagtaatattttcttttagtttttttctttcttgacataagttggtctggctgattgtgtcgtgtaacaaatactttttttctgatgtattgatgtgcaatctttttacacgttagagaaaaaaagatcgtaaaaagctcgatcaaacgatcgatctgcaagtttctgcattacgaattacgaattgatggatgaaatttggttataattttgcaggcatgggggcggcgtacgggacggctcggagcggcgtcggggtggcgcacatgggggtgatgcggccggagctggtgatgaagtcgatcgtgccggtggtgatggccggagtgctggggatctacggcctcatcatcgctgtcatcatcaccaccggcatcaacccgacggcgatgccgtactaccacttcgacggctccgtccacctcgccgcggggctcgccacggggctctgcgccctcgccgccggcctcgccatcggcgtcgtcggcgacgccggcgtcagggccaacgcgcagcagcccaagctgttcgtcggcatgatcctcatcctcatcttcgccgaggcgcttggcctctacggcctcatcgtcggcatcatcctctcctcccgcgccggccagtcgcgcgcccactaatccattacatcgcatctctaattttatttatttttacagtataagtgctactacctctgtttcaaattataaaactttctagcattactcatatttatatacgtatatgttaatgaatttagacatatatatctctagatttattaacatttatatgaatatggacaatattagaaagttgtataacctaaaacagaggaagtattaatttttttactatcggtacagaaactacagatacattaattagttgtattgcaatgtacaacgctcatatcatggatgcatgatcatattgtactctgcagtctacagtattttatttacttagattaattatcccaatcaactctacaaaacattctagtttttgtgttgtgattatacgcagcgacgatagaacagataaacaaagagaagcgagttaatatgaattttctcgaattagtttcttataagagaagtgtaaataccatttgcaacgagtttccacacatgctgatcttggacatcttgaatcaacaccacctcttctactaaatcctaaatggatccaggtattcaacaagaaccaggaccgaaagccccttggatgtcagcaacccaactcctatttgtcaaagcttgtgccactcggtgtaaaacattcgactattcaagcaaccattaaccatataacagccggcaaacatgttgaaaataccaggtaaactgtcgataaattatcatcaacttgtcacattatacaagcaagcaagcacccaacatcgactttattctgttaagtttctcaattataactatagaatctagaaaggcgcagccaatgctccaactctatcgcggggaatgaggcgcaactctgagccatgctttagaaacacattgcctgaacgaaagaaagcagctcacatcagcgagtagaaaagagaatgtgtaaaacttaagtttaaaaaattcatggtactgcatatgcttaagatagatctttcttatgttactgaaacctaatttgagaaataagattactgcacgactgcattttaggctcatccataacccagcaaaaaggacatgcatgtttgggtaaagtatctgcaattgtgtttgctttgtgccacagcccatatcaaactcaagtagttcttttacaattgcgctgatacaactgtaaaattctagttactacaatgtcagcacaaatcaaatggacaattcaagtgcatcaataagcaatgtaatcttctacagtctactaaactatgctgggagcctgggacagcgaagcaggttgttctctaaaacaaaataatgtttcaaatttaaagaattgatagccttatacatagtagtagaaaacagaatccggaaactgtacctgcactttgctgtgggttgatgccaactccatctgcaaaagaagggacacaacattattttcaatatatggcattcagaatcactgcttcactatgagaaaaccataaggcttaaggatcagccatccatcactcaggtcaataatatgttatgaggatggctagcctaataagttcaaggataatccatcaatcactgtagtataacacagcataaatgtatcgtctaaattacaacttgcaaagtaaatgcaaccaacaagagaaatctattagggcaatgagaaaattacaagctgcaacattgccattggcagccgtccatacatcactaatggtgcaagccttccacacaaatcatcaagtcactcttggaacccccaaatcagattgacacagcaccaataaatcagtacacctttttactagagatgcaatccttggcattgaagttcaacatggcatactgtatgtttaaatcaaatatcatgtagtaatgaatattgaatgcaggtttgaacgaacctaaatttcgaactgaattccacaccaattttcccttccaatcactagaccatatacttagcagactcgattcatgagaagcagcccagaaaagctatgaattatcattgcgcgacgcatcaaatcaccaggcaacagaacataacatcgagacatagatcctcttcccaatcgcggtagcggaaacaaaaattatggttcggcgaaacgagagaaaactcatgacagaggccgcagcacggaacggagggggaacacgcgaacacggactcaccgttggtgatgatggcgctggtctggggcgggaccttgaactcctcggcggcgaacttgagcaccgcggtgaacggcgccgcctcgggcacgctaaacctgcaggagacagggcaaaccaaccccgcagatcagaacaagcagagacggccaccgcaaacacccctatcaatcgagagcgagagagagatctgatctgagatcgcgggggtgctgctactcacactttgaaggggagcttggggtcggaggtgaggatgatcttgaacgacaccttcccgcctccggccgcccccgcgccgccgccgcccgccgccgccatgggtaggggttgcgttggtggtgttgggatcgacgcgccgcgtgtggtttcgctcgcttcgacgagacgagatgcgcggttcgaatgagtcgcagcccttcttttttcttcttctgggaaaagaggattcgcgagtttgcgttgcgtgttttctccgggccgctttttacgagccagcaactgtgtgccgtgccgtctggatttttttttcccttcttattattatttttatattacttatattttttcctaaaatttttgatcatgtagtatggttatctgcatgtctactcctatgagatatttttggctgtgtatcaggatttcacagcagttgtttgccttgtttgaactagcacaattgtgaacaatcaggatgcagggtcaggatggttgggctctgatattcaggttccaaaaacacgtctcccatcagcaacaaactgacatgttttcacatccattaacattgttcattgattccattccgaaagatagcaacaacaaggttacacccccaaaattactgcagctatcaaaaaaggcacctttggcttgaagaacaccaggcaccctatgctgcagtgcaaggcgcaaaagaacaaagaaacttggacaaaacttctgacgaataatacatcaagaaaaaggctaacagatgaatctgattgcctctagagaaaaagaactcctgtcctgcaaagctcatttgctagactggcttaagatcatcccacagtcacaatgatcaagcggttggaatctccccttcctccaaatcatcccacagcttaagtggcgacgttatccctgccaattcatcttcatccatcatttcaagatcaaagttgaggaaatcatcaggatttatgtccccaaacaaatctgaataagcatttccgatttcttgctcaaagcccaagttgggaacctctgaaaataaccccagatttttctcggtgtccagtgggtaaactttcatgcaagacttccttttcagagcttcaggagttgaatttggcgtcagcctgctttgttgattatgttcaacctgaggacaactgaagccatcagatgctagaatactgatggaagacggcactaaagaatctgtgttgctatctatcttagatacggttgtaccttccacaggtgtaagattaccaggatgcgaagctgcctggttcttacattctatgccctgcctctccgagatcaccccagcatccccactttcctccatgtccatcggatagactttcatgcaatttttagtcttggaagccccagatgttgtatttggtgccatcttgcttcgttcagttagtgctttttgttgaccatctaatccaagactgcgtatatatgacagcacagaagaatctctcttggtgtctaccttagatccacttgtatccttcgctgaagctaggttagaggcatgtgaagctccacattccttgaggtctataacttgtgtttctggtgccaattctccttcttctatttcttcctcatgaaactcagtgccttctagatctgggctatcggtcgagctgccagggggcttctcacttgcaggaagcttgttgacaaacttttctacttcgaaatcacaactgtctgatggaagaaagacattaatagttgggtactcgacaattttaatgctcctcagttgtggacccaatggttcttctatgttgagttggcgatatggtgaagttgattcctgcagcaagttataagaagctctttaaagaaacagaggacatatcaataactacaacggatgcaaggtaaattggctgcagtactataccttggcagacttttgaatgaacagtttgagatcacgcaaatctgtattgcgatatggtgtgagctgatttttccaaggtccaggactcagatgtttttccaatgatgatagcaagctggtatgctcatctatgctgcgaaagagggcataaaatcagcacagaaaagagtgtgtgtggtgcacacagcttctggtgtcgtgattcatttacatgaaggtcacagaggtaactcttgcaaaatgtaataactttgacaactttctactctgcttccagttctttgtagaaccaattaagcacattaaaaaatatgtgctaacaagaagtgtgataacgttgtatatatactataataaaagttgaaaaaaaatgcagaaaccatttcagaaattctaacagttaatgtacatgtggtgtcataatgtcatcttgaatcagttccaaacacatactattggaacaggaaaaaacaggcgtaaatggtccgtaatctgtactgattgataatcacaaacttacttgtggtcagtcaggacaacatctgttgaattaaatttccattcaagcgtccagtatatgcaatcctttctgcaaaacgatattcatatgcaaatcagcattatatggtacgtacaaggtaggaaaggaaaatatggagcttgacactgccaacacagttcactgggattaatttaggacagaatggctcagaaaggtgaaacgtattgaaaaattccttgcaacagataaagatcccgacccaatacagcattaactaatgaatccatttggccaaaagcgttcaggatggtttcatcttagcaaatatacatttcgttaacagagtacaagcacaaatcattgtactgatgtgaacgaggagaccaaatacatttgtccagcacaaatcatttttctttcaataaaaaaattcaaacgcctccagtgttacttatatataaatttaagagcatttgcaaaaatccatctgatggcatcatatgtcagtatgaaataaggaaatagtaagaaatgatacctgtggttgtgccttgaacggttctgctccctcctggccatgcccctgggaaggaactggagccagataccacgccgctgcgccgccttgcggaggtaaaagagccacttcggaagctgcgcaccgccgaatccaccgtagttgcggccgaaggcgccgatgaggcgatgcgcggactccgccacctgcttcgtctcctccagaaagctgtaatcttaaacacgagacaaaacgaacgaacattacattgttggtcttggccaatcgttgagcgaaaatccatcaaaaagaggagagaaggggattgaacaagtaagagttactaccggacaggagctggtggtcgtcgaagttggcgagcgggacggggtcggtgcgggggcgctgccggtgcaggcggtgcggcgcttgtgggattggacgcaggggaggctgcaggtgaggcgggagcagcccgggcaccggtacttccatggctgctcgccgcactcctcgcacgggctccccttcttgctctcccctcccccgccgccgccgccggcatccggagcgggtggcttccctccttgatcctcctccatctctcgctcgctcaagtcgagagggggtttgcggcgccgcgatttctagggtttatggatggattaatatgaggggttttgctgcgggcggcgccggcgaccgttgccttattaaggcgagcgggtggcggagtgcggcgaacggcgcgacgcggcggggaaagaagaggggagtatttcgtggatttttttttacttgccaatttgatctgaaatctcgcgtcacatcggattttcgcaaaaacttttaaattcaattttctaatatttcattcacttgttcagtcgtttaagaccacatgaataaattgtcaaaaactcccatccctctttattcggcttcggctgtgcaaaaaaccaagacttgcacttaacacaggtcgaggtcggacaagcactggatcgagtttcacgaggaaccaaaacaaatcatccagtaattctacacagcacaactgtgataatcatcaggcatgaaaatgagatgaatttttgattaaatggcagcttgctcataacattctaaaagattctcggtcaaaccaacagattcatttcgagagtgatatctaacagaacaaaaggcataacacagccatgtctagaacaacctcagctacaatttcataaacaaaaattctcattgttcccacaattcaaagaccaacagtgaagacgacccccgcgcattgcatctcataagccattgggcaaaacaatatgctccgtcccgatcaagctttactccatggaagatgcgccaccaccgaatgcgccaccaccgccacgaccaaagccaggtctgctaccctgaacatccaagatttacaaggggtatcaagttagtctacaagcagctacttttatgaatatcactgctgtcaacacaagggttcctgaacatgctatatgtttacatgtcctaacataaaatctattaacacagcctaagatggatactcaacctatacaagcaaggacacaacagtttgaacaaatacaaggatggaaacatgacgtgctaaagttcaaggcaaacagaagaaaatgcatggtctaaacccattcaaatgttccaaattattaagccaataaattatctatgagcagtctggatgaacctagcaatggcatataggtatgcagatggtcattagagctcttaccctaaaagatggctggaactcagctggagcaccacccttctcgccaccaaaatcacctggagcaccacgtgggccacccctgtaaccatccctgtcaccaaacctgggcctgtcaccctcaaagcgaggcgggcctctgccacacgaacagaaaaggataatatcagtgtctccactagagttttcaggcaatacattcataaacaaaagcagccagattatatcatttgagtacatgttaggaagattagatacggtatgtgtaaaaaattgaaatcccaaccaaaagaacaggtctctgttcagttcgaggagaagacttgcaacacagttaaatggtttcaactaattacatcaatgaatctaaatttgttgccacaaatcagccccactcaacaattcagagtcaataacattttttatcaacaaactaataaatgactattgcaaggttcctataaactaatctgatgtccattcaacaatttttacatggtcgctacacaatttgcatatttgaaaacaggaccaccacctaaagaatatccatcacagcaatagcatccaatttccgtattcgcatatgcagatgataaacccaaaaggaataaatgctcacctggggcggtcaccaggagggccagagccgaatgggcgagacgggggcttggcagacttcttgagggtgttaggcacaacctcagatggcaggttgaggtagctgcggaggtgctcaatgccatcattggtcaggtaccagtagtagtgctgccacgagaaggtctccctcacatactcctttgacttgaagctctgcatgagcttaatcacctccaagttgggcacatcaacctttgggtgcttggccaggttgtagtccttcttggcatacaagactccctctgcatatagttgaattaaattagcacttcaactcataacaaataaaggtaccatcattcaggccttcagcaaatacatgaccaatcaaataaaacatgtttcaacataatatttggagtaaatctgggagcaatgtaactgaattcgtcaaacctataaacctcagacagccatagtgaatgaacaattgcagacaatgcaatcaaaatctgccctattggaatcaagcgaatgcaaccacctaaaccctactgcaacaccacatcaagtcgaagcttgcaatcacgatcagcacatacacaatgtacagagtcggcgtatagaggagaagaaagggggagaatctcaccatggaagaggtacttgcagatctcgcggcggttcttcttggagatgatctgcgacacaaaaaaaaaacaaagcgcggcatcgcgtcagacaacggaacgggtagagcatagcggagcaaacgaatgtggctcggtttcggaggtcgctactcaccatgtggcggagagctcgaaccggaggagggcggcggcgccggcggcttcggggccttggggaacgagaggcgaagcagcgaggcggggagaaaaaccctagctttgtgatgggttgatatatagaggccaccacatgggcctccattgtgggctctgtttcgccttccatgtgttctgggcctcaattgactacacgggcctctttttttttcttttcctttttttctctttctgcaaaagtttctcctttctgaaaaagatttcagtcgcctaggtagattttccaatgaaacactctgcagctaatcagaatattttccattttacgaagtgagcacagctccactagttagtttcttgtagtagaatccgcccacctcgatcaagttctaaacttggtacacgtgctcaacatttacagctttcttttagtggtagccgatgtatacgtcgacaacgaaacatccgtgctgacttcgtcaatcttaagatttgctagtacagtttttagagatgctcataggggtaaggtgtgtgtgtgtatatttatagggacgaccgtgcgcgtgttgtgaacgtatgtttgtcatatgcttttttttaagaaaaaaaccaatttgcaaagttctgtggtacattttgataacggactagtctctcttggttgagtacgcatgtgatccgatgtcctttttttcaaaaacaaaaaagagaaaaactcatatatgatgtcaagataattgaaaactgctgaaactcaaaggccccagcgtacggagcccatattgtttcattattttccaaggagcaggaacccttcattttcttacgcatttatagtagagatagagatctttatagggtacgcagtccaactaaatttgtgagtgaataatgataaagttcactctgacaaaaacagtggggaaaaggaaaatttgaggcggtgcaagcccagcaattaacatatacatagcgtgacgcaatccagtgtttaaatttgctttttttaagaccttatcttaagatgtcgacaatagtcgcagcagaacagtttaaaaagaggctaatttgagttggttgggatgctaatactttaattttacacatgatttagccggccgggccctctctttccggcggctttgatatctaaacatgaatctcactgtcaagaaagttgcaatttgccaacctcccagagactcagagtaacaggtaagctgaatttgctggggtgctatctctaatcgtgggaagaaaaggtgaggccggtgacgaaaaggatggaataatggctggggaaaaaaaaaagcagtactatcaagttggttaaaaagaaggtacatagatggtgactacacagctatagccaagccaaagactggttaattagtcaatgggtgactgcttaattgctcagggatatctgttctttgattaatcctggaatctgactgcttagtgtgacctttttttttctcagtggatgcatagtgccatgtgtgatatatactcactaggctgtgtttagatccaaagtttggattcaaacttcagtccttttccatcacatcaacctgtcatacacacacaacttttcagtcatatcatctccaatttcaactaaaatccgaactttggatccaactaaacacagccctatatagaatagcaccgtgctcttctgtcgcaagcgaagttacttagaaattgtcctgaaagctctgtgaccgaaccaatgtctttggatcttttattctgtggtgtttcaggaaaagaaaattaagctagaaagaggattgctcacttccacatacgtgccgctttcacagggagacgacatggataaaaatcatcagtgacaacacaaggatgaactgaagagactgaactagagagacagagaacgtgattaaatcaataaatagcaaagctagtgaaaagtccaaaataaaacaccggtagtttctacatgtaggaaaaggaactgctacgagagtggaagtgtggtgtcctactttaatttaatttgttagtatatcgatagagttggtgactgaaatattacataaacatttgatcatcattaagggcatattctttggtagcttaattaaacccgcttgtttgtttccgcgcaagttgcagtgtcactcactgatcgatcatctcacattctcactgtacagtgccgaacaacgatggctataaatgaggacaccggctggcgcaagttctccacaagccacctcgatcgatctccattgaaatcaaggcaccttaataatttctagtaccatattaagctaagaacagtagtgtacatggcttctcgtagaagtgcagcagctagtccggccatggcagcagcagctgcggtagtagctgtatctgtatacttgctggtgtgcagtgctccggcggcggcgacggcggcggcggtggcgaagaagccgtcgtacccgccggtggcgaaggggctatcgttcgaccactacaagaagagttgcccgcaggcggaggccatcgtgttcagcttcctgcgcgacgccatcggcaaggacgtcggcctcgccgcggcgctgatccggctccacttccacgactgcttcgtccagggctgcgacgcctccatcctcctcaccaagacgcccggcgggcccgacggcgagcagcaggcgatacccaacgagtcgctgcggccggcggcgttcaaggccgtcaacgacatccgcgccctgctcgacagggcgtgcggccgcgtcgtctcctgctccgacatcgtcaccctcgccgcccgcgattccgtcaaactggtaactaactaagttaattgattaattaatatttttttcacttacttactgccactggaaaagtttttcatggaagaggagatggattaaacactactgctatctaaaaagtggagttcatgaatagaggataggaaaattaacttaagtaatgtgggttaggattcaaaatttccgaatgaaattttggtcatattagaccatccgataccatactattttagctaaatttttaatttttaatttttttcatgaattttggtaatatttatttaaatttgaataacatatttttaaaatttcaaaaaatttgaaccgaaatttcgaaaatatcatcatatcggcacccgatacagataccggaaacaaaaagtctgaaccctgatgtgggcactggcgcactgcacgatgctgccgatgcacgaactgtgtttcatccatccatgatccatgcatcttgtttctccaattttctagtatatctcgatctggcagcggacaagagactttcgttgtccggtcctaaattaatcaacagaaatgaccaaagaacatcttacaatataatgatcatccctttaaaattctcttaattaattaaatacccaacaattaattatgcacgcatcgaaaaacaaagggaaaagaatctacgcagagttctgcatgttagaaaagacaattccctttaagctagccttctttagagtgaaagatatttggagatcaatttgcacgtaaattaatctaattaattaagccatgtaactgagtaacaattcccttgaagagccataggaaactataacgcgggataattggactgtcacgatcagtacttctgtagaatttattggcttgcgagaaatggcacaagaagaacaagatagagatgaaggaaacaggaaattgtgttgctgtctcaaccacgtgtggaatcactgtatcatgcccaatggccaaaattatcagaacatcgacatcttaaataattaggacgactaatacgtgtaacagatattaataagaccatttgctgactaggagtgtaccatcgatgttcattaactaattaattatttattaatcaattagtcattacatatcatttacttgctctgttcacgaatataaacatttttaaggagtcaaagcatggattaagatttagatgaaattgttttgatgactagaaattttactaataatgttaaaaatacgttttctaaaaaaaataatgagattaaagatatgatatggtccccatatctttggactttgagtatgtattagactgttattagcgtggtgttgtgtatgtttggtttgtgcatggttacggatgtgcccgtgtaaatcaataaatcttaaaggagtagttggactggaaaagtggtacggagtattacataaatgtttgttctggacaaatttaattaaacgttagaaatgtttacgtctgtgcaaagataaatattaatcagtgaatgttagaacatactccctccgtttcataatgtaagtcattctttgatgcccaattctttgatgtaacccctactctatcaatatacaagcaaagcttttaccctcttttcaagaaaaataaatataaaaaccaaaatgttgaacattgcaattgggtgcaggccggtgggccgtcgtacaaggtgccgctcggccgccgtgacggcctcacatcggcgacgccgtcacaggtgctgggcgcgctcccgccgccgacctcccacgtccccgagctcatcgccgcgctggccaagctcaacctcgacgccgccgacctcatcgcgctctccggcgcccacaccgtcggcatcgcccactgcacctccttcaccgggcggctgtacccgaagcaggacggcaccatggacaagtggttcgccggccagctcaagctgacgtgcccgaagaacgacacggccaacaccaccgtcaacgacatccggacgcccaacgccttcgacaacaagtactacgtcgacctgcaaaaccgccagggcctcttcacctccgaccaggacctcttcgtcaacgccaccaccaggccgctcgtcgccgagttcgccgtcgaccagtcggcgttcttccaccagttcgtcttctccgtcgtcaagatgggccagatccaggtgctcaccggctcgcagggacagatccgggcaaactgctccgtccgcaaccccggcgccgcctccgccgacgaggagctcccgtggtccgccgccgtggagaccgtcgtcgaggcggccgagagcatcgtgctctagacacacaattgtgcgcgccatggacgcgtacgtcagtacgtgtaccgtacgttgaatgtggaaagagacgacgacgactgtggatatatgttggttactgccatgtcgaataaatgcatgacgtcatgacaacctcctttatgatcaatatatatggatgtggattttcatcttgcaggaaacatcttttattgtttgtatgttatctaaatagttattaaaaatttaaaaaattatatataataacatagattattatgaaatatatcactccataaacatacaagaccgaattcaacttctacaaattgcaacaaaaagaacaaattaaattgaacatagttatatatatattcgcagctatatttgttatttttgttacattatagaagttgaatttaaacttaaatgtttacggagtgatatatatttcatattaatatatattgccaaaattttttatgattattttaggtggaatgcacgaatcgagaagatatcccttgagtgataaaaccactttcccaatgtatattgcagatcacttcttttaattaatttaagccaaatttaagatttaattaattaggttggagtggaggcagaagtcacgcacctgtagacacacatgacacatgcgttgagtattaaggcgtacaatatttgtcggcaacgataatagattaataattaattcataagatacctgcataaatagacgtatgtacgtatataccagaaagagagagaaacaacctagtgtctgaaactctaaagacatacgtttgctgcatacatgacaaaaacatcccgatgattacttgatcctgattaggcaatgatcaacaccaatcagtgatcgatcctcgatcatcagcagatagcaagcacatgtcgattgttgctggcagcaagcaagctatatatagtttgtcaccctccaggtcacagattacttcaactgaagaagtatccgaattaacaccaatatatcaaacaaaataaagtaaagtacagtactttccgtttcagattataagacattgtaattttgatcaaagtcaaattattttaaatttgactaagtttatagacaataatatttataatagtaaattagtttcatcaaatcaataatttaatatatttttataataaatttgtcttgggttgaaaatgctactatttttttataaacttaatcaaagttaaagcagtttaactttaactaaaatcaaaatgttttataacggaggtagtaatcaataattaatcagatcgccggcgtcttgtctgctgatggatcatacagtataatggaatgacggatggttcctgtagatggaatgacggatgaggcttgtgcaacagcggcatgccaagacgcacaagacgaagccgccatggtagcccgagctgtggaggggaaactatttcttgatctttcgagggaaggggatatctcctcgttatttgcatatcacttaaataatcagacgacatctaaactaagaatcatatatacatatctatcagtccaatggatcatctacgagaagtcgttgttcatcaggagcaggagggttgccgtggagggtatacagcatggcttttgtgccgcagccggatgccatgaggaagaggaagatggcgagggcgaggaggaagacggcaagggctccatggtgggagcggtagtacttcaccatgaggacgccgacgccgattgtcgtgacagctaggcaggccaagaaggccaccagaccgtagtcgttgtcgatcccgacatcccgctccgccatggcggtgaagtagtaatcgtcatcgccgtcgccgccgccgtcgccgccataaccatcgtagttagggttctctagatcgcccattatttattgttcttcgataataattaattctgatatatgcctctctctgctaatgtactagctagagatcacgatcgatgtatgtgtggttgttgattggtactatttgtttgtgcggattgcaattaggttcgaattaggctcggattatctcgttcaattcggtcacgcatgcatactctaagtaaaacagtcacggatcgatcgggtaccatatatgcttaaccatataccaaattaaataaaggagaaatataatttctaccaacacgggtgttatcgtctcctggctgggctgccctctctcccctctatggcacatggctgcatgattggtggccatcttctagggcttgtttacctgatcatctccgtgccagcttcgactccctggtcctcctagtctcatggcaactgtggagggaacgtaactccagggtccttgactctgtgctctcttcggtcgcagtagtcctagaggtcatccttttggagggccggctgtggtcgttagcggccgtcacttactttggggaattgttgggagcgtagagtggctctgctcccttccgctgtttggagtagagcttttcgagttttttttcctttcctttctttgttttttatctttgttttcttccttacttggcataggccggtctggctgagtgagtcgtgtatcaaaactctattcttctaatatattgacatgcaattcttttgcgcgttcgcgaaaataatttctagcaacaattaatcaatcaaataagtaaaataccctatacctctgtttttaaatagatgaaatcgttgacgttgggaatacgtttgaccattttcatctaattcaaaagaagatggtttttcatccctagatatacccttttaattgcaaaaaaaggttgatatacattaataagagatattgacttaaaaaatatataatgaaactacaaattgtaacaaggtacttttataacagatatatcgcataaaaaatatagaagttaaatttgacttatttgtaacaataaaaaaaataaattaaactaaaacttgctaaaacatacatctagaactatatttgttccttttggttataacttagtagaagttttcgcaaacccgcattacacgtcaatatatattagaaggaacttatataagtcaaattaagttttcgcaaacgtgcaaaaggattacacgtcaatatatattagaaggaacttatatataagtcaaattttacttatataatgttcgtggaatggtatatcatatattaataatggatcatctactacaggaagcctgtaacattgttcgaagggagggtggcaaattgcacgacgaggaagcaacagacgaatgccaagaagaagaagaaaaagaagctgagcacgaggagtaagacggcatccgctccgtgatgggacccgtacgtggtggaagtgcagtggatggcgtagcagaccacaatgcatgtattgaacactcacggatcgatcgagtatactgatcatgtttgaattcggaaaagaaactttcgtcaaaattttctaactagcaacacgattgcaagaatcgatatgataaaaaaaaagacgtgtattttaaatttaaagttttaatttgtgatcatacgtgacaaacagcgccctgttttcatcactgacgtagctagcaactagcttccatccaaagaagaattaagagctagcccatagattgattaatttgtttacattgcatatgtacgtacattcatgtagtgctgaattgaaggtacgttaatcattctcgatcccctcaactccgtgcggactactaatcaacatgcatggaagttgatatatgaaaaattaatcctaaagagagaaatttgaccttgcctagctagcttgtcaagtcaaatgatcattcgtttgcgaaggaggcaacgtaacgactaacgactagctaggtagcatctgcaacgtttgtacgtactacgtagtacatcggatcgtacgtactggccggccggtttgggtgatcgatgaactcgatcgctcgatcacacgcaactgataaaatagaacaatcgatggaagctactagctcacattattgagacaaaacgcaacacaggtagcaatttttgccaaccttcatacagctgcgcgaaatggatgattttgtaggtagtcgattgcgttgacattttgacatcattttgtatatgcgaaaatggattttgtaggtgcgaacgagcaaacgcctataaattgatgaagacactcgcatgcaagctcattcaccccaactccaagacacaaaattaagccgatcgagatggcgagaaaaatgagcagcacgttgcaggttttggtcgtttcctgctgcagcttgctgcttctgtgtgctccggcggcctccgccggcgattacccgccgacggcgaagggcttgtcgtacggtttctaccagaggagctgtcccaaggcggagaccatcgtgaggagcttcctcaagaaggccatccgcaacgacgtcggcctcgcccccggcctcatccgtctccacttccatgactgcttcgtccaggcaattaactaattgattaaaattaattgattatacacctaatcatgcataatgcatgtgcaaaatgatgaaattacgcctcaaacatgctctgaattttgaattctggattgaacagatcgatcgatactatatttaaacacgcatctgtgacgggtaattattcgcgaaccgccactaataattgtgctgcgctgtgcgtgcagggttgcgacgcgtcggtgctgttggcgcgcacggcgacggaggcgagcgagctggacgctccacccaacgagaccatccgcccgtcggcgttgatggccgtcgcccaactccgcgccctgctcgacgacgcgtgcagcggggccgtcgtctcctgcgctgacatcctcaccctcgccgcgcgcgactccgtccgcctggtcggcgggccggagtacagggtccccctgggccggcgcgacggcgcgacgatcgcggcgagggagcgcgtcgtcgccgcgttcccgccgccgagctccaacgtgacggcgctcctcgccgccgtggccaagatcggcctcgacgccgccgacctcgtggcgctctccggcgcgcacacgctcggcgtctcccgctgcatctccttcgacgaccgcctcttcccgcaggtggacgccaccatggacgcgcggttcgccgcccacctcaggctctcctgcccggccaagaacaccaccaacaccaccgccatcgacgtacggacgcccaacgccttcgacaacaagtactacgtcgacctgctcagccggcaggggctcctgacctccgatcaggtgctgttcagcgacggcaggacgaggggcctcgtcggcaggttcgccgtcgaccagccggagttcttccgccgcttcgccttctccatggtgaagatgtcgcagatccaggtgatgacgggagtgcagggggagatccgcaccaactgctcggtgcgcaacgccgccggcggtggcacctagctggagctcaattactctttgctccgatgaagaactcggagcttgcatgtagcacgttttactcggggtggattttaaatttttaatcactcgagagaatattctctcgtgtatctttttcttctaaattcgatacaaataattatgaaaaattctaataaaactagcgaaatgcccatgcgttgcactgggtgaagacaaaaataaatagtaatgggcgtgtgggagcataatgccaccaggttaattgagatccttatagtcaaatcgaatcttttcggtgcaagtaagacgctaacatgacataattattcgttgctctaaatccattcacatggattataagaaagctattaataccactttaaaatgaaattatgtattatacatactaaagtttgaaacccaaaaagtatttatttttgtcatgtattattatgagtcggttgcaatgcatggttatatttttgtacttgatattgataaacacttttttttacatactgcaagagtagtaatagtacaagaaatgtttttcgctagctatcagataaatctcactgtactccaattgcataatcgctttcactcaaaaaatcagaaggaaatcgtacgatgaatggaaagaaaaaaaaaagtggtgtatcatctcactctaaaaaaattagaacaaaaacatacaacgaatgaaaaaaaattgatgtggatgagggaaaaaatctggatgtaaacacgattcattttgttggtgactacatgtttttttaaaaaacaaagacacgtgattgttttctattttctaaaagtaatttattttgtcagtaaataattcattttgttggtggttacatgtttttttaaaaaagaaagacatgtgattttttttttactttcccaaaataatgaaattgttcctttttttaaatccaattcctagtagacacagatccaaacacaaactttatttagtgttaataatctcaggcaagcctcctatttaggtggtattattcgtgctacagtgctcggttactactatatcacgcagaactatgttgtgctgggctgctgcttctctgctctgtaggctggctgccgggctgctcgctaggtttctcttttttttttccattctcttttatttgcggagctcagagatcgtcgtaatgcatccggattcacggattagcggcgaaataatcacgtgggcccaccctttaatgacggaagaaaaaaatcaaccgaaaaccttacttattttttaattaggtatagatatagatatagatttgacaatgtagagtatagtgatatctatcggtccaccaaaaatcaagctaaaatttgacatacccactaagattaaaaaaagagagacaaattttgtatacaatatgctactattcataagtttgtcttttctatatgtcgatgtgtgagttgagtttggatctaaaattttgtggagttgtatagatatgttgtacgaacattatcaaattttatataatttttttataactgtttggatgatatttttttaaaataaccgtttgggtggattataaaatgcagctaggcagctagcatccatcaaaatagtttccccgctttatgtacgctcatcggttgctagtctgttaatgctagctgcattttataatccgcatgttagttcagagatcaaactttgatatttgaaggaatgaataaaataaaatttgtttgggaatcgattgcttatgcaccctgcgaaaaagtggcggttcagccttcaaaattttttgggcctactaacttcgatgggccgttttttttagcccatgcagaagacagaagtgtaggacattgacgtgacaacctaaccatgcacatattggatgcatgcgcatattggatcacatagatatatgcacagacaggggtggatccaacgtgggtgcggggggtttcgagtcccccctacacccacaaggcccatggatacctcccagagcatcccctttaatttttttaaaatgaatgataaacttaaggcttctaaatggctggaggttgaacaaactgtgtaattgagcccccctcctcccaatttttgttcttggatctgcccctgtgcacagaggatggagtatgtgaagtgaaggtcaagagttcgtcaggcatacaattacggctgtgttcgttactactggttgggaacaaatctcttggcacataaaatggagcggctcattagcagctactccctccatttcaggttataagacattttgagtttagtgaaagtcacactgctttaagtttgaccaagtttacagaaaaagtagtaacatttttaacccaagacaaaattattatgaaaatatattcaattattgatttgatgaaactaatttagtattatcaatattaatatatttgtctataaacttaatcaagcttgaaataatttgactttgagcaaagtcaaaacgtcttataacctgaattggatggagcatttttttgaaaaatagattaatatgattttttaagcaattttcgtatagaatttttttgcaaaaaacacaccgtttagcggtttgaaaagtgtatgtgtaaaaaacgaagaagatgagttgagaaagctaggaaagaagtcagtctaagctcgtcggcatagcacttaatctgctttacctgagtggtggccggtcctggccttgtacaaggggctgacggcctgaggctgaaccccgtgaaacaccaccacctcttcttcaacagttcaactcgagcgggggcgatggaaaaagcaatagcaggggacatgaatattccaactttccaggacatctttctgaattctgatggtggtgggcaatgtgagactgaaaaaaatcgatatgggagagagagagaggtcagaaatggagatggaggggatgataggtggaacccactctattttttttaatgattgggatgtcacgtgaacaccaagtcaacgaaaaaccgcttttaaaaacagttgatgtagtcattttaaacggttttgatagttagaggggtcgatttatctagttttatggttgaggaatatgaatcggattcaatttatatttgtgtgagtagttaaatttgcttgtgtttttctttcttcatcagcttattcttatttttcaatgatgataaactgatcagcgtagccgccggcccgtcgcccacccttaaacaacgacagctaatttatgcatgcatggattccgatggaggagctgtgtgcaccactcattcgtaagacttctttcgaataattcaacggaagaaggttgaaccatttgaagcgaatcacacattattgatctttctctccaaagaatcgtgctagctcgttggaaaaaaggggaaaaaaaaacggcgagcctagctataattcaatttgcgagattacacatatgtgaaaaatcgccaagttaagggtttttctttatacataactaaatttgctactaatccttatatagccgcctatgagcatttgtgcattgtactatgcaccaacctccacttgtaaagtttcaaccaaaaagaaaaaaaaagccatccacttgtgctgccaatttgctcaatcccgacaagctcgctcgatcgttcgccgcatcagccagtctcagtccgctgcaatttgttcgcgcatgcgttcatataatagacctatcatagatttttcgacgattccaacgacctcgtggaaaaatcgcagatgcacgcaccaaatccatcaatttcatcacgacactcgcaagtagtgcgcgtccgctataaaagcgatggaaatcctcggaggacggcacacggttgatcgatcagtacgagtacgacgagagctaagtaaacttagctatatcgatcgaccatggcgtccaggactagtgctactgccggcatgctgctgctcgccgccgcggctgcgctggtgtgcagctcggcggcggcgaggatgccgccgttggcgaaggggttgtcgttgggctactacgacgcgagttgcccgcaggcggaggccgtcgtgttcgagttcctgcaggacgccatcgccaaggacgtcggcctcgccgcggcgctgatccggctccacttccacgactgcttcgtccagggctgcgacgcctccatcctgctcgacagcacacccaccgagaagagcgagaagttggcgccgccgaacaagaccctccgcaagtcggcgttcgacgccatcgacgatctccgcgacctgctcgacagggaatgcggcgacaccgtcgtgtcctgctccgacatcgtcaccctcgccgcccgcgactccgtcctcctcgccggtggcccgtggtacgatgttcccctcggccgccacgacggctccagtttcgcgtctgaggacgccgtcctgagcgcgctcccgtcgccggactccaacgtcaccacgctcctcgaagcgctgggcaagctcaagctcgacgcccacgacctcgtcgccctctccggcgcgcacaccgtcggcatcgcgcactgcacttccttcgacaagcgcctcttccctcaagtcgaccccaccatggacaagtggttcgccggccacctcaaggtcacctgcccggtgctgaacaccaacgacaccaccgtcaacgacatccggacgcccaacaccttcgacaacaagtactacgtcgacctgcaaaaccgccagggcctcttcacctccgaccagggcctcttcttcaacgcaaccaccaagccgatcgtcaccaagttcgccgtcgaccagtcggccttcttcgaccagtacgtctactccgtcgtcaagatgggcatgatcgaggtgctcaccggctcgcaggggcagatccgcaagcgctgttcggtgtccaacgccgccgccgccggcgaccgtgcttggtccgtcgtggagaccgtcgctgaggccgccgagagcttggtgctgtagggtgctaacaaggatggctagtttaattaagcttatttccttgataaatattttgttgcttccaaatgtcatgagtatgtacacttgcgtgtattttgtagcttattttttatttgcaaataaagttgaatatatgaaaactatttaaatccctcgagaggatatcccctcgtttgcttaaaaacatcaaaacggttatgaaaaattctggaaaattttgacaatattcatataacatatctatacagctccacaaaatcttaagtccaaatgtgattcacacgtcgagatataaaaagacaaattcaacctctacattgtttttttttcagaaattttcacaactatttatatcaaatttgaaagaaaaaaggtgtacgaggggatatcccctcgagggatcagaatctactccccaaatatataggatttattggatccatgcaactttggtgatttggaaatcaaccattacaattcaagaaatcacctagtataggagaaccttggctattgattttgcgtatagtaagccaaacttaaccttaagtagaaactaagcaatctaacaaacaatgtgggtggctaatcattttttataaggatatttttttacctggcctctacatccaaccagatatatgcagtctttttaaattaggaacttatcctatcaaacaaaaaacttagccctcaaataacccaatctgaaattcgtttcaataaagatttgaattcaagataatcatgttcatgtttgagctcgatcggaatcacaattcagatgaatactgaatttaaaatcaaatcaaaattaaatcatcagacggcgtctaatggatgatcaacagcagcagcaaccctgtcttcttccaggggaaggctgccgtggatggcgagttgcacgagacctatgcaacagaagcacacggataggaagacgaagacggacagcacgaggaggaagacggccagcgctccatggccatggtgggagcggtagtagagcaccatgaggacgccaatggcgatcagcgcgccgggtaggcaggcgaagaacaccgccgcgccgtagccgctctcgccgtcccgctccgccacggcggtgacggtgatgccgccgccgccgccgctttgtacatcggccataatatattactgtatttgcttcgataatttgattcgattcgatgcctcttgtttctcttgtctgtgcggattgcaagcagtgcaagtcaattctgtaaaaataaaaaaagttgcagggtaagtcagttattcgattcggtcatggtgcgtttcgaatatccatactgatcttgtttgagtttggaaaggaatcctctagagaaattgaggaggaaaataatttccttgatagcaaacccagatcgataaagaaaacaggacatgcatgcaccttccttggattatatctctagctaggaagtggataaaacgagtgtacatgtccactcgagtgataaaggatcaccaaatcctctccctagtttcttgatcagcaaaagtttgttgcttccattaatttgccagtacgtacatgcgtgcgtgtattcttgtagccttacatcttttcaaataaagtcaaataaactgaaatctggtatgtatcttttattacaaacacgtaaaatgagactattaactactcatccttttaacgtttaatccatcttaaaaactctgtaatgcacacaaacaatgcaacggcagtgtatcaggggacagaccggccggccggatgaatgatgggcacggtgactactagtgtggctggactggtacagtagttgctagtggctgatctgcaacatagcgccaggtgcaacctctctcatccgccacgactcagtacgtgtacgctcttgtgctgcacaggcggaagaggattttgattccctcgagttatttgcatgtcactcaaatggttataaagaaaattaaaaaaattagaaagatatattaacatgtgatatatcactccataaacatgcaaataaaaattcaacttctatatctcgcaaaaaaacagatttgactttaaatatacgttaactagctgtagtttaatttgtttttttgttacgagatgtagaagttgaatttgaacttgcatgttcgtggagtgttatatcacatgttaatatacattctcaatttttttataaccatttaagtgatatgcaaagaacaagaagatatccccttgagggattagaattgtttctatgcacagtgatatgtgaaccaacaagattgttgtcggactaatgcctcactgcttggtcaatgaaagtggctaaaaccacacttcaatttgtgcaccatgcatgacactcagattattcgatatatctgaacgaacacgtacaacctactcgatcatatgatgctaaagtagatgagaattttcagaatatgccattcaattcacatcatcttcaagatttttcacttaattcttagcactttcagatcatgccaccgaggttcttagtttgctgcgtttatagcaaacgtgtacacggtatgggcaggaacagcagagtggtcgacgtgtttggccaagagcgctaccctgcactcccaactcctggagaaaccgataaaatcaacagtacaccgacacccaggacgtagggagataggatcggttgttctcttctcgcccatatcttgcatctcacaaagcatcctgcattcacctacgtcaacatgcatgcatgacaagtttgattaataatattttaaatgtccaaaaacaaaatccctatcaattatgaaactattttgatccatccataaatattccctcgttatttacatgtcacttaaatgatcatgaaaaaaaattaaaaactatagagaagatatattaatatataatatatcactctacaaatatactagttcaaattctacatctcgtaaaaaaaattaaattacagccagtgaacatatactcacagtcaaatttgttttttgactgtgagatgtaaaaattgaatttgaacatatatcatatgttaatacatcttctcaaaatttttctagtaacatgcaaacaacgagaggaaatcctatggagatatcaaaatatactcccctataaattgaagcctacagctgcgtatgttcagtacgagcttacacttagagcagtagaaatacaattacgggaggaaatggcttctgcgacgacgctggtaatgctggtagctgccgtcgcttgcctgtgcgctccggcggctgccggcgacggcaacgccgacgcgacgcggcagccgccggtggtgagtggcctgtcgttcgacttctacaggaagagctgccccaaggcggagtccgtcgtgaggaagttcgtcagggacgccgtccgcaaggacatcggcctcgccgccggcctgctccggctccacttccacgactgcttcgtgcagggctgcgacgcctccgtgctgctcgacggctccgccaccggccccggcgagcggcaggcgccgcccaacctcacgctgcgcccgtcagcgttcaaggccgtcaacgacatccgcgaccgccttgagaaggcgtgcggcgcctccgtcgtctcctgctccgacatcctcgctctcgccgcccgcgactctgtcgtcgcggtaaacgtataaatttagagtcttacagtttgcatgatcgtgagggcgtgttgtgtataatcgaaaattatttatactttttaagtaaattttatagaactatatatacttgatcaaattattgtaaaaatacagatttaagataatgtattagaaatatatatttaacaataaatttatcataaaaactatagatttaataattaattagcacaaaattatagcttatagggtttaaattcttagcatttatgttatgcctgagttataaatatccaagttttttactaaatcaatatttatgaaatttcacaatttatagttttatgataatttaaagtatctgaaatttacttttactattattatttttgacgtgtagtcaggagggccggagtacaaggtgccactggggcggcgagacagcgccgagttcgcgtcgcagcaggacgtgctgagcgggctgccgccgccgaccgccgccgtgccggcgctgctggacgccctggccaagatcaagctcgacgccaccgacctggtggcgctctccggcggccacaccgtgggcctcgcgcactgcagctccttcgagggccgcctcttcccgcgccgggacccggccatgaacgccaccttcgccggccggctccggcgaacctgcccggcggcgggcaccgaccgccggacgccgaacgacgtccggacgcccaacgtgttcgacaacatgtactacgtcaaccttgtcaaccgggaggggctcttcacctccgaccaggacctcttcgccgacgccgccaccaagcccatcgtcgaaaagttcgccgccgacgagaaggcattcttcgaccagttcgccgtgtccatggtgaagatggggcagatcagcgtgctcaccggctcgcagggccaggttcgccggaactgctcagccagaaaccccggcaccgtcgccgccggcgacctcccgtggtccgtcctcgaggttgcagacagcttcgttttctagataataaaataatactctgggactactactagttagcctggattagtggattagcagctgtatgctttcaacttatggccttgcttgtatgcaatcttagtgaaataaattcagtgatgagggcaagtgatggtatacgcatgattttgcatgacatgatcatttgtttatttatgtgaaagatatattaatcacaggtagactggtagtgtttcgaatctcctgaaaatgaagataaagattaaatgtttcacggaaaacaaggtgctaataacatgtgaccttttaatattacaaacttgaaaaatggattaatctgatattttagaacaactttcatatagaaagttaccgcacgaaacataccgtttagcagtttgaaaagcgtgccacgagtattaaaagtttatccaacttttgttggagaaaaaaatagggcgtatgaaataaaaagatcataatagagatggagcaataatcaggtaggatttgaaagatatgagcaactcgtgtatttgttttctgttctccacagcttacagtaggtaggtacagccgcaaaacacgaggcttggaacactagtgcgttatgtcaagaacaccaacacgaaaagtataatgaacagaaccacaaggaagaggatcagcataatctgcccttttatgccagcctttttcatgaccatcgccactcttttctgcaccaggcaatgagaggaaaataatttcagggcactactctaatttccaggaacttctacacaacttgaatgcagcaaataagtatgacatggtacaggcttgttaactgattcagcaataaaaattgctagctgaaacataaatataagcatctagtgcacatcaacaaataacttgtggaaatttaaactatcttgaatacaagaaacaacgacggcgtcatgctttataatgaagcaactaacctgcacgaagtcaagtctgtttgaagtagtttccatctccaagcttaggtcgtttaagatcctttcctgtaaaaaagcaagacgttcccagttacttcagctgacatgttctttttagagtgctacactcccagccaaaaaaaaaaaagagactgaatggccctgtagtgaacattttttggctcattaggcaacatctccatcaatttgccgtgtgacaagggcaatacctgtccagacagctcttcgtgtatggttagccctacaccaccaatcctttgaacactttcgctaagctcatcaagttcctcatcctgctgcctgaaggtaaattaagtacagttatcagataagtgcagaacatcaggctatatgaactttacactgctagaaccaaaaatatatccttcttagcaattccaagtgtaactcgaagattatgcatcaaccagctaaccattaacagaaacataaatgcagtgctcatattatatgtgcagggcagacaatatatatttctaactaaagtatttgcaaaattgcaaaatgcaataaatgtagcagaatgaaaattgacctcataagtagaagctgtctatctgattctgaagcaatgaagtcatcattgtcttgtgcagtgtagtggttacttctgcttgtgcccatgtcttggtgcgccgagaaagttgaattactcttccccttttcaacagatctcctgactgcagcaacctggatatgtttacccgtaaacaggaatccagcgtagatgaaacttgcattggctacatagagttcagaacacagtaacatcaaaattattctcgtgtctttttttttcccacgccactgtatatcatgtttagcagtcattgtatttctaagatgctcacacatgatcaggatatacctaattgataatcctatgaaaatgaaataggcgcaaacgaaaaggcacatgaaatctgtagtataagtataatttgtaaagttccaataagtcacccagcagtttatataacataaaaagcgaaacaagatgaaacatcaagaaatacctgattacgagcagaaccaatccagttccgtcgtctagaaagctcaacttcgtccagtccatagtacgctggatctcttgatgcaactaagattgtcttttccaactcatccaccttccaacataaaaaaacaccagttataccagaacaactgtgcaggaagaagaaaacagatattccgataagtaactctaatatattaaatgcaacagcggcttcttcctgtaccaaaaacatcaaagaatgacagcactgatattccctgttttctcacctgccactcaatgctttcacagctggtatgaagctcctttgtcaaatgaacatgttctcctgtgtttgacggtgttttctcccatcgatggaaagtagtttgcaacttatcaatctgtcacagaaatatctttatcctcagtattagaagaataagatagatgcatgtgtgttgatggtgtgatatgttttcgaagttatgaaggaaataagcagcacaataacacgaaggggctatatcttcagcgataacaaaatctagcatagtaaaatgcatgaggatgaaatatgtttctgaatgtgtgagggagttaacaatagagatgcaaggaagatgtatattcaggaatggtagaatagcacagtgaacagcatgatggtgcagaatgtttctgaaactatgagttaaacagaaaagctactccaacagttcttaatcttaaggggtcatgagttatgagcttaataggaccaattagtgatggagtctgtaacatggcaattcagtgataatataagtgtatcagctaccaacttaacacaaatctgttcaaggtctgttcaagaacataattacaattcttccatcattacatcaaaaatgttaaaaatgcaacaccagactgttgtcaatttcccacgccctgtcacccagtcccattcctcaagcccattggacacaacatgtcatcctagcatacgttggaactactctaaattggatagacatttcttacagtgtaccgacaaatctgtactcttaatccttttggtggcatcgctagacataaaagacatcccaaatcacaggtagcatctgaacagaaacaggacgatcggcataatctacaaaatcggtcagaatcaagcaactaaggggtatgtctgcgcgcaaacgctcgaatttttggttttgatccatatgcatacaggacgacggcaactaatttcgcatttgctggaagcggagaaagggacaaaggagagaaagagcaagaattaccgagtcctggatctcctcccggacgatgtagaacggatcctgcgccgagctcatgctacctcctccaaaacgtcttccaaaacgaatccggatttggagggattggatttcctcccaaaccctagaattcgctcgcaggagagctgcgaaaccaccacgaggagtttggtgcggagatcggatgcgtcaccttgcttcggttgcgcagaggaggtagtgggccgtgggccaggcaggttggtggctgctggcccgtggaccgtggactcggtccacgaaaaccagtccacgcatctacgtggtggaccgggtgcaccacgctggcgcacctggtcttcttcctcccgaatcgccgggataagggtaagccagccacaaaaccctagaaggcgcgcgcgagattccatggcggccttcacctccaccaccaccgccgcggcggcgtcgcccacgccgtgccgccccgcggccctcgtcgcgcgctcgtcggcggcgccgctccgctccgccgcgccggtggtggtggcggcggggcttcggcgagcggccgcgccgtcccgccgtggcgccacgctgcgggtgagccccccgcgagcttcgttcgggttactcgttggtttgccttgctttgatgcagcatttcgtagtgatttcgctgcatcaagtactagctgttgcagcttcgttcgggttgctcgttggtttgccgtgctttgatgcagcatttcgtagtgatttcgctgcatcaagtactagctgttgctgtggtgatctggcctggatcgattttagatgacaacgaagtgaaatttggggctatgagttatccaatagatttgttggtcccagttcagtctttctgggaccagtgtaagccaaagccaccatttctgtacttctattgcccgtggaataattgagtcaacaatttgatgtccctactatttgtcatttcttcacatatcactgtgcagcatcagttacttgatttgatggctgtatgtcatgaatatttttagacttagttttatttttgctaaccacacctgttgcggacccatatcggttggaaatctttcatgaatgtaactatatatgattagatgtaatgctgtgtaaccagatattcatcataggtttattaaccatcatcaatccaaatcagtattttctccaatccttcaatgtgcttatattcatggatgtctttctaattaatttgatagttactgttaacataatattgatattccgtttctaaaaattgtttgtatgtttatttgaataggttcaagcgaagaaacagacgttctcttcgtttgacgagttactggagaagtctgaaaagcctgtactagtcgacttctatgcaacttggtaagctactggtaagagtaaactgtgttccaaatgtcttgatgggttatatcactatcagtgctctgtactagatttatgtactccaattctcacagtgttagaccttaaggagttagttttgatggaggtaatgtcctgttcctacctgaatgcatcactgaccttgtgaaagtgaatgtggaattccctgcacattgagtaatgcaaacacattattaatgggatcaatttttttttgtccaatctttagtgtttccatggataaagggagaagacaagtgtatgtttattgtccatcgtgtaggcttgcaaggtgctgttgtgttgtttttgtttttaatcaaaatcttagatcaaatctatttcttccttatgggagaaaaaaaagagagaataatagtctggccgtattctctctaccactttggcaactcccaacaccaaactgacaaagtgattgctcattgataacggttactcaccattcagataatatgatggcttagcagttcttggcttgttagtaggaagattgataaacgcattttgagtgtatctctccatttatttatttatcttccttttgtcaggtgtggtccatgtcaatacatggttcctatacttcaggaagtaagcgaaaagttaggcgataagattcaagtcgtaaaaattgatacagagaagtacacaagcattgctaatcgttaccaaattgaagcattgccaacttttattatcttcaagaatgggaaaccttgtcatcgctttgtaagttttgaggatccaccttttctcaattttaattgatttgttaatgctaacaataatgaggttatctctttttttgtggtctatgctgtttttcatttttgttttggcaatgcaggagggagcgctgcctgctaatcaactaatccaacagattgagagtgctttggaggttgcaaagtagcatgtgtggtgagcactgagctgggcagaaaattgtccctgacatttgtattgctacccatcgcatctgcatttacatgtttgagtattattggtgcacattattcattatttgttagttatgcatgaatggtattcgatagttctttctgcatctacatctcagatacattactgaagtgacatgagtcactgttatttgatatttttatttatataactgggcaaggtcatggactaaaccttgtcttctgtaccttgtaatgaactctctgaaatataggtctgaaatatcacgataacatagttttgtaataagtacagttagttatgcaaaagttttttttagaaaacaccttctctattcgtcatgctggttcaccatattttttttccgcgccttggtgaattgagatctgttagcatccaactttagttagctcctattcctttctatgatcgcatattgtggccactttccatgttattcgcctagttagaacttaaaacttacaagtagtgtgaaatactgaacgggcttctttaacaatataagtattggtgggagatactactggtattagtaaatgccatttggattttctttcctgactattctagactgaatgttacatggtttgctgaatgaactgaatctgatttttcttgtttctcttattctgtatgcaaacaaccacagtaatcatactatagaagtgtagtataacaaactagctagtatatgcttgtgtaatataatctaattacttgttttgggacatcaagccaataatgagcttatagatgaggtgttcaataatatgaattatggaaaatcaaagtatcaaagttagacactgttttacataactatgcattaactaaagaatccctactggattgtgtttatatgttatcctaacggatgctctgtactgacttcagaatactattattcgtaccagcggaagctaccaattttcttgtggacaacagtataggtgaacaattgattctccgtgaattgatgctgtcttttttaaattacctcaaatcccagcaaacaagatatgggtgcaaacacctaagatgcagcttgctgatcttctgtggtctgttttttttttatgttgttgtaaaattgtgtgaactaactgatgattatactttgtacctctgggcaccatttactgtatttatcaattctgagggaaattaccttatcattttaccttttgaaatgcggactatttacttaaaattggctgtggtaattctggtttgcatccagaaaaggcgatttataattttatacgggtcgtcctttagttaagttgaagcatgtatatagtattttaaggcatgttggggaatgaaataattctcacttgaccacttctttgctccattttagtgctgagcgattgtggattctagcatctaagagacactccatcaaggttatctgttgtttgtggagaaaattatgaagtgtgcatttggtgctgtttttgaggaggatgttttgcgttcagattgtcgtcctgtaatcttcttttctatttgttagttatgcaatccctgtctggaacgcgaaggcatcatcgtgagaactacgtaaagaaaacatcgtctgctactgtgcccttactctgttcaagcagttgttcaagattgtcggcctgtgtttgtcataaggacgtgttgatatgctcgcattttctttacctactggagatatgaaaaaactctcttgataaaagatcaagatgaaaaaaaaaaagcaaatgatgccgttatttcttaaacacagaataactttactgagtggcgcagttaaaaataggttggtatggtcccaattggcaaattaacgcacatcccttttctccaaagcaaataagacaatgcgcacgggaatcttaaggccccattattttcagtttattcactggattattgaaatgtattatttgcttcatattttaaaaatatattttctcaataaattttctttcaccgcattcccttaaagggaaaattggaaccataccattataattgtgcaaaatttgagatatgtcatcctgacctacatgttattgactcatatggggtcctacatgtcattgagatactgatggcatatcttaaactttaaaaaattataatggcatggttccaaattaccccttaaaccactagtccatgttgcatgttgtatggcttttccttagtatcctaccactacgggtactacataaccatacaccagtcatcatgacgaagtaaatcctcaccgtttgtcgtgattatcattaggtcccgttcggtagacttcaagatgaagattaagtttaggttcacgaaacgagagagtcatcgatgtttgattaaattttttttagataatgaaaatggttacatctccggcctctgcctgtaggcacacaaccaaaaagttcagtagtgaacagaaaataacttaaaaaagatgagatgggacaaacccccaacttctaccgataatatgatctactaagataaagtttttttaaaatcacgtagattctatcatgaaattctgtaggtactgcgccatccaaactggaataaaagtttcttggctaccaattccaaacgcgtagcaccattgcgcatagtgtcttggtgttcctgtgaaagcatcatacaacaagagtgaagccaattggaacacatgaagataacctgcatgatgttagacattcttttatgattaaaaactatatcattacggcaacgccaaattgaccaacatagagcactagcaccaaataaaatcaatttttttggggtctaggcactccccttagccagttaccaaaattatcttttgcattgcaccaaacaaaattatcttttccattgtgggcgctccccttagccagcgatgtttgattaattaaattttaattattttatactcatgaaatggatttatctgatgttacgttttcgcgtgatgcaccatttaaaatgcgtaacttatatatatatatatatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatataaagtttttgcatgatgcacaatttaaaatacgtgctaacaaaaactgagactgtattagaagaaagaaaaagaccttagtctcactcgcgagacgctacaaatatatagtcccctccaccggcactcacatcaaccaaagctgaagagcacaccacaccttgttagtggtgcacgatcgagagagaaagatcgatgagaaggtcgatcgaggcgatccacgtccgcaccgactacgatgattgcaggaggaagggtcacggtcacggcgccatgaggatgcaggacgagcttgcccgcaccaagaccaggtggcccacccccgcccagcttgagatgatagagagaatgaaggaggaggaggaggacgacnaaattgtagcgtcggtaggtaattcaattcgatctcacgatcaaattcaaccaaaattcatctatcgatctcatctgtatgatatgactgtgtggatgaaggacaatcggacgccatccgtggtggagacgaaggtgcaggtgccggagatcgtcgaacagaacgtcgttgaaagagatgagcggctgcgcaccagcgatgacaacgacgactacgaagacgaacccatagtgaggagagacgggcacggcggcggcggcggcggcaggagggcgtacggcgacatcggcgggtaccacggcagcaagggcaggtggccgcgcgagcccgaagtggagaagctcgagagggagaaggagatgctaaagtatggcattatgtccaaaccgaccaccaccagaaaggtgaagatcgtccacaggatgatccggccgccgaaccagtatggcgccgccggcagtgcaccaccaccaacagcaggaggaggccaccagccagctaccagtagctacctacggcccatatactaccactactagtacaagatagttcgttcgatcatccatcttaaaatatagcaacttaacgttgaatcatacgcaatctaatactatgaatctgaattgatgttttttagattcgtatattttagaatggagtgagtatataataagaagttaatggatgcatagacgcatctaggcagatagctagcttagctagtgtatgtatgtatgctactgtgtgttcagtgtgtaccacccgatcgatggttatatggagtattctcctattgtaatatagactatgaatgttatactatactgtatatatggtttggttcggattaagactgttaatttctttggctttcttcacaaagccaggataattcaatcgctgaattgcctgagttcctccagaagaagaagaataagatttggtttcattcgctgtcgatcagttagtcgatcgatctatacctgcgctcaactcaacctttgagtgttcaatccgactaaggctatatggccagctagtttatttcttcacgtacgtctggctgtttcacgggcgcttcagtggcatgtgcatcctcctcgtcgtcgacgaggaagctgaaggagagacggtgtgccggcggcgaggcatttcgtcgagcaggcggcaaggactgagagctactagctgcaggggagatgcgaggcgacgcggactgagtgtcttcgggcccactcccgatgacgggccgcgtggtggtctattggcccaaactaatccccacagggcgaagaatagatggcccattacaatcgaccttcgcgggccccgcgtagtggtcggctgttgcctattgggtgggccgtgatactgggccgcgtttccgatagctaaaggtgtgatttgcctgctgcattatattatattgctccattattattgtgcgatgtcatgtggtgagtgattgtggattccagcatctgtacaagaatatctatctggttgagtatagaataagtagtgtgccataaatattcatacagtgctcgacctaggaggacgatgttttgtccgtctataattgacttagggattgggaattgggattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39476 - DNA, 712 bp, Oryza sativa
ggagacggtcggcgaggagaagcgattccctccctgcttgcccgtggctggttcttctacgtgtagaacaccgcgctcgcggctgagcgccgccgcagccgcctcccccgccactcatctcgccgcggccactgccggtggcgcttccctcctacgcgactcgccggcggggccgagcgggaggcggcgctggcggtgccggtggggaggggcatcaggagggtggggcgcgttgggagggaggggcgccgtgtggggaggggcgtcgggaggtggggcgctgacggggaggggcgttgggagggtgggtggccgcccggtggcggtttggagcaagagggaaggggcagcgcaggatttgacgacgtgggcggggaagagacgtgggagcgttaatctaatgctaatccgagtgctaatccctgtgttaatccaactcgcgatgtggatcgttggatgagaggatctgacgattagaaataggtgggtgtactgaagaggaaactggtgctttttatatcccatcttctagaaagtcaagacgatagttctgcttagaagaagccacatcatcgatttcttttctcaccataggattgattattgatggcacagattgccatctcatcaccttgcccctatccatttcctctcctttccgtttctgcttgagaaattagagcgaaaactaacacaattaattagaccacga

SEQ ID NO: 39477 - DNA, 757 bp, Oryza sativa
tcctgcagcccccaatataacctctggtgttgactgcgcctcctctacagatgcatgattgacacgggcctgaacaagcttgggtccggcacgtcttggcttcgggcacgtacataccatgtgtccggacttgttacaattgaagcagagttcgggcatttctccaaacttcttggtctttctggctaagctggcagagctgactgaactgactgagctagaatcattagtggacttggagtagagttgaggctgtgctgctcactgttactgtgattgtcactgttgttggtgccgttgaaattaccggggtggtagggacggtgttgccggataatcatggtggaaggtccaccctgatgtctcatcgtgaagcgaggcttctgactcttcccctaaggagtcctgaactgagctgccttccacttacggtttattttgttacactgctcttcctgacggatagtcttgtccacaatcttatcaaagtcctcataatccttggagatcagttgattggtcaattcatcatcaagaccagacagaaacttttcctgcctctcggcatgtgtgcgcacatcctcaggagcatagcgcgcgagacggttgaactcatgcaaatactcaataactgtcctagttccttgctgcaaagaacagaactctctcttcttttgtgccacaattccctcgggaacctgtgccttattgaaactctgacaaaactctgaccaggtaacttctgtcccagttggac

SEQ ID NO: 39478 - DNA, 2846 bp, Oryza sativa
tcccatgagcgccgacactccacgttgccttgacgtcaacccggacgcgccctttacctgcggtaactaccaccgcagcagcggctgcccccacgcgccagccatccgcaccgcacaccaaccaatctctctcattggcaactgcttctgcttcctcttccatggccaccgccacattcccacctcacctcacctcatcattgattactgcgtcaaggtagtagtatcagcagcagcagcagcaggcttgcagtgtcatcacaagtgaaagtgactggcttccggtgtgtagatatagtggtctgcagtaactttatcacataccagcatttctcaattctcaggccacgaaagcaactgccatgccatacacactgtgcactactaatctcccttcgcgcactcattggctcatctctcatataattttccattcccatttacacagccacagaaaactaatcactgacaggtggcccgtgaacagtgggcccatggggagtcatctgttgacaatataatgggggtagctacctaggtagcgtgtagatgtaatcgcgtttcgcatggaaaaaagtcattcatagaaagggtgccgggtatatataggatcctagctatagatagctggctagcgcccttttggagttttgaccagacccgtttagagtgtcaattgagcaagctgtggtcaagctgagacagctcacttcaagctcgctagctgtatataatgtatacatcaaacacagaatcgtaatgtgcccgagcgctttaagcatgtgattacggtgtgatcgctcgtagtggcacaccatttcttttttctctttagcgaatatatatgtagcccacgcacgcactcgtgatcacctctaagattttgactcccggccacaaatatcccaaaattttatatttaaccgggtctacgagtataactgttatttttatattccattcttaacattatctctcaaaacacaattgcattgcccatacagttaattttttttggccattttctcgttctctgatcgattaacacggtataattttagaattcaggagcaaaccccggtggttactactcgccaaacgatagtgcacacacacatgcatgtacagcagtctgacatgtttgttaggggatgcaaagtgtgatcgtcatcatccatgaaatgaaggacacaccatataggagcagccaaatggttggcaggcagagaccaaaatggagctatccaatagagtggaagcacaactggttttttgtacgttgaaactttaaacaagtgtctaaagttaataattactagtactactgttaggttataaaaaaagctgactagttactggtgtcacctaaaggttactactcctccactagaggggccagcgcgttaaacgacagcttcgcatcattagctcacgtatcaatattccgtgtgtcaggcgcaccatgtgtcaacatgtccaatgtcgggtggtcatttcaattcatcttgcacctgctgctgctgcttgtgtacacctagtactcctatctcggttacttagcttttccacctcccatgcgttaatttactgcgtgcaccacgtgccagtaggcttttttaccgtacgtgcgtggtatatacgtacgtacacctactcatacggtctgtatatatgcatgcatatatatgggctcaattgctgccatccgtgtagtcgaaagcgagctataccactcagctcgaacaattcagatattttcttaaaattgttgtgaaacttgtatgaactacaactagatatgaacggggatatgttaattgaaaaacctcggctctcaagcacaaatggtgaaggccaacgtctccttttatagaggccagggatggcgtcgcctatgcctcctgcttatctcttcgctactgtatcttcacgggagctggctaaagtcgaggcctttccaccgaaagttttactcttcacagtgatatgtcattcaccgcaccctatattgtccccttatcctttatagggtgtccttctggattctttcttgggtaatcttctgaatttcttttattcttttattcttcttccacgcccaaattgttgatattctattatcaatatatattgaaaaacatatttagcttatattaatttattcatctggttgcccatggccaccaagatccattgtgtccaaatcagaaaaagaaacttctaatttctcatctactgccttttttatttgctcaaatttctgatccatttcttgttttaattctttaagtatttcttccttcaattccttctttaactgtggggaggcttcttcaaatttttctattatcttccaatcaatatattccccatctaatggatccactccttttgttaagcattccttgtatgtgggttttttaaaaaacccttcttcttttatagtcatcttaataggtatttctgaagtcttctttcctttagcttttttgcatttttgaatatattcttttgcagcaggctctagataataatttattcctaatatttttctagcttggcttaatgcttcatcaatatccttatatttcttccaagatattcctcccattaatttagcatctattttttgagccacaatttcttcaaaagaaatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaag

SEQ ID NO: 39479 - DNA, 1557 bp, Oryza sativa
cagacattgattacccaagaatctattagcatcgcagaggtttataatgttgttgatgccttatcaaaagtaagacattttttttgcagatgttttattctagtgtcttatgaccttttatttggcttacacatatgctattttgcagcttgcaatcaggcccagttctcctgaatcgctgcagcagttgattgaaatcgctagaagttttgcttccgtgaaggatgaaaatattagacagtcaagggataaaaaggtcaggagaccgataattggtcataccttccattgttccaatagtaaatgttatgctgactccacaaattacacctaactggtttcaggttttatccggtcgtcctttggtgaataaagaggaaaataatgctaatgatgttgcgttcactgatgctgttggttttcaggagaaggttagttgtacacactatatcagttttcgttgtggagacatcacacaggattttatctcctgaaactattagagatagaacaataaatttattttctttatcgatttaactttggttcctgttcggttacatcttttcttcatcatgaacagcaaccaaggtatgacatatgtggtgtatgctctagctgcttcagtgtcatgcaacatgtatcttaatgcagtttactccaaacagctcctccattctcaaaatagatgtcatcgtcaaatcttcaaatgttaactccctaacatatgccaaaaaaaaagagatagaacgaacgctttgatgcgaaaaactgaaaatgatatactagttttcatgagaaagaacgctttcatgtagttatgaatttgtggttagaaaaggcagtgaataaatatttgatttggagactctgtcaatgtccttcaaaaagacttgggagcattcattagtcatttaacagttctacacaggaacattcattttttttttgttcacatggcttaagaaaaggaaacattcctgtgtcaccttctgtacaaaaaaaaactgtgcccccctcaaccagacttggtggtatgaattgtttgttagctggtcattttttttattttgcatacagataatactttgtaacgtgtgcactctgtacatgttctaacaaaagctgacaaactccttgtgcatattatgatggtttcacacaaataactagagatgcctttgttgctaatctcttaataagttgtcactgttcctcagtagattagtttgattagatggatgcatgaaaagggaggaacttgttgaatgctaccaaagctcaagtcctcattgggtgcctatttattcttgattaaaaaagtcacctagatcctcgtaggttttttttttcttcttaaaaaaagatggtctagacattaatattctttgcagactgcagttatgtttattatgtttgatggaatattattttgaatatggttagtaattgattcttaaaagtattgacctctaaatgtgttgatgttacatattattgactttgaaattaacctatattcatggaaagctaatgcattatttggggctgcaggaa

SEQ ID NO: 39480 - DNA, 1838 bp, Oryza sativa
  unsure (1)..(1838): unsure at all n locations
aatgctgcttggtattttcttttccacaatgctcaagtaatttgctttagagtggataatactctagagtagttatgtttgaggaattatgtagctctggaattatatgatcctatttccgaacatgcttaccttcttgtttgatataagttgtgcaataagctggtccacaaaatgtcaataatgataaggaataaggtcaatgcaataaaaattgcagatgacccttgttctaggataattttagaacctaaatcaataaatggcagaatgatcctcctttttccaaatcgtaccttggttggtgctttgtcttaaactaaaatatcccccttgtgtagttttgcttggcttgaattggtaagccacagaagcttcatgccaaagctattgctgtgcaatgcacagaagggctggccattcttccagaggttgcttgtcgatttgttcaaattcatggaaccatatttaagaaatgctgaactgggacaacccgtaagtattattcctgcatattcatttgtggctgtctggtacatggttcactgcattctgattttggtacactattatgttctttttttctattgtagatacacctgttgtacaaaggaactttgagagtgttacttgtgctactgcatgacttccctgagttcctttgcgattaccacttcagtttctgtgatgtcattccccccagctgcattcaaatgcgcaatgttattcttagtgcttttccacgcaatatgagacttccagatccctctactccaaatttaaaggtatttactggttgtgtttatgtaacacttactctaatgcttttccacgctattgtatgtttgatcaacttaaccatttttttgcaacacagattgatcttcttgctgagatttcaattcctccaagaatcatgtctgatgttgatggtgccttaaagtcaaagcaaatgaagacacaggttgatgagtacctcaaggtgaatgacaattgccgccgctgtcatttattttatggacttaccaattctcactcatgtatttctttaatgtaatgatggtttagtgtgtctctattactcactcattcagcaattatattgttgaaaactacttgaccgaaggtggtatatttaatttctcaccttcacttgtatccgcgcagaggccagatggatcctttttaactgatttaaagcagaagttacttctgccgcaaaacgaagcaaatattgctgggactcgttacaatgtacctcttgttaattcacttgtgctctatgtgggcatgcaggtcagtttctaaatctgccatttgcaagttgcaactaaggtgttctgttaatgacatggttattatctaatgcgtctatgtttcatccaactaggcaactagccaagcaatataatatcgtttgttcaaccagcatttatctataattttcatggtcctttttgtgtcctccttttttagtgcaaattcagatttgtgttcgccttctactcatgtaatatgctcatacttggtattctatcgtatggcctgaccatgtttaactggatgcatcatatgatattgattcacaattatagtcgtggcgtggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39481 - DNA, 2244 bp, Oryza sativa
ttgatatgtacagatcctaagtaacggaaagttcagaagtgttgagcacagggccgtgataaacccaaataaggagcggatttcagcatcactgttccactatccgtgtgagaatatggtgatcagacctctgacggaatttgtgaaagatggtaaagtgaattacagatcaattagttaccttgatttcatgacacaattcttcacacaacagcttgatggaaagaacagactggagatgttgaagttggaatagcagccatgaccacgatgcctgtagtagtgtagtgaaatactgagatgaagctgcttcaaggctgtgtccttgagatttgctgcttattatatctagaggtgtccaataatcctgtgttatgaggatgatttacctgatattttgagtcttgtcccatatatcaggaactgcccgtactcaggttatgatgcaaacatccaaaaaataaacattgatgcctagaagaattaactgtacgataatagaatttcagttcagactaacaaattaggtacaccatcttccatgctaaattttggcacactttggcattactacatttcggtagcgttggctttgtttagtttgatgtctttaccaaattctagtagagttttaagaaaagaagcttctagagctgccaaaatttaataagatagtaatggttgaagtgtgtttagtttgttgccttaccaaactttggcaatatcaaaatttggtaaggttgaaaacagcaacaactaaatatgcacgtaggatgtcatgttctcttatttagaattaagagagaatgattgttatgtagcatgattcaaccttttcttctttgaagaggaatggtagagctgttcacatcagttgaagcagacagacaaggtgattggaatttgagaacatcaccctgcttttttccatggttagtcatcgctgatggcaggcgagtcacacttgatggagaaaattccaagggctcttttgacgtgaagatggaagatagtgtactacaatgaagagcttgaagccatatcaggataagagactctgccttccccgtctctgatactgtatgtgttgctttcagttggccatctatatccaccagtttttctatccattatctttaaaaaaaatcccttttgacatagatgtgttcctctaatgacatagatgtgttcctctaatgccataaggtagagactctctaccttttacttcaaaaaaaaaaggcatgatttagctagtgtaaacacctggatacctaaacagtaaaccataaaatcaagtgagtgttcttctgaaggtctataaatatggtatattctacacgttatatgcagtatacagcctagaacaactgcttgccaaaaaaggaaaagaaaagaaaacacttagtgcagaaactgggaattgcaatggcgggagcaagatccgttggttctctcccagtgcctaatgtgcaggcgcttgcagaaatttgcaatgatccagatgaacacatacctgaaaggtacatcaaccagaggctagttctgaggaggtcatcaacaactaccaaggtgacatggcgattccgatcatcgatctcaagaaattgctttgtccgcaatcatcagaagaggagtgtgtgaagctgagatctgcctgccagtattgggggttctttctggtatgtaactttaggttcttggcatttcatcttcggaaagcaacagatacctatttgcaaatgcatactgtatatacaaatgtttgaattgattaaagacgctacagataatcaaataaagttgtgggcagaaaatgaataaattcatgtcctgtaaggtagctctagctcagtttgagctgtgcaactagtataatggaaacatttacttttggaataaactacagctcattaaccatggagtgccagatgaagtgattgcaaacctgaagagagacattgttgatttctttagccagccactggacaccaagaaggagtacacacagctaccgaatagcctagaaggctatggacagagctttgttttctctgaggaccagaaacttgactgggcagacatgctgtatcttcatgtccatcctagcgattcaagggacctaaggttctggcccacttctccagcatctttcaggtgatctaccaaaaaaaaaaaaaaactgtgcaatttagcttttgataggcatctgtctcttcttaactggagatgtctggaaatagg

SEQ ID NO: 39482 - DNA, 1322 bp, Oryza sativa
acccaggattgggttttttttgggacggagggagtatgacataaatggattagaaggattttagccattgaaagtggaaaccaataggaacaacatgaacagcatgttacacatcctaattcacgtatttgatggcaaatagaagccattgtgtttcaggcagctcatgattctggggaagcaaacatactgaatcaaacacacctgtagttcaaattctgccttcctctttccccatcattgagcaaacccctataaagcaatctctgtgttcaatatcactgagattggcatgcaaagaacataacacaacctgagatagcaatagagaggggaaaaatcatggagcagaatgtacgggcagctggggaaaggataatatgatcaaggcaacaccttgaattttagactaacatgaaacctcatagtcctgccagatactgtggttaatgatgcatcatgcatgtcagtatgatattactaagctatgtgaatcttttatgtggatccttattacccgctgctcatctaatcattagatttcgaaagaatttagatttcttttccaaaaaagaaaaaatgttttaagcaaaacatttttctttaatgagattgaatatttctatgcaaacagcaaaatcaaagctggaaagagacaaattacaaattgcagccataagttgaagagcaaaggggcggaatggtggcagaatacagaagaaaactacacaacgtaaaacactgcatcaattttcaccctcagataaataatcctcaccggtatcagcaatgacaatgtcataagcagtccatttttttgtaccatggtttggcatgacttactaaattaatgtccgaacgactgcgttgctcgggaaaataaaatctaagcggttcttggaagggaaatgtcaatgcctcatatttctgctgcaacctgtattttgtaacaataccacttcattttgtctatcaataattgcaatcattttgtggaatacaaatgtaggcaaagacatgtagccaaggagtgtgcatgatctgaataaaattatgcctctcttggtcacatgtagccaaggaccttgcatcttttctggacaacagttgaaccgaacttctcatcctgttctcaaagtttctcataaaatatcaggttcacaagtatataatcttcagattctgttgtacacacaaaatcagcgagctcattattggaatcattttttccttctgtgtgcatgttgtttggggatggtctgtattactttttgtgtccctgttctgaggaaagggcgtgcaccgcacgtacacttattctt

SEQ ID NO: 39483 - DNA, 1377 bp, Oryza sativa
gtgcatgatcggtaaggcctcatccatctccactagacgttgggagcttcaagtgcgagcagacttgccactttcctgtattagatcagcagtcgatgaatatgataatttcaactaagaaagttcgattaccggtgtttatttatgtctttggcacaatgggggacctctgatctatcatcataaatgccaactcactgaaattttcgcacggctacttagtgacagtcaatttgatcctaatgcaatatgtcgcccaaataatcttctaaagtttattttgatcactaattggcagatgatttactgtatctttttaatggaatagatgatttactgtatcataataacatctaatggttatttccactctctcagggcttaaaggtcactgcatacgtgaggtgcttgagcagtaggaatctgcatctaccatggatgttgttgctacacaaacaaaacaatataattgctggtattattttcaaattttggtccttttgactctatattaaattctttatccattactgtttctcgatagtttgctgtgaatgattgcctgcacattcaaatgatatgtgggattagtttccagtcagaagtgcaaaacttagctagatctctcctgatgcacaaatctcactttttgtccggatgaattctacacatttcagaccagaaaaatcttggtacaagtcttaatacaagccatttagttatcagcatattcactgcgtggtagctatactctaaaaaatattccaagaaaatatggttatgctactgtttaataatttgctgaaggaaatagcaacattgcaaagagatgcaaatggtgctacttgatgctgaaacctgagtaccagtcattttaattgtagctgtttggagcaaagttttggctagatgtagtgcataaattaaatttatttttgccgcttgaaacttttatatacacaggcaactattttttttcttttcatttccaaaggcttccttccgtattaaccttgttttttttatcaaactactaggtaagttgaacgagtgtaaggattttctttaccctttgtatagttttatctatgttctagacacctacttgaagccgctctaacagcatggtcttgaactttttttaaacctctcatttagttttcatttttggctataaaattgcacatttccttttgttgtatagattgccattcttgacagtgtgaacatgggtggtggcagaggtgtttccatgcatacaacattttctattgccactgtcaaaaaaattcgcatttcacaggactgctattgcatgatttatcttggattagaaaatactttctgggttatctctcgtgtgttttgtaataattg

SEQ ID NO: 39484 - DNA, 14770 bp, Oryza sativa
tgggactccaatattctaggcatttttatgttgatgtaatggcgtggaatttgtcggtgttccatgtatatttaatttagttgcttaaaagtcggtggtttcgatccgtccacatcaagcctccacacatgttcattactaattcatctgcctttaaaagcaaattggtaattagggagtaatttctgaatgttctaggctcaaaagtggttctggtaatcttgaatatttgctctggatgacattccctctatttttgcttctgacttgaactgtgaccgtgcatctctgtggtgatcatggattaaattaggaacaatggtttaattgggttattctagggagaagtgatatccattggttgtcatggctgcctgaatgggaattacatcatttgattttaagatttaatagcttaagtagcatttgggctcactaaagtgcttcctttttcttatctttcagacttccactatgaattatttaacacgcataaaagaacttcccttgcatgatttttttattatgaaatcaatatttatattgacaaacctgcttagcttcagttggacaatgataagctgcagtaaggctctttctcattgaaggacattggtggattctgcactgctgttctattacttaacttcagtagataatatatttgcccatttgcttgacatcacattttttattttctctgttccatatggtgttctatttctcattttaggtgaacatttgtctaatttatctgtaccatgatctttttctgaagatattctccgcaaagagagatcatctaaagcatggttaaaaaacagtaagtagcgaaaaaatcatggtacaggagtcaatggtacgcagtagcgaaaacacggttaggagttgcatattatgctgttttgctattccaaaacgtttttgaactgtagcaggatgtttgttcctatttaaacgagagccttttgagcttttgtagcttccctgctggttacattctaataaaacaaaaatagtccttattgaaatatgcactctgtaaacagtaaggggttcttatactgttttctttaattccacactacaataaaaagagtgagatcagatggcaagcattctttgtgaaaacaacacatccatatctggatgtagtggttgccttcatgttaaaagtgggtcacaatttccagtattggaatctaatttagtacatggcaatgaaatttcattgagctgtgaaagtgaggtatcaaaattaaggttggtttctattcgttcagggttgaccttcatccttctcatacaagtattttactaggaaatcatgaaaaagcatggtgtcttaaatagtggactactaccatttttgtttttgaaaccttaattcctctctcaaaatttgctacaggtatacacccatggtacctcagatacatcatgttccagccgttgaaagaaagttgcattcattctggtgattcaaactttctggatcttgaatggctttcaacttgagacaactcaagcgatgaaaggtgtttactttggcattgctattgcatttttttttagcgttttcgactgacataatatcatcttcacagtgacagtcaatttaatttacacattttcttttgccttagtgtaggaaaacattaaggataattattagttgattctcctgtaaatttcttacccttcatgtttaatttcatatcaatctaaattctagagttcttttgctctcactgcatttccatgtaataaatacaaatatgtagtctcgtgttgtatcacttgatataactatctgtattgagaggtaaaatgaaaattatgttgccacacttcctaaatccaattaataagtgtcttctgagcttccagtatgttcactgatactgatttgaagatatcctctgaaacatttttttttaaaaaactcattaatactgatggattgtacttggacaggtccattgcaattaatactccggatgtgaacctttcagcggagaatgttattgccacaatgtcttcttttgactggtagatttgtatgatcaaatatagttgtatcatcaccatggacacattactctgatcattatgtaaaactttgatttttattttttatatgcattggtgcttcatctttagattgtaaagtgtaagagttttgttctcaacagaatctgtaaaacaatgtatggaaattactcatcaacggcattcactgcaaatgtattcataggtttttttttcttacataatcattgattcagcctgaaaacaaatgattagtctacactaatcaagcaatctatatgcaggcggcgcgctattggcgcgccccagcatctagtgcatcattaagagtagctgcctgaagcttaggcgtccaaatttgatggcttggctcaggctaatgaagagtcaggtcaggcaagctcaggatataccagggcacaaaccaaacacatagttgttggagctcagacagcgccctggccaggaatacaagcatcaggacgcgggctggcataagccttgggccaatcttgggtccgtccctaccactagcaagacgccatatgaaactgaggataagcttccgcgcaccttttacgagtgtctaccagaaaactaattttttcaagcgaccaaaactaattttcacaggcgggagggaggtccgcctgcaccacaacgactgtgaaaatcatcgatttttgcagtcggggcaacggcctgcctgcgaaaatgcaaaaaaaggaaaaaaaaattcgccgcatgcggctcgccgccgccgccacgccgtcgcccccctccccggttggatctgagaggggaggggaggggagccgtcgtcgtcgccgccgtcgccggcgccgctgccggcctcccccctccctcctccggccagatctaggagggagggggaggggagacgctgccggccaccccgcgcgcgtcgtcgtcgccgccgctgccgccccacgccgtcgtcgccgccgtcgcccccgttggcctcccccctccctcctccggccagatctgggagggagggggcgaagggagccgccgccgccggccgcgctgccgtccccgccatgccgccgcagtagccgtccccgccgcgccgccgcatgcagtcgccgtccccgccgcgccgccgttcccgccgcactgccggagatgagaggagaggagaggatagtgagggagagggatctgagggagagagagatgagggagaggataagtgagggagagaatgggacttagaaaaaaaatctgctccagcctagtctatttatattgctcctcattttcgcaggcagaccatataaggtgcgcctaaaatgattttcgcaggcggacagcgtacatcaccccaatttatatttttgtaggcggtcatttggctccaaaagtcatgtccgactgtaaaaataagactctaatgttggggaaaatgctttttctagtagaggcctagcgttcgtgaaggatctaaactactatgtgcgtgagcttgacgaccgcagaacagccgacgtcttcatcggccacaaagatgagatgggggtatcgtgtccttcatgcaaggatacagcgtgtacatgcgcatctcgctcgcgatcgatgtcatatttgacgagagccccaggagggactgtggagagaactccttcagcgaggagtttacgtgttaattacttgccacaaaaccgggcttaacagaatacaggtatatatagctcggatagagttgttgtgcatctactaaaacataggaaacttatcttatctatctaaacatcccaacaactcttatccttcgctatttgttacattatcatatgtgagaaatatctaacactccccctcaatctgaacctgtaaggtttagattgtttctaaacatctctaactgtctgactgacagtgtcttggtgaagccatcagcaacttgatctttggtagatatatattccacttgtaaaagttttcttgcaacccgctcacgaacaaagtgataatctacctcgatatgcttggtgcgagcatgaaaaacaggattagctgtcatatactttgcaccaatattatcacaccataccttagcaattttgggtacctgaattcccagttcatgaagtaaggtttgtatccacataatctctgcagtagcattagccaaagccttatattctgcttctgtactagatctggatacagtagcctgcttacgtgcactccatgacacaagattaggccctataaaaacagcaaaacccccagtagaacgccgatcatccaaacatcctgcccaatctgcatcagagaaagcacttacaagaagagaattagacttgctaatttttagcccaagcttaactgtatgtttcaaatatctcaaaatcctcttagccgccacccaatgcttagtggttgctgcatgcaaatactggcacaccttatttactgaaaatgataaatctggtctagtcagagtcaaatactgcaatgctccaaccagacttctgtacctggtactgtcttctggtccaagaggattaccttcatgagcacttaatttttctgaaatagacaaaggagtattgactgctttacagtcactcatattcactctctttaacacatccatagcatatttctcttgtgtcaaaactatgccatcatttacttctttcacttcaatgcctaggaagtaatgcagtcttcctagatccttgagtgcaaattcttgattaagattcttaagcaaagcattagtggcaacaatagatgagctggctactataatgtcatccacatataccaacataaatatagtaacatctcccttactgtaaaagaacaaagatgtatctgacttagatgatttaaaacctaactcatgcagcttagtacttaacctggaataccatgccctgggagcctgctttaaaccatataaggccttatctagtttgcacacatagccatctttctgttcataacctggtggctgcctcataaagacatcttcctctagaaccccatgaagaaaggcattctgtacatctagctgacgaagggtccaacctctagagattgctatggacaaaatagttctgatagtagcagccttaactacaggacggaaggtgtcctcataatctataccatatctctgtttgaacccctttgccacaagtctagccttatatcgatctagactgccatcggcctttcgtttgaccttatagacccacttacaatctattatattctgccctttcttagaaggaactcggtgccaggttttgtttttcataagagcctgatattcactatccattgcttctttccaatttttatcacctaaagcctcatgcaaagtttgtggttctccagaagatgtaaaacaactgtatctaactgtcccatcagtgtatattttctcttttctaataccactttgtaaccttgttttaggtcgcattacctcagatagctgtgcagactcagacggcgcagatgatcctggctgatgtgactgctgcgcaccacctgacgaagacgcgacagcacgggcaggcgatggaggagcagcagtaggcgatgcagcaggcgacgtggcgcgcgctggttggatgcccgagtgctgctgctccgactccccttgcgtcgcagatccggaggcctgccgctgcagctgcgcctagaccgacgctgaatctgaggcggattctcccgccaagtcgccatttgctccatgtacccggccaaatgcccccggtatatctgaattcacatttctgggagattctgcacatgaaatatcagtagcatttggcatagagatattaaacagatgatcatgatgttcctctcccccttgatcagatgttttctcattgattagagtaggaggaagcaaagaaatttcagctcgaagccgggcgccagcatttggatgaagattagcaaagggaaacacttgttcatcaaaggtgacatcacgagatacatataccctgccggtagaaacatctagacatttgaaccctttgtggatattgctaaagccaagaaacacacattgctttgaacgaaattgaagcttatgagtattgtaggggcgcaaatttggccaacatgcacagccaaatgttcttagagatttataatatggtgtttgcttaaacaaccgttcaaggggtgtatcaaattttatgaccttactaggaaggcgattaatgagataagtagcagctaaaaaggcttcatcccagaatttcaaaggcatggaggcatgagctaaaagagatagaccaacttctactatgtggcgatgtttgcgctctacagctccattttgttgatgtgtgtgagggcaagagacatgatgggagatccctatttcattaaagaaagtgtgcagcttaagatattcgcctccccaatcagtttgcatcgaaagaattttgcgatcaaattgcctttcaacaagtttctgaaattcatgaaacttctgaaactaacatagtatttctttgcacctacagactcagaggcaggcccccacacatcggaatgaataagttccaaaggattatttgacacactagttgatctaggaaaaggtaattgatgacactttgcttgttgacaagcatcacacacagactcattgacagaattactaagacaaggcaatttattttgactgagaattctaagaacaattggcttggagggatgaccaagacgcccatgccacctctcaaaagatggcgtcgcaacgaaggcctgtctcaaagacaatctggctggaagtgggtacaggcctcgtcgacagggaccttcaagaattgtcctcctcgtggccttgtccttaatcaaaaaatatttgccatgaatttcaagaaaagcataattatctgcaacaagtttatgaacagatactagatttttcgccgcttcaggaacatgtaaaacatttttaagatgcaaggggcgactaggagtaggaacaatagcatgaccaacatgtttaatactcataccttcgccacttgcagtgtgaatttgatctgttcccttgtatctctccttggttgtcaatttgtctagctgcccggtaatgtgatccgtcgccccagtgtcaacataccagttggtatcaacaccgtaggcgtatgttgcagcaccgccaagcttctcatcaggaacatatgagtcatcataacgatgccagcagtcgcttgcaacatgccctcgcttgtgacacacttggcacacggggcgagtatcattgcctcgcccgcgtccctgacttgcgccgctaggggcgccgcggccgcgaccgccacgaccgaagccgccgcgtctgccacctctgtttccagtgctgctgccgcgtccaccacgaccaccacctcggtttgccgcatttgccgaagtggtgagataagcttgccgaatccgaatcctgttttcataactcaagagctgtgaataaacatgagaaattgaaactggagcaatccttgccgtggccatcagtccttcaaccgcggcgtcgaattctgaatccagcccgttgatgatgtacgccaccagctcctcctcatccagcggcttccctgtagccgccatctcgtcggcgagggacctcatcttcgcaatatattcgctgatagacataggtcccttctgtgtggtggttaaggcgaggagtacattgattgtacccgccttcgacttgcacgagaacatgtcatcaatcatgttccatgcctgggccgccgtcctagcgccggccacttgttgcagcacctcccttgatagagaggagaagatgaatccgagcacttgctggtcctgaacaaaccatgtcttgtactcagggttggggatgacaatcttggtcttcttgtccttgtcgccgtcttctttttcaatttcagccgccggagctgcggtcgtgctgacgatgtgctcctccagctgcgcacctcgcaaggtggtgaggatctgtgcagcccagagaggatgattctgtttggttagcttctccgagatttggaggccaaacagagggttggagattgccgccgccatagaaaagctcgccatgtcactgggagaaagtttgcacgacagaactaatctaatctagcgggaggctctgataccatgtggagagaactccttcgcgaggagtttacgtgttaattacttgccacaaaaccgggcttaacagaatacaggtatatatagctcggatagagttgttgtgcatctactaaaacataggaaacttatcttatctatctaaacatcccaacaactcttatccttcgctattccgtcatctaacagggacttgacggcaacaagcgatgcggatgtgccaccgagcagcaattccgtcatcgagtgtaccatgttgagaaaaccactaggcatatatcctatgttaagcatgcttggatcaccgtaattaaccaaacaggatatagtaaacagcacgattgattactgtagcagattagtacaaacacataccccagaccaattaaccatttctggctaattaaccaacggcgagttgataataacttgatatatatacaaatacctccccacatatttgcatgggaattcacgcagctagctattgaactgacgtagcctgcacttcaaccatatatatctggcctctcctcggtgttgcagcacagggggctatatctatcttttctcgcgtcaacgcctcgcgaccgtgcacagatgatgcaaaaggacggtgcaattctcacaggtaatgaacagcttgcaaccccaagcagagtctctctctctctctctctctctctctctctctctctctctggttagctgtttcttcacccttaatccactgtcataacctttcccttttgctgctactagtacactaccttattgcaattaagctcacctagcttaaccagcttgtgtgtaaacagcaacttttacgttcctttaattattaagcttgctgttagagttgaaattcagcttcagatgtggatgggaggccatgcactggaatcgatcgtccgagcagaatcgacaataagctggcaagcctactcatgtgtatgtacggttgggatgggttggacgtacgatcgagccgtgcaatctatcgatcgcataatacaaccgtgcaggagacatgggcaataaatataaatagagtttggcttgctttccaatcatccctaactgctttaatttcctgtcaacgagacagacggcatgctcggtttggcgtcgacgagcacgcatatgtatcaatgtgttcatgcatccatctatgcattgacgtctcgacatgtagcggcacagtccgcgaaaaatggagcacaggagaaagagtgtgatgggagcatgtaggtcaacctacccaacggtgaccatttccaccaaattagtattagtagtatcatttatatacattttgtatatactgctaattaattaataccaacttgacactgaagacaaatgtgctcatatatatgcagaccatacagcaaataaaattcaccagttcaactagtagaatatgcatatatctctcccccaaccccacccacaccccccacaaagaaaaaaggaattaactttaggagctagtagtaactagcaatgcaattgcgaaaattaattccaaacaataaaaataatgagattttaaaaacagagcaataagagctagcaaatttacttttcaacatatcgccctggctatatatgtacataagtcaataatgcaaacataattgtatggagttgctgctaattagctcgaccttgaagtaggccatagccttatattgtataagcaacaaccaatgtggatgccaaaagagatcataggtttgtagctgggaagacatgcatggaaaagtcacgacgcatgctagaagcaattctgcaagcattgcatgcatgtgctgatgcagtgtttgagggacgccgaggtgatcgatcagacgacgctcagtagtagtacttgcacacatcaattaaatcccttcacctacccgataaaccctcccgtcataaaggttcacccaactgaaagcacattttggcagctttttctagcaaagcaaagttggtacgtgtaccaccggcatggcataatagcatcttattagcacccggttctcggaaagtaagatgtttggatacatgaacttaactttagtctctatatttaaacactaaattagagtattaaatatagactacttacaaaactaattacataaataaaacattggtggataaaccatttatactctcggttggtaaccgcctttagtcccggtttttcaaccggttggtgttaccaaccgagactaaagataccttatcttaggactaaagagagggtagcggcagtcccattaggtctctttcttttcattatttttcattattttttagctagagtttaatcctgtattttctcccaaatcaagtgggatacatatccccaaatcaaacctcaaatcaaaataacatcccaaaacattcacatcataaatcttaagttacttatacacacaaatcaaatacatcacaaatcttaaaaaaattacacacaaaccaaatacatcacagattatacatctcagatcatgcaacaaatcacaaaattatacatcttagtgaatcacaaattataaaaaacaaaaaagatgccgacagcggccgccgcctgccgccgctcgccactgggcccgtgcgcggcccagccggccgcctgctgcgtgggaagggaggagggggaggagagggccggggatgggaggggaaggggagggggaggaggagaggaggagagggagatcgatctgagaggatgagtgcgaggcggttgtggaggagaggacagggaagaaggattatatattaagcgttgaattttagtcccgattggtaataccaattgggactaaaatctttagatctttagtcccggttgataacaccaaccgggagtaaagttaggatctttaaagatcccgggtggcctgacaagacctgacaggtttagaaccgggactaaagatcaaatatgcccattgtagccaccaaccggggctaaccgggactattgtggatttcggccgaccgactaaagatggtttctccaccagtgaaagctaatttgcaagacaaattttttaagcctaattaatccataattagagaatgtgtattgtagcatcgcataggctaatcatggattaattaggctcaatagattcgtctcgtgaattagtccaagattatggataggttttattaatagtctacgtttaatatttataattagtatccaaacatctgatgtgatagggacttaaaagttttagtcccatttaaacagggtctaaggtaactaatcaaggccataacatgtagtgcaccgcttgttaatgaatctaatcatatatatatgtgtgtatagattcattaacatccatataaatatggacaatactagaaaatcttaccatatgaaacggagggagtaattggcatggtgaagttaataagccctaaatatatcctgttttacatgcttgtagttgttagctagatagcacatgtacacaagagttcctcacagtaaaaatgtgatgatataattagcaaaaaaatgctatatatggtgtatctacatgttaattaattagaagggaagaaaagaaacgggagaaaattaattgctccggcctacggcatggatcacctatacttgacgacacaacgcggtgcaatcgcttccggtgtatatatatgcatgcatatatatgtagccgatgggcacacacacaactgatcatcgagccggcctaaaggaaacaatgtaacgattcaatacgcggcaaccaccatgaaagctactgcaaagcattcccgtgtttaaaggcgaactgtttcttgttgtgtatatgagctagcgctatatattgcagcttggagtatcttgagaaggaagaaagcatcatgcagaatttcctctccgtaggcacacgtatctcgtaataatgtcaaaacattttagggggtgtttagattcaagatggtaaagttttggcgtgtcacatcggatattatatagggtgtcgtttgaggtgttcgggcactgataaaaaaactaattacataatccgtaagtaacccgcgagacaaatttatcaagcctaattaatctatcattagcaaatatttattgtatcaccatattgtcaaattatgaagcaattaggcttaaaagatttgtctcgcaaattagtcgtaatctgtataattagttatttttttagcctatatttaatacttcatgcaggtgttcgatgtgacatggtgtaaaattttagggtgagatctaaacaggcccttacactagctagctactccctccgtttcacaatgtatatgtctaaattcattaatatcaatatgaatatgggaaatgatagaatgacttacattgtgaaacggagggactagttattgcacagttgacatgccatattgccttgcgtatgacaaatacaattttaccatcaactcatcaagttactaggtactctctttgtcttaaaaagattcaataaaaaaatattatttctcctaatgcaacgaatctaaacaaaaggttattcaaatttgagtttttttttttaacggagtaagtatatatacacatgcatatattggcactcttaagccttgttcggttaatccctcccacaaagggattgggagggatttggaggggatttattccacacctattgtggtgtggaattattccccctcaatcccctccattccttctctcttggggattaaacgaacaaggccttaagctgtatagctagctgggaaaaaaatacttaccgttctgtgggaagacaagcattaactaggccgtgtttagattccaactttttttcttcaaacttccatcttttccgtcacatcaaatgtttggacacatgtatggagtatcaaatgtggacgaaaaaaaatcagttgcatagtccgactgtcaatcacgagacgaatctttagagcttaattacgccatgatttgacaatgtgatgctacagtaaacatttgctaatgacggattaattaggcttaatagattcgtatcgcggtttacagatagaatctataatttattttgttattagactacgttcaatactttaaatatgtattcatatacttaaaaaaatttgacacgtaaactaaacacagcactagacaaatttatataccagccgccggctagctggtagcttgttctaactgcgagacaaattaattccaacgggtggacctggaccaaagctagctagccgtagcacacacagctgcgtcatgcacatgtaccaccaagtactgtacggttaaattagcatggcaagttagcattggcccgggaaattaactcgtttgttttcttgcatgtgtttataggcatccatgcacacgcaagggacggtaggggtcgggagagagggccaacgcaagcacgtcacagtgtttatagtacagcagaatagcagacactgtcacagtgttcagtggtggcaacaagcaatgcatgcaagcatgcagacttgcagaggcagatagaggggtggccatggcgaaacgaggcaaaaacgaggaccagctaatagctaggactcccttcctattattgtacatattcatatacttctctctctataaaaaaaaagcctagtattagcatgtaacatacaacgaatctaaatataaagtatgttcaaattcgttatactaagatgtgttatgtcatagtacgaggttaaatttttttaggacagagagaatagatgttattgaatctatacatatatatatgtctatatttattatcatttatataaatgtgggcaatattaaaaaatcttataatataaaacggcggaagtagctagctcttctcgctcggctgcacctggttactacgctacgttgctggccatgtgacggcgtgggccggcgagggaagagggaagggaacaagttagctagatagccctactacgctagctgtaatatatattggagtaattgtcatcaggtccacacctttggaaaacaactgctttcccatccatccaaaccccgaaataatcattgaggctgcgtgcaaatgcaacggccagggcaaaaacacaaatatctccggtataaaaacgacgtcgatcgatcgtacatcgcagccatgcatgaattagtgatgcgtggtaatgtaattaaactgcatgtgaaattgttatcgaattgtgctagtggtggctagatatactaattgtccggtcgacaggagacgcccagagatctttcaactagctccaccaaaccgatttactccagttttaaagtctcatctcttatatatatttgatattagattcttttctaatatttgtatcttaattgtctggtcgataggggcggttcgatattaattcactcggtatggacaagggatatgtttgccagaactgcatgcggtacggtaactacgtactcatcaataattccattccgtaccgacgagtatatgcaacaagggcaatgcacaatgcactttatttgatgatcaatcctgtagtagggctgcag

SEQ ID NO: 39485 - DNA, 7699 bp, Oryza sativa
cctagtatatccaccatgcaagcaaagtgctccagctgtggttccaatttgtagtgggtagtcatcaaatgaaagtagcggcagccatcatcgaacagcccaacatggctgcatgccctaagaactgcaacaaaagtggcatggtttggcactacattctctttttgcatcctctcaaacatcctgagtgcttctactcctagcccatggagcgcatatccacatatcatagcgttccatgatacaaaatcccgtttctctaccttctcaaacactagcagtgaatctggcatatccccgcatttggcatacatatctacaagagtgctggatatatattcatcatccagcatttcttgcttgataatctgaccatggatttgtttaccaagctcaatggtggcaaggttcgcacaagtatcaagaacagtggcaaacgtgaaatgatctggctttagacccatatctagcatctcggagaagaacttctgggcttcttcactctctttattgagtgaaaacccagataaaatggcattccatgaaacaacttgttgcccgccaattctatcatgaagtttttgagcctcatcaattatgccacatttgcagtacatgtcaacaacagtgcttgctacaaaagcatctgaaccaagtcctgacttgataactttatcatgcaccatcaatccatactccaaagaccgcaaagctgcacaagctttaagaacactaccataagtgaaatcatctggtttcataccaaagcgcagcatctcattaaaatgaagtatagtatcatcgtaatgcccattttgctcaagagccgcaataattgcattccaagagactgaatctttttgcttcataccttggaagataaggtatgcttccatcaatgctttgcacttcccatacagatccagaactgcattgttgacacagatgtccacatcaaaacctgatttaattgctaaacagtgaacttgctgcccttggaagtaacccttagtctcagcacaagcactgaaaacccctgataagctgactacatcaaaacgaatgctagacctaatcataaactgaaagagtcccatggcctcaattcctagccctgctcgtacaagcccaaccatcatggcattggatgtctccaccgtatggttgggcaacccaaagaatgctcttctagcatcggtcaagctattagccttagcatacacgtccacaatggctgtcccaacaactcggtcagaactaaatttgttctttatggcgtgcgcatgcaactgtctaccagtgttcaggcatgacattgctgcgcatgatctgaaggcactggcataagacggttggctcaccccaagccccaacctctgcatctcaatgaacagttctagtccacgcacatactgctcattttgaacacatcctgcaatagctgcaccccacgaaacccagttcctctcaggcataccatagaagaagcaaagtgcatcatccaaactcctgcatttgccatacatgtccaccaaagcactcccagtccggacatcgatctctaaccctgtctttactgccaatgcatggacttgaacgccaagtgacagctcttccaaagcgctgcacgacttgagcagaacagcaaacgtcgtccggtcaggggaaacacctcggcgagccatctccacgaatagatcaacagactcctgaaacatgccgcgctggcagtaaccggagacgagcgcgttccacgacaccacgtcagggtccggcatcccgtcgaagagcgcgaccgcggtggagatgtcccccgcgtgcgagtacgcggtgagcatggtgttccaggagacggtgtcccggcggggcatcgcgtcgaacaccctccgtgcgcacgcggcgcccgcgcagcgcgcgtacatctggaggaggcagttggagacgaaggcagtggggacgaacccggacacgaccatccgcgcgtgagcggcgcggccggcggcgagcgcctcccgtcctgcctgggcgcagctctggaagacgcgggagaacgtgaccctggcgggagccacaggaggcggctgctgctgctctgctggcatccgggcatgctcggcgagagcgcgacgcggggggtggaggccatgcggtggcggcggcgtagggcgaggcgagcggtggaggagcggccaccttcactgccgctgccgcgctgcgcatttgcccatttgcgcggcggaggcggtggccgccgacgaggcgacgattcgacggggaatttggtggtcaaactacatgggctaattgggctctcatacgcgtgcttaggaataagttcatctcaggtcccttaacttgtcaacgaatccgatttcgtccttcaaccgcaaaacagatacaacgggtccctcaactatcaaaaccggtgcaaattagatccctcgacggtttcgatggtggttttggctgacgtggcgtctacatggctaattttgacttggtcttgatctgacgtggcaatgatgtggcgcttacgtggcaattgaatccagaaaataataaccccgtgggacccatatgtcagtttcacacacaataataataatagtaatggtgggacccatgtgggccccacatgtcagtctaactcaccccctcctcttctgcttcctctctctccttctcccctctcttcatctctctcttgccctgggtcattctgaggtggtgtttggatccatagacttaactttagtccatgtatttagacactaatttagagtattaaatatagactacttacaaaactaatcatataaatgaaagctaattcgcgagataattttttaagcctaattaatccataattagagaatgtttactgtagcatcacataggctaatcatggattaattagactcaatagattcgtctcgcgaattagtccaagattatggatgggttttattaatagtctacgtttaatatttataattagtgtccaaacatccgatgtgatagggacttaaaagttttagtcccatctaaacatggtctgattctcctcttccccatcttctctgtcttcatctctcttccctctcctctctctcttctctccagttgacgggcggcggggagagggcggtggccggcggggagaaggggcgcgacgcggcggctggcgggagggaaactagtggggagaagggaaccagcccggcggcagaggcagcgccgccgtggccgtggctgcggacgacgtcgatgccgacctctgcatcctcgaaggcggccgtccgcgtgggcggatgagggggccacctcgccggcgggagaggggagaggcggctggccgcgaagacgaccccagcgacgattacgaccgtgcagcgcgcggcggaggccgatcccgtgagcaggaagctcttcatccacggcctcggctggggcgccagagccgacgacctccgctccgcattctcccgcttcgacttcttcctcttccgctcctctcttccgtcggctcgcgctcggcaaatcccgcgcgtcgttgtcgtcctcctcctcctcagtccagccctcgtcgtccattctccggctcttctcccaacgacgtcgcagtggaggagggcacggtgctgtgcatgccaccgaggatgctgcacggcgcgtccaaggagtttcttagtttgtgttctgtttggtcttaattttgtttatgtgcctaatcatacaaaggtagaagcaatagcaactagtactagctgactggagtatattttgcttcgtcatcatcatttgcttgtggtacgacgggattgatgaatgaatgaatgatcattgttttgggcaagaaaacaccgttccggccggactgacgaggaacccatcgatccgctcgccgtggcccatggaaacccaacaggagatggcggcgctaccttccgccgacggcggctaacaacggtgggtgatgctcgagcacattgaagaactcgaggtcgacgatgaggactccaactacaacttctgctctgccgctgccgacgacaccgccaataccgtgagtccatgatgaccttgctcacctctgacggccacgtcgtcagcgtatacttccgcctcgaagcgcccccggcgacgtcacgcctatgcccccggcacgctgctccctcctctcccaccggtgggaaggagctaggcgagctccctggcctaccggcgagcgcgcacaagagagagatggccggcgaccactcttctccatttccgccgccgtcgtcgactcgtcgtcgccggccgcaagagagagatgaagagaggggagaaggagaaagaggaagcagaagaggagggggtgagttagactgacatggcgggcccacgttggtcccaccattattgttattttttttgtgaaactgacatgtgggtcccacggggtttattattttcccagatcaaattgctaagtaagcgctacatcaatgccacgtcagatcaagaccaagtcaaaaatagccacgtaggcgccacgtcagccaaaaccaccatcgaaaccgccagggaacctaatctgcatcagttttgatagttgagggacccgttgtatctggttttgcggttaaaggacgaaaattggattcgttgacgagttaagggaccttggatgaacttattccgcgtgcttataccgtttcgtttcttgaggcctcgaatggatgggcctcaatctcggcccacccacatatatggtcctaaagtagtaaagtgaccattcaaaagaaattttctgaaagtgatatgcagatgttttctttggggaaaaatatgttctttgacctccttagttgaatgcagcattttttttaatacttcataagatccatcaccaaatttgtgtcaggtgagacattgttaagtccaattggaatataactaagacttttcactgacagatcatgcatgtgattttctcccatgagcttgagtatctgaccaaacactcctacggcttaattagtctccaacatgctagcatcaccagtactaattaattgctaatgctccatggccggctaagtacaaataccaatcacactttcttccaaaggaaaagtacaagacttgatctgaaaacaatatttgtctgctccaggaagacacctacacggctacacgactacacctactgaagaagaacaggagcgagaaaaatcaccaatggctcatgcaagaagcacaggatctctgccggtggcaaatgttcaggcactcgcagagacctgcaacgatccagatcagcagatacctgagaggtacatcagagcagacgccaacgccgacgagggtcatcagcgggcgacggaatgcacggcccgcaattcctacccgtcgatctcagcaagttgctcgatccattgtcgtcagacgaggagactgaaaagctggggtctgcctgtcagcaatggggattctttcaggtatgcagatttcttggcagacagactgaatttgatcagacaagttttgaaacgtacgtacgtagtgagagatagcaaaagcgttgactcacgatatggatgaacatgaacatgaactggtgaactgcatgcagctgatcaaccatggcgtgtcagaggatgtgatccgcgacgcgaggaaagacatagccgagttcttcaggctgccaatggagaccaagaaggcgtactcgcagctgcccagtggcatcgagggatatggccaggcgttcgtggtgtcgcacgagcagaagctggactgggctgacatgttctacctcgttctccgccccggcgagtccaggaacatggccctctggcctgctcatcctccatccttcaggtgatcgatcgatcaagatcaaagtcaaactgcttatgataatcatcaaattaatcttctgcggttttgattgcgtgttgttgaaaaagagagagtaatcttggttcttggcgatcacttgcctgtgatcaggaattcgatagatcggtactcgtcggagacggcgagggtggcgagatgcctgttggagttcatggcgaaggacatgggcgtgaggccggggtcgctgctggagaggttccaggaccagccgcagggcatcaggatgaacgactacccgccgtgccgggaggccggcaaggtggtcggcctgtcgccgcacaccgacgccgcctgcctgacgctgctcctgcaggtgaacgacgtgccgggcctgcagatcaggagccccggcggcaggtggctcgccgtcggcgcccctccggacgacggcgcgttcatcgtcaacgtcggcgacatactcgaggttaccgactgaccaacaatggcgtcgaggcaaacatagccatcgccgaggatgatttcttggcttcatgtttgctttgctgctacgtgcgtctgcatgcagatcatcttcttagccggggtcatctgcattccttagccggggttgctgtttctggggatttcttaggagtgtagcgtggctctacgccttcccgctattagaagttgtgtttagcctccgtagttcttcctaagatttagtttcttattttatttttctttctttggcataagccggtctagttgattgtttttttaaaaaaaatcaagggcaagggttcctatttccattactagaaatgagcaaagttatatagttcaaatagtctagctgattgtgttatgtaacaaaaatttattttcttttaatatattgacatgcaatttttttacgcgtctcgcaaaaaatgcatgcagatcatgagcaacggcaagtaccggagcgtggagcacagggcggtggtgcggccggacagggagcgcgtgtcggcggcggtgttccaccagccgtgccaggacgcggtggtcgggcctctgccggagctggtcggggaaggcggcggcgataacgcgcggtacacgtcgatgggctacctggatttcatgaagcgttactactcggcaaagctcgacggaaggaatcacctcgacggcttgaggattaaactgtcatcttcgaagggttagaattcattcatgttacaactgttgtaaacttgtaattggaaccggatttgatcaaacaatttgaaatactttcagcactagcaaatgtatccgtgcgttacaataggttgtacgaacataccttgtcttttttagactggtcaccggggggtgagcttaccttagcttgtacatcttcaaagaatcattgtaaacacaaggaataaaaagcctacgctgttcaacatagcataaatagaatataccctaagcaaaaattgcaccaaaaaaaacaatgcacaggctcggtaatttctctacacctcaaattttcttacggtgacctgagtagttacaatgacctagtggttatagtgacctgagtagtactacaaggtcctgagttcaaatctccatacaagtgaattttatattgggttgtttgcggggctaagttccctatttcaatgattatatatatatatatatacatccagttgaatgtaaaggccgggtaaaatatacccttctctaaaaaaaaattcttacggtcatcgagtgtgttccatttcatagacatgtgtattagcaacataatcatgtctcaatccacattgatgcttcctcgcactcttcatttaatccaactattcaccga

SEQ ID NO: 39486 - DNA, 1323 bp, Oryza sativa
cacaattatggctcttcagagttcagagactgactgaatgtcacatttcagcagctaacattttcattttcagacaacaaaagaatctaccatgcattaatttcatttaagacaacaaaactcagcagtaaaaaaacttccattttctcaacagggagttctctaaactttcaggatttctatgagcagaataaactgcaacctctgaaccaggaacaataacactatggcacgtacatcttgggaaagattcaatttttgaatggtcgtgagaaatatcaaataacacttaggccaacatttctaggtgaccaaccaacatcagggaaaaaaactcaaaaggtagccgtgttcttgcagtgccaagttggaatccataccattgggagctgtaaatggcacaagaggagttggatatggaggcaaggggaaccggcattgccgtgccagctgcctgaaccgatggcgtcgcttgtagatgcttcgcagattgcggcagcagtcaggtaactgaaatcacatttcctttccctacatgaaagaaaccctgcagaaagatgcaagagaagctgatgagaaaacaagatttcagttctgaaaaaccagtgaaagctccaatggaaaattgttagaacatcacttcagtttgcaacaagaagtttcaggactctttatgcaacagaaaactggtttagcaatgcacatcagtagcaaaaaaattcagcttcttggttgaatctctcattaaatctgatgttcaggttctgtttacatataccaaaaaaaataagaaccaccccataattcaagatgtactaaaatttgcattttgcggtgaacaaagatgtactaattattaattattaggcagggcaataccatctatccatttgctcgccatacggccaatctgggatatgctctgcaccatcgtgacactctcgctccttctgtccagtacacacacaaaaacaaaaaaaaaatcagaaagacgaggattggagtcaagagagatgaggaaagaccaaaaagctaaaaagctagattagtaaacaggtcacaaccgatggaaatatgcacaccacagcagtagttgaagcacaaacatgggcgtggaggtggtgccgttgccgatgcccaccatcaacgaggccatggcttcctgatccacggcagcaatggatccgctcgcgcgaggatagaggcagacaaccggcgacgcgtgaggataatggtggcagcaccgagatgcacccctaaaaagggtattaggggagccagaaactcttttctatcaaacaaaatatagaagttcatttaccc

SEQ ID NO: 39487 - DNA, 9010 bp, Oryza sativa
  unsure (1)..(9010): unsure at all n locations
attatttctccaacaaaatgtgaaaatacactccgcggtgcattcaagcacctcttgtaagctgaaatccttgtttttcatgagaatcctttgtcctttggctgtctattcgatgattcactcccattggccctgaaaccttttccatttacatccttgctgaattgataacataacaatattgatgtcaatacatctatcagaacacaagacggatatctttgtatgaccacagcaagcaacaaacgtgacaaatcacacgactgtaaagaaagccttacgcaattccaatactataggttgatttatatccttttgaaagtcctaattaatctaatgaaaatttatcataaaaattaaggccttgtttgaattttttttgtctgaattcacaatggacaaaaaatgaaaaaagagaaagatgatattagacaatataacagtgagaaagagcccaccccatccacgaataacaacaatatgattacctgaaggagttaatgtacgtgcatagatgaatgactggaccattccattttcaaatgttccaagtagctgaccccaaaccctggagctgagagatgtggtatagcctaaacatgatggtaatagatgtatgcattagggaacgatttacaccagaaaatagtgtgtatttctttttgacaaaatggatgtttgcgatggtcgcagtatacgataacatttgttgcttttctatatcaaatcactgtagaagacaatgtggaaaatacaaagtttaataatacagtaaaaacccttacaagcccttgaatatttgaaaaaaacaatgaggtgctttgagcttgctgtaaaaaaatgcaccaaataaaataaagcaggattaacagatgaaccaattgcacagcctatgaaggaacattataggacatgatatgcacgcatcatcaataatcacactattcaaatgctcacctgcatttccttcttccgatcaatcaccaaggctgtatttgggccatacaaacgaacagtcacagaagacttgttgcccttgccatcttctacggagacactcagcactgcaagcagtaaattacagttgttgtttccactaagttctcggtaaattggtagtacttcagtgacagaacattatataattttctatagcaaacaacataagataagatgatttaggcattaaaaaagcaagaaagaaatggtaaaagagtccctgatctcacaaaagttcagaaatgcaattaagttcataaatgttcagaattcagaaatgcaatcaggttctggtaatagccataatgttatgtctgccgctatccaaattgctttaaaatgtgcctaaaaccaattttccctttgtttgagcagcagcctgacctctgttttcctctacttacaacgagttgcttaggtgaagcaggaaggaaaaaaatcatgacaacgcgacaagccatgaaactgccaaggagcagggactcacacatattcgtgatgctgccgccagacaccgtctcgatcgagaagcgcgagctgtctagcgatgaccgtcctctcaccaattccttgcagatacctctgcacaatcgcgaacgggagtccttgtgtgagaaccaaaaaccaaattgaagacagataacgacctcccgcaattcccttgatgagccttttctctaaaaaagaaaaaaaaaaagaaaaactcccgtgattcctccaactcagcgcccgcacccacccacgaacgcatcgaaacgaaacgaaaaaaatcccagaagcaaattcgaagagagagagagatggaggggatcaggggtactcgcatgatgcggggcgtcatctccgggagcggcagcgcgatgtcgacggacgcgccctagccatcgcctccccgagctcgccgtctcggccgctagtcgggggcgctcgatgatgccgacggcagtggcggagacggggatggctgcgctcggcggcggcgcgaggcgggaggcggaggcgctcggagacgacaacgcgacgacggcggcggcagcggcgggggaggtggaggcggcagcgcgagccgacggggacgacgatggctacgttgcaaggcggaggcgggggcgcgaggggaaggcggaggcgacgacggcggcgcgagggggaggcagacgcagcgggagagggagagggtgggatgagaggtggcggcggctagggttttttgggggaggtggacgcggccgcggcggtagaggtgggcgcggccggggggcgcgaggggcaggaggcggcggcgcgtggcggcgacggcgggagaggggaagggagaggatgagggtgtgtttagttgaggaaatgaaaatttttgggtgttacatcggacgcttgaccgaatgtcggaaagggttttcggacacgaatgaaaaaactaatttcataactcggctagaaacgcgagacgaatcttttgagcctaattaacccatcattagntaattaggctcaaaagattcgtctcgtaatttcctccctaattgtgtaattagttttttatttatctacatctaatgcttcatgcatgtgtctaaagatttgatgtgatatttttgggaaaaaattttggggaactaaacgggcctgaggagagacgagagagaagagggcggcggcggctagggtttggggcagttagagttagtgcgcgtcgctttgcggaaaagcccctcgtcttttaagttttacatcgctgtccttactcgcgatttttccctcgttttaatgtatatccgacttttataagggtctcgacctaaaataacatctcacaggtactgtttggagggagctatttcgaattacaaacaaattggagggctttttcgaaaaatcaccaccgcgcgcactgttcctatcctacgtggcatagccgagcggacgccccttccgccgctcttaatggtttctaatgtgtcatttattccatactttgcgctggtaaaagttgctttttgatattttattattcttcaggcatatgcgcgaaccaaacgcacaaagcttcagcctgcctgatgaggcaagtgttacatctcccaacgctgcctgtccggcgtgagtttttctcaggcgtggccctcaggacacaaaccaaacaaccccttaggccttgtgtattatttacaagatggaaaaaaaaggaaaaagttcacttgacgtccctcattttgtcgtcgagttttgtaatactggatataatgcatcccgaatatttgcaaaacggtcacattaggtctgaagacagtatagctcccaaatttagttgacgtggcatgtgagtcagtgtgggacccatatgaaccccacatgtcagcaccacaagtccacaataccctcttccattcccatcccctctcttcccatatctctcatcgtgcggcatgggcggagccctagttgacctgatgaagatgctgttgctccttcggtgaggcccgtgagaagctttgctagggtttatccccgcgtcgccgccccaaaagatgagaccaccatggccgcggtccagtggtggtgttgttccagaccaacatcaccaaggctgcgtcgaggctcggcgccacaacctccatcatgtttgccatcgctctacaacattgatggcaaccagcgcgccgtcatcttatatcggttccgcggggtgctgccttggacagtcgagaagaagcaggtggcatagcaggaggccgagagcgctccaattgcctcatcgccaaggctgagcaagaaaggcgcccgtgcatcatgcacactgaaggagactgttaataaccaaatttagtaatctaagtatcggagatgaggatgggattgaagcggaattcgagatggaaatcgtcatgaaaacagagtacggatcggctgaagtccgaatcggctgcggttggggtaggcagagttcgagtcggacgaggttagccgatcgagccgaatccggcaacgtgacgcggtatgcgttgtcgggttgagctaacgaacttcatgaggattgccacccatggatagagttttgagaaggcaattgtatatattaattaggatatttcatgtaatttccttagagatatgtttgggcaaaagtctgccgcaaagacttatggtatcttagagtttgttagaaataagagtcgtgtccgacatggacatattttgtaatctcaggtataaatagatcccgagccctatgtaatcaatctaacacacgttcaatacaatctcggcgcatcgccacccttttactttcgttttgtttcgacgagttcttgcttttgggttgagcccgcatcggtttcgatcttcaactagaggtaaaacttgttatggcggcttgcgttctcggtattagtgcttacatctttatgatactctaatattgcttatgtaaatcgtcgagttatcatatattttatgtaatctccgtcaatatcgctatctaaccttcaatcggctaatgtctgttactagaaggcagtcgattaggttaaataccgacgttgacttagattacataggatatcaaccactctatgaaacatccaacggcttgattgtctagatattgtccttattttcatacttatacctgcattagttgagtttgatcttatgagtcgtgattagaatctcaacctctagcctgtctttggttgccgattagggtagcatcgggtttcagccaatcttacctgatttaactatatttttcttatatgcttgattgacatgttaaatctgccctttatattaagatcttgttgcatttaggtatattaggctttcgtttggtatattctacttgctttaatatcttaatatagagtggtatcggagtattagctgatacatgctagatctatatgatcagctatgctatgaacatatatagtcttgttgctaatatatctttcgatctaagtaatttatactgtctcggcatggcgaccgatctatcccaataacttgatttaagtatatatcgacataaggattatatattgttaatatctacagccaatcgagtaaatttagttctttcttacttattcacgattgccgatcgatctacatatgacatcggctcaaagataaatgatatgtcatcggcaactagccgatcagctatcatttatggatttaaccgcggtttctttgtctttatttcttgttgattgcaggatcaaattaactggcacggtcatacacttaaaggcaagcttttggacctgcactggagttaagcagatctccaaggcctcgtgtttttacatcaacagagacgtagccgatgatccttaatcccggcgtcccagcaaaaaacgctttccgaaccattgaaggagttattttgcactagttttcagagacgggggagatgttataccggttttatggttgagggaggaaattcaatcaggaggaagatgagggatgacttattccaaagggatggggagagcccttcaagggcatggtctgtctgatgggccgcgttagtcaaaaacctgagcagaagtaaatgggccaatcgttctgcatttcacaggttctgggctggaccatagaaattcaccgagaagcgactcgaaagcagtagttcgtgtcctcggaacgaacacgtattttctaatttacgtgtctcccaatcgtagccgacgacggtcggtcgctctctctcgctcctcggctcctctccatttcccatcacccggcgctcgcatcgcgtcgcactcgcccaacatcgcaagcactgaagcacccacacaccctacctccacacgccctagctcgctctcccagcgtcgcgctcgccgccgccgccgccgccgccggcgggatgatccccttcaattccgccgtagccgaggatgtccgctccctggtgcagggcgtggacgactccaccttcgactccacccaccgcgagctctgccaggtaaacgcgagccgccctgccccgccccgcccgggcccgaaatccacggcccgaggtgcttcgtttcggcctggcgttttgcgcggcggcgattggttcgtgccgcggtcgtagatccgccccccccccccgtcgcttggatttcgtctttttgaagcgcctcaatcttgagggctgatctagggttttggcggatttatctgtcttgtgggtattgacgaggagcgatactagggcatcgcctttgatgctcttctccgcgacttaatctagggtttcggtgggattcctcacgattggataacgtgggatgtgttggttggtgttttttttttgttgcatagatccctcaatgtggtgcacgtgttccatggttcaagtttctcagtttgatggtcgtgcaaaatttactcttgggttggaataggacacttaagctttggattgttttgaatttagcctgacttgtggtcagatactcagatgagaattgtgttaagatgcatatgtttgtgaatttgtacaagattttgcattctttgtcattgcagatgtcttgggatgtctgtcttatgtttatacttacacaatcaactccgctagaccaccatcgactttttagtattggcgctcttagaattactcatttttgtcagaatgacgcgctgcattttattgtattattggtgcatggtgtttttagcattatggactctggatcattctaaatgatttataccttgtctcttgttatcagaactgttctaactcatttgcattcataattatctccaccggaatttgctttagttggtggaatcctttctaatattttttacctttcctttgtttcagctagcggactgcagtcctgatggatgcagtttgctgcttcaagtttgtttggatgaagtgctgctgaatgccgacgtggcaaagagctctcgattgaaacctgagctcttatcaactgttttcaagtattgtctggataaaccatacttcagcaccagtttttgtgaagcactgaagacagtacatgtcagtgatatgttccttgtaaaattgtcaaatgaacttaatctatctgctggagagagggttggagttgggcttgccctatcagattctggaaatctaggcttgattacgaaaggtaggtgcttggtagatcaatttccctggcttagtcatgtgtcagttctcattgaaatgcttaattacacctctattctttgctttatagggcaaaagttctcaatcgctgaaatcgaggagatatgtgcaaatccagcccatgttttaacaaatgatcaaattcacgatattgttgtgtttcttcaccagactgatggcctctcaaagcatatggattctttcactaacatcatctccctattaaatgtcaaagagatgccattctatgttcctgccccaattaaggaaggcaacgctcggccaacaatttcttcaaggtttgaagagttccttctatttacattatgcttcattttcaattttgctttactcatgcacatttcattgcctttttggcaccttacaggcacatggaactatacactggtagcttggatgatgattttgattcccttctatctgaaattgggaaagaaataagcatggctgacatcattactgaattaggctacgggtgtacttcagatattgctcattgtaaagaaatactgtcactatttgagcctcttgatgatatgggaatctctaagttgcttggagcagttgtttgcactcatgttggtcttggtgaagctcataatacatattcaacgttcatgtcggccgttggcaacagccaaccaagtgactcatctcaatttactgcatggaatattgatgttctcgtggattcaattaatgaaattgtgagtctttatccttcatcttcttgattatcattgctgtcaacttcttttccttttcatttcttaatacgtcttgtcttgtgagtgcaggccccaagaactaattggattactgtagtggaaaatcttgatcatgagggtttctgtatccctgatgaagcggcattttgtttgctgatgtctatatattctcgggcctgcaaggtatgaagtttttctgttgtactgtactgaaagtcatgaactgttttacggaattattgattgattcatacaggatccatttcctcttcatgctgtctgtgggtcactgtggaagaatacagaaggacaattatcattcttgaaacatgcggtggctgcgccaactgatacatttacattcaaacattgttccaggaagatggtatcactgtcctttcaaaatttctttaatcctaataaacatcttatttcacacttgacacgtctaacctttctgatcttccttaggtattccagaatttgctaaccgcatgcaaggcaatcaggcttggtactgcctggaccttctagaggttttatgccaacttgctgaacttggctatgcaacaatggttcggtcaatgcttgactacccactgattcattgccctgatgttttacttcttggtgttagccacatcaatgtatgctttctgttccaattttgtttaatgcctccccttgtatattatatatctttttaactttaggaacaacattgtctatttgcagactccatataatctcctccagtatgaagtattgtcttgtgttttccctatgatactgaaggacactacatacagtagtcttatgaactctctctggcatgtcaacccttacctcactcttcgtggatttgttgattcacattccgacgcaaattgccttctcagaactgttgagatatgtcaagacctaacggtaacacaattttgccaaacttttgtagctaagtttttaagttgacaacttaacagtcttgtagtttgtttatattttatctgaagtgttaactttgtaattcaatgagcctttatttggtactcggtgactcttaattttttttatttgtgtacaaatgaagtggacggttaagatgtag

SEQ ID NO: 39488 - DNA, 1138 bp, Oryza sativa
cacattgcaaacaaaacaacttcaaaaataccaccgttgaaatttcatatttaaaaaataccaccgcaatcagccaaaataagttcttgaaaatgctgtcgctgtgatgttctgtacagatatgctttttgaacctttttggggcagaagattctgtaaatattaacaatatccttttttctcctcttcattgcactctttgagattacctttagttatatttgtttctacaagtaacttgcatgatgggtgctttatgtggcaaggaaatgccacctttgccaaagttatcttgcacctgatcagtttggtccttctagcttttcaagtcaattagctaaaatctcttggtatcattcaagagccatggaacagatttaagtcatttagatcaatgatccattttaccaggaccatccttttgctgttcttttaccatcacatgcacactatgaaatatgtaaaaatagaaaaatgataggactgtttccatgcatatagatcttttggccaagttaattcaatcatgggtaattagttatcaagaagtctgttccaaatagttttggcaatatgactgtttttctctgtacaagtgaatccgttgatcttaaaagtcatgacttgtttctggatcaagctcttttgagtgacttaacattttgtgcaggtaatatattctgacgaagataagaagtttaacatcgacataattattggactaattcggtctgaactgattaatcttggggattacaatgttcatttggcgaagattattgatggcggaagaaacagtaagttgagaaagtacttgaaaagctagttcttgtttaagttgggtattgttgtatgtttggcattcaggcatagatatacctgtgttattctagcatgtagcaagtgaaaagttttcatgcattccgtttattggtttgtcagttaaaacagcttgcatgtcctgtattgatgaaacaaatagggatgtgatgaaacttatccataatttggcatactgcatccaatgttcaggttgatgaagtacttgatttagattattgaatttgaaatgttgctgagccaacttgttattgattttcttttctaacatagtttcactaatcgaactatttggtta

SEQ ID NO: 39489 - DNA, 1129 bp, Oryza sativa
ctcactgctaaaaaattgaactcatctttactgactaacatttgctaacaaagctaatctttttgactggaatttgattacagaactagcctatgttgactgaaatgtactgtcagaactaattattctgggtgctaacaaaactattctgatatgttggtgcctaacattgttagaggcacacaaaactaagcattgattatctgacatttgcacatactttcagtgaattaaaatgacctaaacagaactctgaaataattatagtgaaaaccctcctgaaatttcttcaggccaagaacaaaaatagtgaattgtggatactatgatagaaatcaaattgttggtgataaaacctaaaatcataaagtagtcatcaaggggcctccccttgctctaactccagtactccacaaaatccatgtattgttaatgcatatattcaagcaggtcttgttgataaaaaaatctcgagaatatcagacaaaaaacaaatatgcccccattgccagtacatgaaaatgcactaatcctcccccaactctgttgccaaccctcgggcccacatgtcagtgagcagatgatctggattgtacttgtacacatacaaatcaggaaagcacaaaaaagataatagaatcactaacctaataaaagatcaaatacatcctccccaaatgtatatagcttcagaaactgcattatacatcctcccctaatgacataaaactttagatcgaacttaatcaaccaaagtcaacgcacagcatgacacagatgacaaggatctactagcttagaaaatggaaataaactattgctcaccatctgggccgtaaacatcacattgcctaatttttaggagctgaagccacagccgcaacagcaacctcccatcacctgaagattgcttcatcgccgggatgccttgtcgagtcagcggagtacggagtggcgttgctgcacgagagaagaattctctggagaagacgagcgaggccgtcgccgagaagaaatcggcggagttgcctcctcccatcgtcgccactcgccatcgacattcgacagcatcacccaccgtcgaaaagggtggaacaaaccggatccaaaccgaaatagcttgataaaa

SEQ ID NO: 39490 - DNA, 17248 bp, Oryza sativa
  unsure (1)..(17248): unsure at all n locations
cgacctgattcaacccggttttgttagtttagatttaacccggttcagagatgtaaaatgaacttatttcttaattgttcaagaacaaaaaggcctaacccagttgcaagaaacgctaacgatgagcccataataataccggcccaagggacccctcacagaaaccctagaaccgcctgattttcatcataaagacccctagcgccgcctccgtcttcgccctccgttgctccccctctcccagatccgcccgcctccgccgccactcgcgccgaatatccggcttctcaatccgcggaaactactccctgttgttcgtcgacctcttcgtcgccggagacatctaggttttctccctctctatgttgctgtatgtttgtatggtcgcctcaaaactcttttgtaagtttctttattatgtgctcggtggctaattagccaatcacacactgcggccgccatggcagcaacctttaaccctgtgtgaatggtcagtaagcccacctacattgatccgctttgttgcgtcgattggaggaacgactcttcttgtgcgtgcttccttcattgatgcatcaacgcacactgctatataatatgacctagctctaagttaaatccatcccgtgttgaattcgttttctaggttgcaaataagctgttttagaaatactagtggggatctccatgactcacgtatgcattattcatttagagtggagggttaggggtactgacatgaacaagtgcggtgactcgttagccagtcgcaatatcaaagctctgccgctggtagtaggtggtcacctatatttagttttcgcggtctgcatcttgtgcaatgggcggatggagcaatcggcaaaatcggtccttcaggctgttgttgcgaacactgcttgctgctgctttgctaacagtcaataccaaaacaactctttcaataccaaatcaactctttttttttgtccctttctctaagcaagtcatctcaccacacctgatgttgtgtgttagttgtggtggtagcattttttcctggtagcgcgcagctatacgctattctaagtcaggaaggcgatgggcatttagttctagttatctatatgtagtatgcagcagttgacctgttgttgctgagtggatcatagcagttggcttcaccgcattcatactttgtagtttgccttgcatagacaatctggtacagcgttgtatgaaccttaatgttctggttttgccttttgttatatgttattggacccatctctttgtgattttacttacaatgttgattacgcctagaggagacatctaaaagtttaaacctattctagaaagctgaaagtatcaaaatgccctgcctatcttgatgttcattgaccatgttcctccaaacccctaatggaaatgttctcatctctataaagtatacttcctccttcccaaaaagattcaaatcctaggatgaatctaaacacacatgtgtctaggttcatccctaggatttgagttttttttgggacagaggggagtactactgaattttgatacgtcgagaacaagtaatctttgttcaaataggnnnnnnnnnnnnnnnnnnnnnnnnnnnactttttccgactgaagtatcagtagtaatcattatcaggcttgtctgacagtgtctggcatgatgaataaattgtataattttttttcataggattcacttgtgaagttttttttttatcatctgcagtttccctatacggctataccatgtcgatgcctggtgatgcccaacctgaaggttctcaccaatccgcttcctccgcaaaacctgccttgtcatcgtgccggaggaataaatctgagaacacgtcatttgtctcagatttgagagatcacatccaggagtttatccatgcttccccgaatgagcacaggacctgttttaccaagactatcaagagaatgtttggcatgtcaaaggtcgttgcagagagatccaccgaagcaaaggaacctggagctgaaagtgttttgccacttcagaccacggtgtcgcggtagactgtgatcagtaatataattttctctgtagaaagtaatctgtcgctgaggatgatcttaggatagagaagtcatagttacacttgataccagtagatcatgtacagtaactggaggatattctgtattaatttgactgctaaaaggcctatatatattgtaagaagagaaactgagaagcagttctttgaattatctacacccaattgtgctatcacactagaagagacatttcctcttctatggaatcacgctgcacagcataacactttttttttctttctaatccaatcaaatctttttgttgcctataaaaacatgtctatcatctacaattgcgtcacaagtatgaccaagactgtacaaagcagcctagctgatccagcaagcaagcgccgcggcgacgagctggacgtgccctgctcggagagcgagctgaggctgaactgtgggttggagccgtacaacgcctgcacgccctcgacgtcgtccacggtgaggcgcaccttcttctcccgcggcttgatgctcgggtacatgacggcgcgcggcgacgccgagtggccgagccccaggacatggccgatctcgtgcgtcgccacggactccaggtcgatggccgacgccgtcgcgtcgacgtcgaagtccaccgcccagtgctccgacgcgtcgaggtggagccgcccgttctttggggagaaggcgtggccgaggatgccgagcggcccgtcgaacggcacgccgtcgccgtggttgccggcgtagaagcccaccttgatgtcggccgcctcgtagtcgtccgtctcgacgaagcccacggggatcgtccgcgcccaccgcgcgaacgcgcgctggaacacggcacgcacggcggccggcggcaggtagccgacggtggccgtcggcgagacggcgtaggacagcacgatcggcgggtccgaccgcgtccatcgcggctcgcccttgaagaacgtgaaccggctgaccacgccgccctgcgcccccggcgagagcgcgacggacacggggcgctccacatcgtcatccccgacgccgcagcgcggcgacatgatctgatcgagcgtggcgttgtcgagccggccggtgaccggcaggctgaacctcgtctggtacctcctcacggcgacctcgaggtgctcgtcgaaggcgtccgtcgtgtcacgccccggcttcgccatgtacccgaacctcgccaggtaccgcttcagctccgcgagccccgtgacatggctccctcgccccgcgtcgagcagctgcttgaacgagtgccacgccacgccgccgtgcccgtgcaccacggggagcccgagcaccaccaccatcgccacggcggcgaccaggcacgacgcggcagccgcgcggcgacataggaacatgagagcgcgcgcggcgtggcgtggcgagggcgaggcggccggtgtggccgttattctcgttatcgtgggggctcgcgggggaggcagtggtggacgaagaattttatgtgcacacgagagtacgagacgagagacagaaaaagctgtggatagggagaagtgggtcagccgatggagctccggttggccaccggctgacctcgtcgtcttcctcctcctcgcggcggaggagagacggtcttcctcacgtaatccactggttaagaattcaatctcctcaacgacgaccaactgtcgccggtcatcgtcgtgacgcgaaaatacctaactccactctctaatctaatctatgtactcctacttaacttggtttcgatttggggataaaaatcctaattggctcatcacgaaaaagaaagaggataggcgctaattggaaccgatcataaaacagcaaaacaacaagctgccgtgtggcggtaaggggtttgcttgacctgaagatggcaggaatcgcagggagagtatcaggttcaacgcgtgttggtgttcagaaaaaattgggggtcaatttgtcgaattgatcacggtgctgtgcacaagaggggattggattatggatggccttgtcaaatggtgctttccaagccaaaaccaagaaagcgattggacccgtttctctgcttggacctgggaggcttacgtttgtggacagaccaagaaagagaagctgcactagcctagcctgaaaggtaccttcgagttgcgccatcgcgttgaacaccaacgcatggtttatttttcttttcgttcttctagctactactgttgtacggtatgtatttttccctcatagacatcatttttccatggaatcatcatcatcctatggactgaaactactgaaaactctgcaaaaccgaattagaatcaattaactctggattgctaagttgcgtagctctctagtatagtataattaaccaagttgagtttgacatggatgatagtatatgatataaacgtttcagaaaaaaaaaggaataacatatcttgtttctgatagggtgcttcacccatccatccaatatggctaacatgacaggatcgtatgttgtcgcaacactgccgtgtcatcgtctggtcgatgccgatttcttcgcgtcaagtgcgaggtggtggtgagacacggacgcaatatctttcatccatatcacgcgggcgtccatccgatcgcgacccgcgcgcactagagccgtaccaacggtttctccatgtcattttgattggtctgcttgcttgcttcccttcttaataatctccatcaccttgaataataatcttctaattgtagtacttgagtttttttggtctgtgcaattacgcatgaaggtgttgattgtgagcacgcaatgtgttgcagagtcagtaagcttgcaggagtttgcaagaacaatgcaatttgcagtgtctctacgtcatggcttggctctggctcgtgaggaggggagatggatgacttctgctttgtttattctgtcaacgagatgatgtctggtacagtgtgttggtgcaggattcgttaaaatctgacatgggagagagcaggtattgttgatgagtacggtttggtttaagaacaagatgcctttggcaggcagaggccaccagtccaccaagctggaagagccatggagaattggagatggaggctttgcagcatcagagtttgcgattgcactatcgcagccttccaagtctggttgccgtggaagtacaccaacgttgatgtgcatattttgcaggaggaattttctggtgaaggatgagagtagcttttcgatcgacgcatgtgctgtcacggtcgcagaggaaagaagaggagttgcgtccatcggcgtctggggctccagcccacaaagtggcagctattgtagtcacggcccatatacgaagcttttagctttggggcaggtctcgaccagcatagccttttgcattttactccccccgttttataatgtaaattattctagcatttcgcacattcatattttttttatatactagattcattaacataaatatgaatctagatactagattcattaatatcaatatgaatgtggaaaataatagaatgacttatattgtgaaacggatgaagtactattttagtaaatagtttgtactatcactgctcagtagagttggattgtaacaactgtattggctttgaaaaatgttgacaccacactagtaagttttgttttaagttgtgattttaagttgtgaaatatttggtagggcaaattttaacataaaactaaagcaacccttagaatatatattctccatggtgaggctatgagagacgccgaccaaccttggtgaggctagacagattcttctgtaatgaggaatgggaccttacctttgtacaccacatcctgcatgccctgtccacaggaacatctgatcactgcccactgctcctctccaaccctgcggggctgcgacgtccaaggacctttaaattcgaaaacttctggaccaggctacttggcttcaaagctgaggtacaaaacacatggaaccagagcaccatgcaccatgagcctttccaccgcctcgcagacaaattgagccgaaccgcaatgtccctaaagagatgggcaaagggcatctgctcagaagcaaaaatcaagtatcacatggcgctcgacataattcagaggcttgatgtagctcaggagcgccgggagttaacgcaggcagagtacaggttgagactgggcctaaaaagaaggctcttcggatttgcggtcatcgaaagagcatggaagaagcaagctgcgcgcttaactaatattaaagaaggggacgccaatacaaaatacttccatcgtaggataaatgcaagaaaaaggaaaaatcacatcttccgcttaaggaagcagaacggctgggctgtcacacacacagaaaaggaacacaccattgcagaacacttccggcaagtcatgggaagacctgagccaagagagtgtgatctcaactgccagtctctagggctcacccccgtcgacctctctgggttggacgaccccttcacaaagacagagatccacaaagcgttaagcgaaatgcctgtcgacaaagcaccaaggcctgatgggttcacagggaaattcttcaagcactgttgggacattatcaaaagcgacgtagtggccgtcttcaatgctctgcacgacatgaggcacacacactttaacctcctaaattccgccaatgtagtgctcatccccaaaatggacggcacggagggaatcggagactacaggccgattagcctgattcatggctttgccaagctcttctccaaggtcttagccatcaggttgcgaccactgatgcactcgctaatcccgacaaatcaaagtgccttcattcgcgaacgaagtatacatgacaacttcatgtacgtcagaaacatggtcaggaaacatcacaggactagaaggttgatccacctcttcaaacttgacatctccaaggcttttgactcagtcagatgggactacctcctcacgctccttcaaaatagaggatttccacaaaggtggcgggaatggattgcgggccttctatcaacttccacttccaagatcatcctaaatggtacaccgggagaggcaataaggcacggaaaaggcttacgacaaggcgaccccttatctccattgctcttcattctagcaatcgacccactccagcgccttttggacaaggccactgatctaggggcgataagtaaactgagaggaagggttatttgcttccgcacatccatgtacgctgacgatgcggtagtcttcataaacccacaaaaagaggacgtacgagttttcaccgaccttctacgtcgcttcgggcaggtgtctgggttatgcactaatctgcaaaagtcccacgtggtgccaatcaggtgtgacaacctggatcttgacgacatcctggatggcataccagtaaccagagcaaatcttccgatgaagtatctaggactacctcttaccacagcaaggctaagaagagtagacctgcagcctctcttcgacaaatcaatgaaccgcatagccgggtggaggggaagacatattgggcttgcagggcgttccaccctagtgaaatcggtgctcacttcacaacctgttttcctcctgacagggctaaaagcgtcaaaagagtctcttgaggctcttgacaagcagagaaggaagtttttgtgggcggggggagaagccttgacgggtggaaaatgcaaaatcaactggacccgaacctgcctacccactggtttcggaggtctaggaatcctaaaccttgagaagtttgcaagagctttgcgcctccgatggctttggcaggaatggaagtcaccggagaaagcatgggtgggttctggtacgccgtgcgatgacaccgataagctcctttttgcggcagcgacatccataacaatcggaaatggggcgactgtgagtttttgggagtcagcctggtggcaggggagaaggatgaaagatgtggcaccgctagtctacgcggtctccaagaaaaagaatagtaccctccaacatgccttgcaatcagatcaatggctgctcgatctgggattaccagtggacgtgggctggacaacagagctgattgaccaacttgtcacagtttggaccgccatccagacaatagagttgacagaacatgagaacgaccaaatatgttggaagctcactagccacggtcaatatacgacagcatcggcctataatgcacaactacttggaacaacgaccaacaatttcaacaacctaatttggaagccctaggctcctcgcaaatgcaaaaccttcgcctggctggtcattcagaatagagtctggacctctgatagactatctacccggggatggccaaatggatccatatgtcccttatgtcgtcgggtccaggagacggctctacacctcctcgcaggctgccgctacacaaagagaatatgggcgaccctagcggaatggacggcgtgcaacaatattcaccccaaccattggcggtaggtttcgtcggtgttagaatggtgggatcaaaccacaagtgtaaaagaggcacccaaaaaggctctacgctctctaacgctcctagtcgcctgggagatctggaatgaaagaaatcgcagaacattccagcataaggagctcccaccgagtggtcttctgacaaaaatcaaggacaaagccaagatatgggccttagcaggcgcgcatcatctgagaaattggcttgttccttagttcactagggccaaaggtcctgagtttttttctttccctttacactgtacagttttctccttctatattcaatgaaattggctgctcgccaattcgttcaaaaaaaaaaaaattctccatggaagacatctaggtgaaacccaacacgacgaccttttttaaagacttattattcaagtaaccaacactattaccctttcaagaagaaacaatgtctaataaaaattaatcaaagctatggcaaatctctgaataagttattcaatgcaagtgaagcgtgagaccatgctaactattaacggcacaggcaagacatggagggtagagtggtagacgtacgagtcgccaaaaaaagggttttttctttgctgtttcctttttctgctggatgtgctgttcaatttcccttatagtttcgacgcgcttgggcttggagtcggctgtcaagtcgacacgtggtggtttggcaccgtacagctcctggacgcccttgacgtcgtcgtcggtgaggctcaccttccccctgtaatgcctgtacatcatcgagctctccgacgacgagtggccgagcccgagcgcgtggccgatctcgtgcaccgccaccgactccaggtcgacggcgagcggcggcgcgtccccgccggcgccggccacgttcgtcaccgcccacttccgcgccgcgtgcaggtgtatccgcccgtcctgcggcgggtgcgcgtgggcgagcgcctcctcgccgccgcccttgcagacgcagccgcacgcgtcgcacttgccgtcggctgtgtggaggtagaaccccaccctgatgtccgcctcctcgtagcgcgccgcctccgcgaacctcaggggcgtcacctccgcccaccgcgcgagcgcgctccggaacgcctcccgcacggcgtcccgcgggaggtggtcggcggtggccaacggcgacacggcgtacgtcagccgcatgtccggccgattccaccgtggtctgccccacaggaacgtgaacgccgccgcgccgccgccgccgttgttgtcttgggaccgcagtcgcgtcggctgggagccggtgccacagccacacagcagaaacatcgtgtacgtatacgtgccgccggtgagttgcaatactagcgtattgatcgttgtcacgtaactagttacgattgattaattctataaattagtcactcctgtgttttgtttatagatatgacacaggccgagtgtgagcagaaatcgttctgaataactaatccgaataaaaaaagcaaacatcggaattcaactccgtacatgtattccatccgaatagcattagtaaaagaatagtactagtcttttttttttcttaaaacttactccattcgtccaaaaaaaaaagacaaaccctgagtttccgtgtccaaagtttaaccgtccgtcttatttgaaaaaattataaaaaaaattaaaaagataagtcacacataaaatattaatcatgttttatcatctaacaacaatgaaaatactaattataaaaaaatttcatataaaacggacggtcaaatgttggacacggaaacttagggtttgttttttaagacggacggagtaatctctgctaaataatgtggtggaaaccctagttgtcgcacgtgtttccctgcttcgccgccgtcagggtttagttgtcgagcaatgttgttgctacaggacagggcactgaagtgacaacatcggatccatattagcagggcagcacgacggtggaatcataattcaatttcaaaattcgaacttaataattggtgaattgtaattgacgtagaattcttctttcaaactaagcatttacggttcaaaaactaactgatgtatgttttatataccgtgcaatacaggggttcagattctctagagttggcatcaactccacccagtggatttgggcaaatctcatccatcgttttatttctacggttaagatcctaattgactcccttaattgatgcatatttggatctttcttttcaactgttctatttccaacataatcaagaaaataaacgtaattaatcttgttcctgcaattaatagaccaacatagaagagtttttcagtgtagagaagagtgatatcgtagatggtgaacatggacagccttgcgatggtgcagaaactagctctccgcctcgaatcagagctcagggcaactggacagcttactacaagcaaagccatcgctagcgcaagcaagtagcaacatgtacgtacatcatgtcgagctccttgatgctgctgtacagctcgctgatataacctatcatagagtccttgtttacaagcttgacgaaggtttacataaaaaaagtttgatgaaggtaagatcaaaagtggaaggaacaaattaaggataggttgagctgcattgatttaatctcaaccgtaggtgataaattatggctgagattggcccaaatccaccggatgaagttgaagccaactctaggggatccgaacctgcaatacaggggttggtgactagcatcattaattaatttgctaatgattaatatttgtaaagttggatggttttatccacctaattttaccggatgagttcatccatcatcattgtgaaatattttcactctcggctatcccatccacatttactcatcaactaattacactcgaaaattagtgaaaaaaagataatatataatcggaaaacgccgggatcggatcgggcgctcgacgcgcgccagaaaaattggacgctgcgcgcgcccgccgcccatgtgccgcccccacgccgtgcttcccacgcgcgccccccgccatgtgtgtagtgccgatcccgccacgtgtccccaccacgcacgtcgttgcaacaaatcacccatatattatggaagccctctattaagggaatccgtttcactttttttccaccaaaaatatttcacctagtgtattcataatgtttcactatgtatggatcaaatgttgcagtgaattgaaacactctttcgctatttgctgaaatttttttttatatagggtgaaacaacacttgatttttttggaaaaccgttatttcatacgttgtagcaaaatatttcatgaggtcatatggttatgtttcagctttttaaaagactaaaatatttctatctgtttagtgaaacatgtttgatctacttggtgaaacagtgcccgaaaaaaaattgggcgtccaatttgtaggcgcctcgtatataatttgattcttttttcaataaaagaatggttattaagtaccaatagtcaaagctaattcaatatctaaagaagtttattcaatgaaagtgggagtgggatcatggtaacaattacggcacaagtgagagctagaccacgttgccaaaaagagctgccgcgagctttcttcttcttctctttcttcatctgttggatgcgcgacaagatgtcctgcttgaagtaggcaccgaagctgaaatgtgggtttgccccgtagagctcctggatgccgtggacgtcgtcggtggtgaggcgcaccttcctctccctgcagctgatgaacgggtacatcatcgagctcctcgacgacgagtggtcgaggccgagcacgtggccgatctcgtgcgccgccaccgactccaggtcgacggcgagcggcgccgtgtccgcggccaggttcaccgtccacctgtgcgccgcgtggaggtggatctgcccgctcttctccggcatggaggagtgagcgagcactccttcacagtcgtccccgtcgtcgtcgtcgtcgtcgctgtcgatgcaggcgcacccgtcgcaccggccgtcggtgtagaggtagaagccgaccttgatgtccgccgcgtcgtagcgctccgcctccaggaatctcatcgggatcacgtccgcccaccgcgcgaacgcgctccggagcgcggctcgcacggcgctcggcgggaggtggtcggcggtggccgtcggcgacacggcgtatgtcagtaccctgtccggccgcgtccaccgcggcttgcccggaaagaacgtgaacgggccggcgccgctgtcgttgttgttgtcttcgggccgcggttgcagcgtcgtcgtcatcgtcgtctgcgccagtgccggctgggtggcggtgagacgcgccacatctccgcttctacacagagacatcatcgcgcgtacgtacgtgccgccggcggcgaggtgcagcgcatgcagtactgatgtgccttcacttgatcgtccgttacgtaattgggtacgattgattttgctatatgacaacaccgaacgccaatgtttggacgtttttccgagcaaaattcacgttccgagtagtattatgaacgccaatgtcttacacaaatcgtaactcataatactactctgacttgtatgttctgagcaaacaccagaattacacacgtgttccatgttttatcggaatagtattggcaattggaactagtagtttgaaattacatgtatgaggagtcataatcaatattgatctagtgctaaacgtttttcacaactgcctgcaacaaaagactaacgaggcaattaaccatccttaagaataaaaagacttaatttccctaacttagagggggcacaagtaaggcctggtttagttccccaatttttttttccaaaaacattacatcgaacctttaaacacatacatggagcattaaatatatattaaaaacctaattgcatagttaaaggaaaatcgcgagacgaaccttttgagcctaattagtctatgattagctataagtgctacagtaacccacatgtgctaatgatggattaattaagctcaaaagattcgtctcacagtttccagtcaagttatgaaattagttttttcattcgtgtccaaaaactctttccgacatccgatgaaacatccgatgtgacactaaaaaattacttttcgcgaactaatttccctaactagaggggcacaagtaaaaagacttaatttcctaattttgaagagaccacagaattagataacataatagtttaaacttgtttagtattctgtgacacggataaacacgttgtggcaatagcatatcaattttttccctgccaatataagagcttcttctagtactactactagttaacatgcaatctagatttttttttctagaaaagataattgcttcttttcataatgtgattaatcagagtttgtgcaacggtgcaacccctaaatacaaggtctccagcatagattggagcatgctctcaccatactgcagatcaatgactagctagctagctagagcggcaaaagtaagatgcaggctataccaagtcgccaaaaacgactccttggggtgtcatggtccggcttgaagtagtctaggaagctgaagcttgggttgaccccgtacaactcctggatgccttccacgtcgtccacagtgagccgcaccttcctttccctcgtgccgacgtacgggtacatcaccgagctctccgacgtcgagtggtcgaggccgagggcgtggccgatctcgtgcgtcgccaccgtctccaggtcgacggccgccggcgacgcgtcggcggccaggtccaccgcccaccgctccgccgcgtcgaagtcgatgcgcccgtcctccggcccggtggcgtgggcgtacacgttcagcggaccgtcgaacgggtgcccgtcgccgtgctcgccggcgccgtagaaccccaccctgatgtccgcctccgccgccgccgcgtcgtcctccgtcgtgatctccgcgaagctcaccgggatcacctccgcccaccgcgcgaacgcgctccggaacacggccagcacggcgtcgcccgggaggtagccgacggcgtcggtgtgggacacggcgtacgtcagcaccattggtcgtccgtgtcgcgtccaccgcggcttgcccgtccagaacgcgtaccggctgaccacgccgccgtgatggcgcagcgtaggcggcggcggcattggccgtgcgtcagcgacggcgacgcatgagaggatgcaagctatcgccagaagcaggagacacgcagcatctccgcggcgacgcgggaacatggtcggctgttattctcgttatctgtcggactctcgccggatttgatcgtcgtcacgtcaacgggctaccatgaactgaagattgacacctatgcttgatttacggactccaatggtttgcttctaaaaggcctgagttgggatcatgggaaattattaaagtgtactagtataataatattataactactctataatcacaatatgatttatatgtgtaactcgtatagaattctgaaaaacatgttcatattggattgactagctctagaagctcttaaatctgagatcgggtgttcgactcccactaacgcatagtcgtgcaaaattcgaactcccgctagcttatggttgtgcaaattttttttcctcccctctcacgaatctcgaggcaaccaaaagatcacaaatttgaaacttctgtggagaaaaaacgggttaaagttatttagcaattccatgaatcataagcttaaaatactacccaaacatgttctaacttcggacaaccgatctaaactagttaagtcctgtacttgatacacgtgctcacatcaacggctattttttcactgatagatgatattaacagcgggacgtccgtgataacttcgtattccggccaaaatagtactggccattggcacatcagcaactggtacatagaagagaaaaaatcaagtgctgattatttcttggtacagaagatccatgttctcgaccactaaatcttcatgccctcgacgttagcccttccgtcaagtttggccgagaagaagcgcttcatgaaatcctcgtaggccatcgacttgtacaccggcctgccaccgtccttcgtcacgagctccggcagaggcccgaccgtcgcgtcccggcacgcctggtggaacaccgccgccgagatgcgctccttctccgggtgcaccacggccctgtgctcaacgctcctgtacctcccattgctcagaatctgcaagcagcagccatgttggtagatgattaagctagaaactctgtactggtgtgcaccagcaattcaacatcgatcagcaaagaaaaactgtttcggtttcagatcgacgcatcaggtgaaagcctggtcaatattttacctcaagcatgtcgccgacgttgacgacgaacgcgccgtcgagggcttcgatggtgagccacttgccgtccttcctgatctggaggccctgcatgtcgttcacatggagcagcagcgtcaggctggtcgcgtcgcagtgcggcgacaggccgagcaccttgccggtttgcctgcacggcgggtagtagttcaccctcatgttctggggctggcctctgaatacctccaggagagactccggatcaacgcccatgtccatggccaagaactccaacaggcagcgtgctacttttgccgtctccaaggagtacctctccatggaattcctgtcaaacatttgtgttgtgatatgcagcaaaatggctcattggaacaagagaagccatgaacgttcagactgaaaaactaaaccttggaaataaaaaaaattgttcatttcttggttgaaatttctcaaaactacttatttcccatagtcatgatcaatgcaaagattagttgtggttttgtttgtgaggcagacctgaaagatgaaggatgggcaggccagaacctcaaatccctggactcggttgggcgaagccggaggtgtagcaggtctccccagtccagcttctgcttctctgaaacgacgaagtgctggccatagccttcgtacttgtctggtggtttagcgtacgcctccttggcttcaagtggtagcttgaagaactcagttaagtctctcctcacgtcgctgatcacatcgtcaggcaccccatggttgacgagctgcagtttaatttgtgagatcaatcacagtttatcctacttaaatcagtgtcaccttgtccaaatttgaaaaaaaacactatttaattctctcccacatggtttattgatcattcagtttaataatagttgtatcaccttgtgaatcatcaaagtaaaagcttgattacataatcttgacgtacctggaagaaaccccagtgctgacatgcagatcgcagcttggcacactcctcttgggatgactgcgggttgagcagcttggcgagatcgatgaccgggattgccgtgttgatgccttggccgcagatgacctcttcggtgccagcctccggcctgatgtacctgtcaggtatctgctggtcaggtcggttgcaagtcagtgcgagttcctgcacatttggcacctgtagagacatggttaatctggttttctcttgctgctcttcccactgtgctgatgatg

SEQ ID NO: 39491 - DNA, 8857 bp, Oryza sativa
cttgtgaagatgagattatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaactaaaaccacgaagacaccattcagagcaaagcttccaagcgcgctctcaccctccattccatctttcttagtagtagttcctctagcctaccttgcataatatatattgaagcaaggagttgtaatataaaggtttgtaaggtgagaaaaacttgtttgtatctaccttcggggttcccgaaagggaaaaccgtatgtaagcctatttgcttaatatgaagtaattttctttaagtttccctgtttgtttgctctagataagcgtttatgctagggaccctataggagaaacctctcggatgttctcgtttttagcctgcatcttgcataggcgtctggagaaccagtatccgtagagaagtgttcccctcgggtggaactgcctggggagatggtaaacgcttagctagttcaaatatgactagggatacctgaagttggttgcttaaataggcagataagtgaggcatacggctagtaccgagtaggactttaaaatttctaaatcaagcgccggttgtttttggattcgccaccctgcaaagatcctaaaaatttaaagaaagttttcgagtgaacagtaacctgtgaacagtagtgaacagtaattctgtactcataataagtgaattcagcactaagaatagttgtgaatagttgtgaattaattatatatatatatatatatatgtgtgtgtgtgtgtgtgtgtggagcgagttatgagagtacttgagggaaccaaacaagaggtggtggcactggaaggccttttacgttagttaccaaacgatcccatcatggcatgtgcgcagtcacggcgcggcgctcggtcgcacgaacgcaccacgggcacgcaggcaggcaaggcaggcaagccgatggggacgtagtaattggcctgtggcctatataaagaaagattcctcctctccagggccagccagcccccgcccactcgtcagtgccaaaacctactcgaccacaacggcgacgacgttatgtttaacgtacgtacgctgctaactgttgcaggctagctttcagttgcgacgacgcgcgccatcctgttaatgttcaatcgttgggcttgtttatatttttaccattccaattcatgttattatttggtaaaattaataattatagggctatatttagtttgttaccaaattttgataatgtctatgaaattttaacaacattatattgagcacatcctactaaaacttgaaaatattgccaatttgctaattttggcattaccaaattaatgaaatgattcattttagcgtacggacccgtcatgttattgtcttatatatctcggccgcaacaaaaattttaatttttaaacttcattttaattttatctgaatgtttttgtatcgtagtttactttgatgttgcattagcttttaaatcgttaagagcatggataaaaaaagttttattatgtttatttgatgttacttcgttcatctcatattatcattggatgcatcaattgcaacctcagccaactccaattttacctctcatcatatcaacggtgacacatgaatgggaaatatttttagggtcactcttaatatctacttgttgacttatcagccccaatcaaaatttgatcttagagtaacttctaatgaatcaacatcaagagtggtgttaattttatgagaatatagctggagtaaaaccgggcggttaaccattctggatggcagactttctgctgccgagggaattgaagcagtatgagtatgtacgggagagctagcgagctgatgagtgggagagtgcaagctgcgacctgtagctagctagcattgatttcgatcgggggccaggatgcttcggcatccgttttccatggacactcccgcaggctacagctcatggagtcacgtgctcgtgtgcatgcattgcggttaaagtaacggggcagattcttttaatttactagtagcccccctctttgttttttgttggaccaaaacaaaactagtccatcgatggtttaattaagtagtaaattttttagatgcccccaactgatcttatgcttggtgaaaagaaaaaaaagattaagcagagtgctctgctggagtaatggatgagagagagagtgtgtgagtgaggtgcaagtggtggagcatcaatccatctgaatgtgggtgggcagaggatggatgcagtgcatggggcacgttgggggcctgcttctgtgctgggttgcagcttcctctcttctctctcgctaatcctataccctctcacgctaattaatcgcttcaccacccttaatgcacacagcttttgtcaaacattgtttttgtgcacacacatgtagtagtactgggctcgtaccactccactgctactgttagtgcttgctatgctacaccctacacacacatacaaacacactctctctcctcctcccccactctatattaattacttcacaacaacccttcctgttactggtgagcgacttggagctcttcaaagccccagcactatttctcctcccccttcctcctcctcctcctcatgagctcctcctctcatcagtcatcactacactcacttagctagtggcaaaaagatagatagctctagctcgtactgcatcaaacgggcggtagttgcactgcccgtttcaagggaactccagtgacaaccagcttcttgccaattcagaacgtgaccgtgtggtacgtacggccaaggcagtggctagctcgcgatggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactacgggatgcctcatcaggcggcgatgggcgacgccatgcgcgtcgacgacctcctcgacctctccaacactcccggcgcccacgacttcttcccggcctccgctgccgccgccgccgcaggtgaccacgggcaccaccaccaccaccacatcggcggcatgggcgagccgtcgggcgccacgccgtcggccacgtcgtcagatcaccagacgtcgatgctctccttcgccgacgacttctacatacccgtaagcaccctggataattcgagatcgcacgcaaagctagccacttgcatatgcacgcatgcacatacccttgtgaattttgcatatgaagttagctagagtgcttaattttgaggcttgatgagatcaaacgggtttgagctgaacaatggcgatggatgtgtgtgttgatggggttcagaccgaggacgctgccgagctggagtggctatccaagttcgtcgacgactcctactccgacatgccgaattaccagtcgtccgcgcacgccgcaatggcggcggcggctgcttccgcggccaacaacggcggcggcagcttggccggccaaaacaactgcctcacggcggcgcctggccgcggcgcccgtagcaagaggtcgcgcgcgacggccgcggccgccgccgggtggcactcccttgttccggggccgccgttccagtcgtcgccgtcgtcgtcgtgctcgtcgtccgacttcccgtcctcgaacaagccatcgggcaccgcgaggccgaacggctcaggaggcggcagccgcggcaagaagagccccggccccgcgggggcggaggtgggcatggaggccggcgtgcggcggtgcacgcactgcgcgtcggagaagacccgcagtggcggacggggccctgggccccaagaccctgtgcaacgcgtgcggcgtgaggttcaagtccgggcggctgatgccggagtacaggccggcggcgagccccacgttcgtgctgacgcagcactccaactcccaccgcaaggtcatggagctgcgccgccagaaggagctcctcatcatccgcggcagccaccgcgactccgccgcggccgcagcagcagccgccgccgccgccgccgcgggatccgccgcggcgaccgggaggccggagctcatgttccgcgactacggcgtgtgctgatcaagcggcgcacgcggcgtccagagcgagccatgcaggcgcagctacgcatcacatcgcatgcatggatggatgcatgcacagcacagacgcgcgggcttagatccttttgcgaaattctcccgtctccctttctcttgtttatttcctctccctttttttctcttttttgccttattccagatatttttcaatgcttttttgttaattaatttgttggtacctacctcccttgcaagttcttcctcctctatgagagagatcaatcaattctgttggtataactatgattgtgattagccgtccaaggcaggggcgattagttgtctcacgtacgttcgacgtactaacgtacctcccgttcgttcgttaattctccatctgatcctttgctttttcgttattttctggtgaattttctctcgtggtactaccagtacttgcccattgcgtttgcgccttagtttcttcatggccattaataacttcgactcgactcgatcgacttcggttgctagtatatgtgtttttatttcttatatgaaaaaaaaaactttgggatggtaggtcaagcattttaatgggtgaaaaagaaagacgcgaggtaagcggggaatggtggtggaggtgggtgggtcagcacgtgacttgccctatcatggcctttttggcaggggaaagagtgggcaatggtccggtcacgtgacggtgctcccctctccctccctcctcacttattcgcgacgtttctaattttttccctttcattcctcctttctttctccttggtggggctagcagcaagctgccactgctttgagaggaaaaaaaactctccataagaacctaggccgagtttacttttaagctttttcttcaaatttctaactttttcatcatattaaaacttttttacacgcataagctttcaacttttccgtcatatcgttctaattttaaccaaatttttaattttagcgtaaactaaacatatccggatgtgatattttctagtactatgaatctggacaggtggatagaacatcttcgagtactatgagaaaatgtataatccgattttaggttgctatattttgggattgagagtagtaaagcggagtgagctcggtgtggtgttggccatggagctagcgagcgtgctgcctgccgacttccatgtggagctgtttgcttgagccgtatattgtgggctgattattgtatgccactagtactactaccacccccgttactgttactgctgcctgctgctactactagtagcactgaataatgtactattgtaatcatgcatgcatgttctcttctcttctccggtgtgctcgatgcaaagtcagacgtctctggtttttgcagatgtgacctgcggatatatacatcggttgaggttttatctgcaggtcgaagacgagaaagaataagcaaagcaacttgcagagggagaggggggtaaataagccaacgtgcttgctaccggcagcaagtgagggggggtggtggtgaccggtgacagaggaggcatgcatggcgtgcaaagcgactgtacaggagggtttcttggctttacacaaagaggggagatggcgagtggagacgacgagtagttatcggctgtcacgttcgcgcgcaggccgcgatttgacacttgccccccatgcgaagcggcggcggccgcagaggcctcgtcgtcgtccatcgcgcgggcgcgcaccgacgcgcgcgtcgtcgtccagcgtccaacgagagattgacttcgccggcgcggtggcagtggcatatgggtggtagttaacgggtactcctaccatttcaggttataagtcgttttcactttagtaaaagttaaactattttaaatttaactaaacttatagataaatgtgtaatatttatagaactatattagtttcatcaaatcaataattgaatatgttttcataataaatttatcttaggttaaaaatattactattttttttctacaaattttattaaacttgaaccagtttgatcttaaccaaagtcaaaaacgaagagagtaacaaggtaagctgcgtggcccgcggtgagctgtgtggtgacgcccacaccgtaaggaggcctgggccactactgctactagtagtagcaggggagagggggggcaggtcaaggcacgcatcggcatcatcatccatcatgtgtgtgttcttctccctgggaatcctgcagcaacccaccccagctgggagcaatcagacacacaacaagacgggggccagttgggcctaaacgacgatggtaaatgcgactacccactgacaaaaagcaattgcaaagaccaccttgccccacgcccaaagggccacaaggcccacaacccaccaccaacagtccaccaccacacggtgaattttcgaaacgaaccgataactttttttaatttatagtatgtgttttcttttttaaaaaaatttacagaaatatatttgtttccaaaaatatattataaataaataaatgcacgaaccgacaggtaacaattgtactgacatgtgtttgtttagctgcctcggacgctcattcagtccgtgcccattcctataacaaaaaagttcagtgcctattcgatttgttttccgtgaaaaatctttagtactagtagtacgttgttgaaaaaccatcactgaagtaaccaaatcaggcctcataagtggactttgaaaagaaatccagatgatacagaacatcctaaaatggttaggggcaggcacactccatgcatatcgaacaaaaaatcatttgacatatgctctcggttgattgagattccaaggacaaatatacagtcacacgggtacagggccattcatcggtacacgacattgcaatatagcataggcacattatgccggtcgagttgtcctcaagtacgtagacaatgttatggctatagcttatttcaaattactagtactgtgtctgtaaatgttattctacctcgcgtcctgagtgtacaataaaaagaatctgatgccataaaagacttaacagctagcagccctaaatgatggtgtggtagctggtgagagaagttttttctttcggaaggttgttgatgacagaagtggttaattctgcccaaaggatttcgtttaggtgatagtagtgaccagtgatcagagatagcgggacgagcagagacaattaaaggccccaccaacttttttgtacttaggagtatctaattaattaggtaattaagtataataatgctacctccacccaaaaaatacaagacgtatttattttgaattaaaacaagaaaaaaaaataacttatccaacatataacaaaaatggacgaggcttcttgacttaccgccatctttgcctgttgctgcaaagattgctcaacactgccattgcaagaatcagaaatactcctaccatctttgcctgttgatatttcagttaggagatcattttcttctgaatcttgcctgtcacgattacccgggctacttaaaatctcctcctccagaggtgtctgataagaatctgcacatttatcttcactaactctagtagtttgcatcttcatagtatatatttgttcaatattggcaatcatacgttgtcttccaaaattgttgctgcgtgcattctcgtttggacatctgagctcattcaaattaatattttattctaagttattttctggttctacaagagaattgcagtcgttctcttccttgacatgcctcttattgtgaaccatttcagtcacactcttcaattcatttaaagtttgggcaacaacaatactccagcttctacttcatccttgatgaagatcctgataaaatgttcagcagattctgaacccagtttatccaccaagtctttaaatgctactcccttcgtttcaaaatgtttgacatcgttaactttttagtacgtgtttgaccattcgtcttattcaaaaaatttaagtaattatttattcttttcatatcatttgattcattgttaaatatactttcatgtacacatatagctttacatatttcacaaattttttgaataagacgaacggtcaaacatgtgctaaaaagtcaacggtgtcaaacattttgaaatggagggagtataatatatatgtcacgcagcagttcaactggtaatgatcaactcatcattttcttctgttagcttctgcatccagaacagccaaatttctcactaagtctctgaatatttctgaatgtaacacatgttgcagttaacatctgatctctgaacc

SEQ ID NO: 39492 - DNA, 1379 bp, Oryza sativa
aaacaaggaagctttgctcagatcaaaggaggcgagccctagacacatcacacaaaaagaaagaaaatggaacgaagcttgaagaacaaccagaagaaagaaggggaccaagtaaaggacattgattgatttcccaatccatgatttcacaaatatttcttcctctctgatttggccccaaactgatctgttggctaaaaatagcgaaaaaaaatgtcagatggcaaattgcaaggccaacaaattccgcaacataatcaggaatttcgctatgggtgttcacatatataggtagctagaccagtgtgtgctttggagtattcagaaatcacgaaaagtttgtgttgtactgctcaaaaccttcccagtactaataatttgaaaagatttactcattacaaagactagtacatgtggttcagtgtggctttttcttccctctatcaatcatttggagtctccccataggcgagaacccatacctgaacaaacatacttagagcaagtataataatacttagagcaagtataatagtagactataaaccggctaaatgctgagttggaggagagaagagagtagagagaggagaagcggcctgtaaacttacagtcggcttgtggcttggacacaagaaccaaggcttgtggcttggacacaagaaccaagaaacactgtgagtgagacaagtgggccttgtattaattgtaaatagctgactattatatgggtagagtgagagaatgctaaaaaaaccttatagccaacaggtcggatgtattattagccttgctcttaggtaactgtttctccagaaattgaggtactcaatcactattttgaaaacagagatcatagagagggtacttaatcacttcaacttaattcatgccataagccactaaataccaaattattttcagattctttagaataaaagcgaggtagccgcagctggttccatcttcttcggtttccatagctgccttagatacatgcctttttctcattttgcccctgcataagcacaaaaaagtcatagaagaagaaataaatccatagaggttaagcgaaaacaacattcagtattgcgctttttaatgaaagccgggcgtttaattacgcctttcctccaaaaaacaacattcagtaaaatttcagatcatatacacacatgtgaaattattttctaaaaaaaaagctaacagaactagcatttaatgcacactattcatagcttcaaaaaaaaaagttgctgatgagtttttgtgcatttgaaatataacagaccacaattagtatttatgtaatataaaatacttgctgaaatttactaagaaaactaaccttatagttgctgaaatttgctaagaaaact

SEQ ID NO: 39493 - DNA, 28982 bp, Oryza sativa
  unsure (1)..(28982): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcttatatgagatagatgtatgactccaccactaaacttaggacattaaatccactggcttataaatcatataagccaataagctgacttaaaagtctaggccaataagcctaagcctaaacaaagagggccttagactagagagagagagagagagtagctacaacctacaaaatcctagaatttcatgcgattaatttaagtgagcgcatgattttgtcaacatctcgatccatttgtcaatggactggggctgtgttcgggagtgagggttgggaatccactccctagcacgtaaaacgaagcagcgtttagtacatgattaattaagtattagctaaaatatatttaaaaaatagactaatatgattttcaaaagtaaccttcatatagaaaatttttgcaaaaaatacaccgtttagcaatttgaaaagtgtgtgcgtggaaaacgagtaaggtgagttgggaaagtgtcgacgtttgatagtcaccactacggtattaggatggtatggggatcgtcggtaccagagtatatacgagattgaagtaaaagagattgagacaaggatgtttatataggttcgggccccttatttgacaggtaatagccctactcctattggctgaagccggtgttgctcttattcatcataatcacaccagtacaacaattgagataacctatctatatgttgtcgacttggcggcatggataaccaactcgcgatcgacgacaaggtagtcttcctccttgagtatgaacccgtcgagatcagagatggtgctagatccctttgccggcctccgttggcatcggatggggtatgtctaggctaatctctaatgtcgatatttggtggcatattggcttgtgtgtatgttgtgtcttgttggtcttgtggcttccgtctcccctctcctcctaggggagcttgtatttatacccatagatgtccccttctccaactctaagtagaactagaaagacaagtatggatacgattcgagtagtccttatagtatccatataaaactctatttgtcatttcttatccggaactccctctatatatgaggtatgattccgtataagacttggtatatggtaggccccgccgagcttagtcgattactattgggtatgtggtatccataaatctgacaaaaagtataggagtaccatgtaagagcatacccaggagctcatctatatttgatcctccaaatacccatatggtgtatcatccaaaaaagattcctcatccatatcccttttaatccaacagattatccatattacatcattcatatcccatcatcctatattttagtaatatctttcaactaatcttacatttgtattttaagggatatattttgaatgacttaattttaacggtgttgtttatcgcgataatattttgaaatgagtaaactttaacggatatatttttaatgggtaatttttaattgatatatttaaaatgagtgaagcattttttatgtgttgaacggctacatttccaacggctagctagctcattcaaattgtccaacggctagtacatacatgtaaagtttagctctatatataccactacattgcttgctatctttttgcaccatccacattattgtgcatagttcttactcaatgagcttccttttgagacatgttttattggatgaatcatcgtcatcgacgatgaaatcattgttgcttcaagaagatctagttaaacatctatggcaatttcatggtaggaactagtgtagtatgcaacctcccatttatgtagtaggcaagtctaattatgtatgcaacctcgtttacatatgaaatccatcaattatgtatgcgacctcatttatgtatgccatccatcaattaagtatgcaatcctaatgtatgcaacctgtatgtgctcacaattaatcatagcattcttgcatagtacagcataaaggtcacaaaacattaagttccaacaataaccattacataatacatcaaagcctacacggcatacaacataaaagttcacaacccattagaaaatagtaataaatagtacatatccatacatcatgaaatcaatccatatgagcctttatgatctcctgctgcaaacgcaagtaatatgtttttcttggcccatccatagcactaagatccatattcataattctttcttctctttcatgggtttctatatctaactttcgtttttctactttcaacctctctttctctagtgaaataacttcaaccaaccggtcatttctttcctccctagattgtgcactcatctcctttttctctgaccacatgttatttaatgcaataactacaggactactctcacttgagcatgaagaagtattacctcgcgggcattttgccttttccaccttcttcccaggtggtctcactaaaggatcagaggtattaatgtcggggctgtaatgaaattcactagagtttgtgcttgcagatggtctcactaaaggatcgacatgagccttctgtcttttctggaacaacctatcattccactttggatgatgatgcaaaatctcccaacagtgcattaaagaaaatgtcttcttctctgctgacttgtacaaagtaaaagcctgagttatctgcaataattggcaaagtcgataattggaaaaacaatatttttttaaagcaaggtactagctgaatgagatgcttacataatcttgaacaaccattccactttgaggtccattaagaatctgctcataatatccacaaaacttgttaacttgttcttgaatggtaccccaacagttgttaagtgaattttggttttgatctgaggggaaatttttgttttcatggaagtattgatgaatccttgcccaataagagtcacggtgttgctcaacacctgtgattgcatctaaagttgtattcagccaagctgacaccaacatttgatcttccgcagtgttgaaattttttgatcgcttattgttgggtctagaggaccctccaacttcagcacttggctgttcaccaaccataggactatgttgtggctgctgtcctgttgggggaaaattttgactaggatcccaattttctacatcaatgtttgaacccaacaaattaacatagttgtccatgtattcacatcatagcaacataaataaaatgaacataaaagcacagtacaaatatagcaacatgaatctaatttgtactctattcttattacttttctctactatgtgaatataaaatcaaagtaagtaacattccaatatattttctctccttctctgctattactacttaacattccactgtattttctttccttctcttctacttttcttctctaccttctttgctagtactactttgcagcgggatggccgataggcggcggccgagctggcaacaggcgacggcgggcatgcagccaaggggcggcggcggacgaccggactggcgagaggcaggggggatgcacgcgacggccgcggaggcggacaggcagggaagagccatggatggtcgggaagaaggcagccggcaacgggtgggtgagaggcggaggaggcaagcgacggctgcgcgcttggcaacagcggtaggcagctgccgcgggcagggcgacggcggaagtctgcaggcgtgcgcatggcgacgacggcagacggcagtcgcgcggctccagatctggtacgcctctccctctccactctcactccaccctccctctccaccatccgctgaaaaaacaacccaaaaaggtgcatggaggactcaccttcgctggccggccacgacggcgatggagaggaggtcgcggaagtttggataggggcgggagctcgatccagatgcggttgttacgatttggcgtgaggagagagacacgctatttttggcttttctctctctctgtttagcgcatccgacacttttagcgctttggatggcacatctcctggaccttgttttttcgctcctatacgccaaaatgcggatggagtagcgggtagcgtatgtcctgggatgctctgacagggaggtacctagtgtgcttatcgcctctgcacccgctctgcctctccttcacttggtacgccgtacgtgtatggtaaaaaaaaaaaagagtactagctggcaagctgctgtttgttaatgggcctaccccaatttgcgtgagggccttaatgggctcaactggcgcgcctcggaaagttgggcctcacacaggcccatatcttacggggaaagtaaagctacggcctaaatggaataacgtctttgcgccaccgttttcttccgcagctggccaactcgagccacctcatcaggaaaaaaaaaaagaaagagagaaaaaaaaaatctcgcctccctttcaaatacgccgccgcggccgcaaagctttcgctcggagcacacgcacgcgcggcgcgacggcgcgacctcgcctcgacacgagctctcgtgatctcgtctcgccgcgtctagctcgccggcgccgccgcgcgcgcgcgtcccctcgccgccgtacgtgtagcggagcgactccctctctccctcccgcctcacctccgggaccggtcggtcggtcgatcgatcgacggggcgaggggatggcggcaccggaaggccagaacaagttcgcgggcgtccgcttcttgcccaaggacctggagctcctcgccatcctcgacgccaagctccgcggaagcccgttaggccccgtggaagccatcttccacgacacgcagatcctcgacttccacccgtacaagctctacggtatccaccgcctcgatcgatcgatctccctctctctctctctttgtcgatctccttcttcttctccggcgacgggtgggtgcctggatcagatcatgcagttttggggattttgattcgggatttcgggtggatattactcgactgattttgcagagatgtatgctgaggacgaggaggaggaaggctacatctacttcttcagcacgatgcagttcagatgcaggaagattgtggagcgcgcggcgcagggcggccggtggaaggtgaacaactgcgagactctggaggttggcggcgtcgccgttggccggaagttcaccatgaatttctacgagcatatcggcggcgacaacgacctcatctggaccaactggggcatgcaagagttcgccaggatcatcggcccaaacaaggaggtattccattcggaaatccacttctgaatcttcgttcaatgatcggatacatttgatctcatttgggtgaaatttttctgatcattttggccaaaagctcgcggatcttgccttgtaccgcctatacaagaagaaaataacaagggggacaggcgaggagaagccggaagacatcgccgcggctagcgatggcgataccgagagcagcatgaacaagcgtagacgtgtagaagcgtcggcggcggccatggcgctgccaccgccaccgccatcgccaggcctgcctggaacaatgatgttcatggcggcggaccaggcgaacgtggcctcgacctcgcaggaatggcacggccagttcgccaacggcgctgcggcggcgccgagtcctagcggctgctggccctgggcgccaccgccgacaccgagcgcagtggagcctttcagcttctgggccagcgcgtcggcggcgactcctcctgccgccgcgaactaccacccgtcgccgcagccgcagccgctgccgccgcagggcggcgagtactactccagacacggcgccttctcggtggcgcccgtgcccgcgtccgcctgctcgacgccgtccccggaggcggcgaccagctgcctcttggctacgacgtcacctctgccggcggcaggtactgagggcagtgacagtcagcagcaagaacccccctgcgaattgatggaattttgaaattttggcgaattgcttatagctgattctgatctggccgacaaatttccgtcaaattcgcagtgttcaacttcgtactctttttctgaccgttggctgttacttcactagttctacatatgtgagactgcattgttttttgtactagtattaatcttggtgatctgttgttctgaaatgcttataaattttgcccttgtgccttgaagaatttgctatgtgcgtcacttgctttgatttgggatgaaatgtttgatgaacaatcatttttaattaccacatgcataggagcttcaggaagggcttgaatttgacagttgctatgtgtttagccatgatgcatgtagttttgtgatagtaccaacgcgggatattcataggatttttgtggaggttcctgttaaatcattgaattttaatttggaggctctgaagtgttcatagtccaaaatactgtcaagtaaattcaagtgatgaggtcatgactttaatttttcatagcaaataactagattaatagaccggcatgattttctctaaaacaaaatagttagattctgtttctggcaaggaaacaagatcactgaatttcgttccggtcaaaaccatgtagcttgaactcaacttggactctagagagagaaagagatactatatcatgcaagatatagtagatacaacctacaaaatccaagaatttcatatttttcatacaatgtaagtgagcgcatgattttatcaacatctcgatccatctactgatgaactgaagatatgtagtaccagctaacagggaggtgctcacgctggtcgcctttgttctacagctcgaaataaaaaaaaaaattaatatgtaccaattcttttgaaacgtgtatattttcttaaaaccggtggaaaaaatatttccaaatcttatttgctgcagctctgcctctccttcagttggtacgcgtatggtcgaaaaaaaaaagacagtactagaaacagcggtttttaatgggttgagcccaattttcctgatggacttaatgggctcaactggcgtccctcggaaagttgggcctcagataggcccatatcttgcggagaaagtaagcttctcgccgtgctcgtccacattccgccagctggccagctcgagccacctcatcaggggaaaaaaagggaaaaaaaaatctcgcctctccttccttacaaatacgccgccgcggccgcaacccgcaaagctcggagaacgcacgcacgcacgcgcgcgcgcgacacgcgacgtcgacacgagctctcgtctcgccgcgtccacaccaatcggcgccgccgtgtagcgaagactagctagctccctctcctccgcgagaccggccgatcgatcggggcatcgcgcgcggcgcgcgcgggcggggctagctgggcatggcggcaccggaggatggggaggacaagaatttcgggaagaacaagcacgggctcccgatcggcttctacttcgcgcccacggaccaggagctcctcgccatcctcgaggccaagcgcctcggccgcccgctctcccgcgcgcacgacgccttcttccacgacatccgcatcctcgacttccaccccgccgagctctacggtatccacccttctccgtctctctccttgtccccttcttcttcttctccggcgccggcgaccggcttggtggtggggatttgattcgggtggatttggaatgatttgggggcggcgcagagaagtacgccaaggacgaggagaagggctacttctacttcttcagcaagagggagttcccgacgagcagcaagaagcggccgctgcgggtggcggagggcggcgcgtggaacagctccggcgccgtttacaaggtggtgaagagcagcaagtccggcggcggctacgacgtcggccataagaaaaccctcgtgttccaccagcgtttccccggcgacaaggaggccgtcaaaaccaactgggccattcaggagttcaccaggatcatcgggccccagaacgaggtataaatcaaaaatcaagccacgatttattcccacatttcatcttcttgttgtgaggattgaattgatcgagttcatcttgatctcattcgggtggtgcaaatttgtgccgaattttgactcagagttttcttgaactttaatttgccaaaaggttccggatcttgccgtgtaccgcctgtacaagatgaggaaggaaggcagggagacgcctgcagacctcgccgccgacgaggccgcggccgcggcggccatgaacaaccgtggacaacaagcgtcggctgcggccatggcgctgccaccgccggcgacgggcctgcctgggggaaggatgatgtccatggcggacaaggcgaacatggcctcgacatcaaaggcgtacgggccgtcaaagtcaagctcatcgcaactccagcaggatgcggcggcggcggcggcgccaccgaacgcagcaggggctagcaactgggcgccgaggccttgcaactgccgggagtgcgcgccggcggcgggacactatggctacttcgcggccgcggcggccatgaacaaccgtggcggacaagcgtcggctgcggccaaggcgctgccactgccggcgccgggcctgcctggggtaaggaggatgtccatggcggacaaagcgaacatggcctcgacatcaaaggcgtacgcgacgtcgcagtcaagctcatcgcaactccagcagggtgcggctgctgtggcggcgccgccgaacgcagcagggcctagcaactgggcgccgaggccttgcaactgccgggagtgcgcgccggcggcgggacagtatggttacttcgcgtccatggttccacggccgtcgctggaccggaagggcaagggcaaggcgccgatggactgtgccgagcaggccggcggcggcggcggctgtcacgcggagtcaacgagcactccggcgccgccgaagggcgccgagtactacggatgcagcgtcgccgtcgaggatgatgacgaagaattgctgaagtttctgcaggcgatggtgaggggcgaggaggtggagggtgatggcgaccacgccatggccgacgagcgcggcccgcagcagggctcctccccggtggcggcggcggcggcctccggctccgcgcctgcaggtcatgacggtcgccgtggctcgctgcagggtggccaccatggatcctcctcccccacctcattggcggccgccgccgccaccggcgacgacgtcacatctgccgccagtgcaggtgacgacgtcagtggcagtcagcaggaagaccaccctgcgcgttgaacactgaaatttgaaatttgaatttgaaatctgggacaaattttcgtcgaatttgcagtgttcaacttcttactcttttctgatcatttggtgttgttacttcactagttctatgtgagagctgcaattctttactagtaatcctggtgatctattgttgctttacgatggtgatttgcttgttctagaatgctcgagattatatatttgttttgcctgagatgaattggttctagtgtactgtcactgatttggtatgaatgtttgacagatgaacaatcatatttaccatatctgggagatggatgaagggatttgaattgactgcttttatgctaacctgtagttttatgatatgaaagtgatatgcaaaagccatcctgtagttttatgaaatgtatgaagcagaggtctaagtttgaaatggacaaactgtattctgtatttctgttttaagcttatgtctctgtgtaataatggtgcaattgaacaaatgttgatctgcatagatgcaagtcttgatcactattttctgtgtggtgacacatggagcaattcttgcaccgtactactttaggcttagacgctttctctcaaaatatcatgttaatagttatgcaatattctcaaaatatttggcaatattcatgtgccacccgaatttcatatctaaactcaattcaccagagagaaagaagagacaaatccactaaatgaacaacaatgcttaaatactatattcacaccatggagtagtgtatgctggtgtactactcagtatcagctagtgcaaactcatggtaggagatcactgatcattggttacagagagatatttgatcaactcagaagatattctagctatcaaattctagattttacatgcaagctaaggccagtgcgtctgtgcgtgcatgattttgtccaaacactagatgctgctcctatacatgtaaaacatctagatcggccttcaaatgggccgggcccaatttgcgagagcaaagtaagcccattaacacccaactaaacacgtcttaaatcacggagacgctccattgatgccggccaaatcaatcgctagttttcacaaccgtcttacggcgatggccgccggcggcggcggcggcgacgacgaccaacgtttcgatctccccgacgaccctcctcctgcgcatcctccggctcgtcccatccaaggaggccgcgtcgaccggcgcgctctcgcggcggcggggctcgctctggcggcgccgtcaacctcgccgcgcgcgtctacttcgacggcggggtcagccgcagcgtcagcctcgacgaacgggaggaggccttctcctcccgccgcgacgccttcgtccgcgcctcgccaggcggcgttcgcggcggccgccccgccggaggcaacggcggctgccgcggcgtcaccaggctcaccctcgacgtgcaggcgaactgccctgcaactccttgatctccaagttcctgaacaatggcggcgagacgacggcgaggtggacgtggttgacctcgtggtctcccaccctgcggcgcgccgcgtcgaggatctccgcgtccgcgttgtcccctgcaggtaccgctcctactccgacgacgacgaggagaaagaggcgagatgagacagcggcgtgtacagcctgtcagcctcaccgtcgagtccgcgtgctggacatcaccgggtgcagtgcaccaggctcgctctgccgtccgccgccgccgccgcgttcccgcgccgctgcgtcgtgcggctctggcatctgcagcgcctcatcgacgccgcgccggggctcacacagtgcacctagagtccgtgtccgtctacttcgacttcggctgttcggcaaccacccctactagtactactacgatgacgacgaacaagactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagcacctacgacaacgacaacggcggcggctgcatcgcgatcgacgcgccgaagctacgctccttgcacaacctcgagtcctcgtcgccggcaaggcgagacgagagccgagcacctccgcactttccccgacctcgagcgcctcaagctagtaacggaggcgcggctgcccgctgccggcgatgaggacggcggcggcagcgatcgccaacctactcgatccgttgctgcccttctcttcgagacctcagcctcaagctcgacacgttgcctacaccatactcgatgtcatttcatgcacaattaatttcaacaagatttcgacaagtccattggtcccttcacacgccggaaatggatgccggcgacggcggtttcattatcggcacggcagcaatggtgatcgtcatgacgacatccccgcgcgttgagtgaacgatcgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaatgtaataaacagaggtctacgatgaaacaaaacaattcttttttttttgtttgtttctaaagcctatgcgcgttgagcgattctttcaatttactatagcaggcctgaggcaaaaaatatactataaacattagagtttaggataaggttcggtccaaaatttaaaacattgatcatcaattttatattagaacaagttcagaaaaaaaaatctaataactttacgatattacgataatacttttcaaggcaattcacatataccattaaacttaagcatctgagaaatcattattggtcaaagttttaaaagtttaactaaattttatcttaaacattaaatatttatgtatggagaaagtatcatgataagtaggagtaatagacacatcaacatagttttgctacaaaaagtactgcaatatttttttctttacttcacgctttttcaccatgtgattaattgctaactctacctactaagtagtaagtatatgttcgtctctctcttatctcttattttttgacttccatttttcattttttaatttatcagtccattttgcaccgttaattttcaaggaatctagtagacaattaattatttatgtcctagttctcactagatatgagtactagaaaaacataggcttagttcggcatcctgagttcccaacccatctccctcgtgttccgcgcgtgcgcttttcaaacaaataaacggcccgttttttacaaaaagtttctatacaaaagttgcttaaaaaatcatattgatccatttttgaaaaaatagcaaataattaattaatcacgcgctaatggaccgctccgttttccgtgcgcggaacatatgtttccaactagcagcagcgaacacagcattagtcatgtgatttgcaattcatagttaaatatataaaattccgtgtaaaataatacaatgttaaatatatgctgaaaaatttgagttttctattttctccttgagatacttcttcttttaatttacctttttttattggaattaatgtttttggactagttatttttgttttgtttttattttggatcatctaaactctgttttgtgagtacattagcatcctcataccgacaatcatcctttttacgtgcaactcatcgtcaagaagagtggttgcatatgcctagataaacgcatttgggtggtccaaagtgcattaaatgaaaaaaaaaagtaccaatccaaagtgaaaaagattcagtacagaatggtttaaagtaaaacagagaagctaatggagtagcgcactgtcttgctcagcttgcaagacggtcgaatcagtagatagtgtggagaggggaagccccaacgtgtgtttctgagcttttggctcatgattgtactcctaatacttgattaataaagctctctgtttgcggaaaaaaaaggggagtaaaacaatcggtaatgtttggctaatagaaatgggaaataattttccacttaccaaaagacatctttaaatcctaaccatttattccccctcttccatttaatcctaaccctttattcattttacaatcccgatcctttccctattttccattatccaaacacacccattgggtaataacaaccggtgcaaaagtgcgattcattccttttcaaaatgggtgtaggcacaagtaggtacagtatgtgactacgagcccacaattacccaatgaagtttgtcctgtttttattgagttgctataacgcctccctactttgaagcatccatgaattatccaatcctagggtattacagtgtacacttaatttcaagtagctagcatgccaagtggcagagtagtcaaatcacctctttgttacctaacctacgtaccatgatatggtactcctaagagtgacatatataacacatgctaatctcaaagagaaaaaaaatcgaaaggattggatagaagctttggccgttgctgggcagtttcggcgatccatccggcacgtatatacccgccaccactctacgcacgatagaattgcaaccaacgacactactaaagtactaaacgttaacttgacccaggtcaacaacgtgactgaattaaaattttataatatagctgaacttggaccccccacgttaacacacggagcagtagcattgcatctatcagcttaaaaatgttagatctgacggtaatggtgtttactttgaaagataagcatggaccagaagagtaatctagtcgtcgatagcaattagcaaagggtcgatcgaagctagaatatatatataatatataaatgacacttgatgaatacaatgataagcatattttccgagcgtcttcgttagctgttactccctcctgcctacaatataatataacgattttgagtttttatttgtaacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgtcctcgtgatcgccgccgccgccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatgaatcagtttatatgacattagaaaatggccgtaggaaacagacctgatcaactgactttatgctttatgctttatgcagtttgcagttgtacctgatatgtaagcgatctctctctatacttaaaaattagtaaaacattagacttgttcactttgatgccaaaaaaaaccttaccaaattttggcatagttgtcaaaatttgccaaaattttgataaaatttcttatatagttaccaaaatttggtagcaaactaaatgtagccactttttttggtaactttaccaaaatttggtaaggttgaaaatggcatcaaagtgaacaagatcattgttatatactccctccattctataatataaaacacaactatttttttaggtgttccataatataaggcatgcatgtttgcatacaattaactaggacatcttctctattaaattattacttttttaaatcctccacccttaagatctctaattgtaacatcttgggtatttagctatagtattaatcacgctaatgacttgatcacactggctgagagcggtattgattgagccacgattctggctaggacctataaatatgttgattgttgttctattatggatcttaaatgatatttcgatcgttttcttgtcatttatttatcaagtcatatccatatgcatcattgatttattgttagttagactaaatctgttgaggagtgggataatttagtttcgatcaaactatacgtagattagttgtcacgaagctaggtatacatgcacagtagaaatcagaactgaaactatagtaaattattcacaaactatttggttataggttgcatacatacatacgtacgtacgtacgtacttacgtacatacatatacagactggcatacatccatgtgtacacatattcattataaatcttatacgtatgcatctcatatattgtgcagatacatggtgcttataaatacaaactgaactcatacgctctgcattcaagtaaaaggagaaattaaatgtattaggaaatgtttatatgattttagaccgcacaatttctatttaggaggttgcatatttaaaactttagttgtagtagcaataaaggaatttttgtgttgtctcaatctacaaattttgcatccaaccaaataggggcacaaaagatgtagggcctgtttactttgatgccattttcaaccttaccaaattttagtaaagttgctaaaaaagtggctacatttagtttgctgtcaaattttggtagctatataaaaaatcctgccaaaattttggcaactatactgaaattttggtaatgctaaaatttggtaaggttttttttggcattaaagtgaacaggcccgtaaaccgagccatctcaagccaaattccaaaattatccatttttgcataaaactccctgaattctagggcaattattaatcggtcccttaactctggagtaacctccaaaattccaaaagcttatagactagaatgcaaaattactaagtattccaatttcaccagatttccattaaattgtaaattagtgaaacctctcaaaattaatccaccgaacatgtcatggtgaggtgtcaatcaaggaagcagccaccaaacaacaagtaagtgagtcactggttaagttccaccaagttaactagttcagtgtgaaaccattcattccaaccaagcaactgtatcgtcgataccaagagactgttcactttaatgctaaaaaaaccttactaaaatttagcatagttaccatactaaaattttgacaggatttcttatatagttattagtaagattgaaaatgacattcagcagtaggcacagcagtagtagtactaccattttctactgcaaaaagcacagcggcagcggcagatcgccatagtggcagcaacattagggggagtagcagctatgaagaacaacagtacaagcagtagaatctcaactggagtaaggcagtcttgactagaaatcagtagaggttagggagataaagagatattcaaccagaaattatacacctcaccaacaccacagctcaaccatagtatccacagtaaagcaacttggtagagagaaagagagagatgaaccaaatctgaagaaggagaagtaggggtgttcggttcctgcatgaacagtgatttcagctctaggaggagatggtacttcagctcaagaaacaagatggatcagtaacagcagaagcaggacaagaagaaaggaggagaacaggcaactgttgtaaattggatcaggaggtaaaatcagcaagaacaagaaatcagaaaaatcgttagcaagggtgcaaatcaagtaggaggtacctgagcttcaagaagagaggggtttcagtttctggaggagcaggtggtgcttcagctcaaagaggagaaatcagagttccatcaggagaacccttgaatcagagtccagaagagtagctgcagaaccagagttccctatatcagtcacctaaaatcatggcaggtaatcaggagattgaaatgaaagtacaatcatatcatggcatgattcttgagtgatgcatatactagtatgtgtaggagttgtgagttgcatttgcatccattagaatatgaacaagaaaattaagtaatttgtgaaggataagtctttgtagtccttggtcgtggttcttcctttgcttttgggtagtttcaccttttaaggacagcatctactcctttagcatactttcagttgctaggacagctgcggttagtaggacaacagcagttagcatctcctttatgcctcatttatactttattcagtttggatgccttctaggacagcatcctattcaaatttcgaattttagactagggtgcagcaataggcttacagccagctatggctatatatatgtatccaacctccctcgggtaggtatggctttgagtttatgaataaagaaaaccagaaaattgccccatcctaagtgccatcctcttctcaatgagagtaactattaaaattctaacaatttgagctgtagagtaggaggtgtaactagtaggacataaatatttttttatttaactgataagtaaataggttaatgttagtttataattatttggggttagtaacaagaaacattttagtttttctagaatcattatgtaaatgcatttaggtaaacagctgcgcatgcatttgtttggtgaatcctgaaattataaatagttagaattaatgagtagagttataagtctctatagcagagcatctagggcaaatgattctagattagagcatggcatatattagttctgtaagtattacttcctccattttataatgtaagactttctagcatttcccacatttatgtaaatattaatgaatctaaacacacatatatatctagattcattaacatacatatgaatgtggacaatactataaagtcttacattataaaacggagggagtaatcaatataaatcgtattccactgtgagaaacattagcagccttaaaaatcaaccaatgcattagttcttaatattagtgatactgaatgtataggattactctggatagcaagtgcacaggtatatctttagttcgaataaacctaaacttatgggtctctacagcaagtcatctagagaagagcataatatcagaatctaaactttagtagttgatcagcataaccttgctaagaccaataccataaacaccattatttaactgtgatttcagtagtaagtatactttggcatcaagatgaagatttataatttctaggtcattaaatccctcaagtgatactaccattatgcatcatgtatgaatgaaatcatattaatcctctagattactattcagcatggcaacataaggatctgatcatgttagtttattagtttgtaacaaattttaatatttagatgtgttgctttttctaatacaaggatctaaatcactaatggaaacgatagagagcaagagaatagagtagagcaaagaagctacattttcatatattacataagccgtagacaccatttacataggggtatatgtccttttataggacttttaggtcggtttctacaataagcgacccgctacaatagcatgtttttacagctcatgttacagctcatctaatagcacaaaactagcttgctaccaagacagacgtgctgcttgccaagcacaagcagtaatgaaactacctgatacagtgtacacctttgctagctagtaaaatttgctttgtatacttccatgccaacacaacaaagcatataactcacttgtgtattctacagcccattatcactcatttacaactaaggttagctaatttgtgctagaaacttcaagcagcaacaagcaaccaacttgaccaactagtagtcaaatccaatttgactttgttatctcaagaacacaaattaatttccaacattctcccccttaatttgtattcttgagatcttcactttactccggtcgcttctttatacttgatgagtgctcacacttgatagtcagtaggacacatcttcaacttgactcatgtgtttgcctgagacggtgacgcaacttaacacgcctcgaacaaatactcattcagtcagtcggtcacatcttcgacttgccaaactccctcaacttcaagatgggtagtctgtcgcttctacgacttgccaacttgaacaaaacacacattcacgttgtcctagacacaactcttggcaccaattcagaacggtgaacatatcttcctcaacgtcctggactcaactcttggaaccaatataggactacaaacacaaactagctactactcaccctagacgcaactctcgaatccaattcaagacgaggagcacatctacctcaatatcttggacacaactcttggactcgaatcaggggactcttaactcaggatggcgtcacatcttctcaagatccggagtatcatcttccatcgattctagacagtgactcaacttctcatcttcccagactcatctaccatggtattaactctacaatcccaattcaaaatggtgacacatcttcttgtggacacacattcacaaaaactaacacacaactagctggtatgtatatggaatcaactacatacacataccgagatgacggttcaacaacatgcggtttgcacctcatcatggagccacatgctccgtactaggcacacaccaccgcacaccatctcaacttctcacaagttgttgccatcggcctcactgccacaaccaccatgacgataggtgccactccacagcattgtcatggtgtcatcgggggcgtgctccttacctccaccactttcttgctcctgctatgcccaacttaaaaacaaaggcttgaactctcaaatcttgctctatctatgcctcacctgaactaggctctaataccaattgttgctttttctaatacaaggatctaaatcactcatggaaaagatagagagcaagagaacagagtagagcaaagaagctacattttcatatattacataagccctagacaccatttacataggagtatatgtccttttataggacttttaggtcggtttctacagtaaccgacctgctacagtagcatgtttttacagctcatgttacagctcatctaacaacacaaaactagcttgctaccaagacacacatgctgcttgccaagcacaagcagcaatgaaactacctaatacagtgtacacccttgctagctagtaaaatttgctttgtatccttccatgccaacacaacaaagcatacaactcacttgtgtattctatagcccattatcactcatttacaactaagcttagctaatttgtgctagaaacttcaagcagcaacaagcaaccaacttgaccaactagtagtcaaatccaatttgactttgttatttcaagaacacaaattaatttccaacacgatggtcattgcataagcataattaaggatttaatcatgctagagtgatttctattttagtaatgcaattcatagacctattcatgtcagcattcattcatcatgaacatataggcatcatccatcttagcaacccaatttctctagaaccctagatccagtaaatacaaccctaagtataacatcatcaagtgaatcattaggacaaattcacaagcatcaccagtacatcacaatttacataacaacaccatacaagagaggacaccacactagtatatcacaatagggatcagagacgggaggatggaataggtagctcacctatggagcagagggatgcagccaccggagttgcctgtgtttccaccggccatctccacggtggctgcagtagcaggagaccggcggctggggttagtttaggggcagagaagcgaggatccaagaaaccgattcaggccggcgacggttgcggggcggtggctagaagggtcgccggagtggggtgtggcagcaggcgcaagggagagcgacggcactgcctgggaagcggcggcgctgggtggagagcctggttatgtaatctggatgatattctcaagtttggtattgaacttgtttgttctcaaatggttatatgtgcattatgggtacatgctaccatttttttatctatgtcaagtgctttcttgacttgtgtcaaatgctctacaaattgcaaggtacatgttgccaaaatttagggtacatgctgtcaaaattttgcttacatgctgtcaaaattttgccatcggagcaacagtttatgaatacacatatatacaatacatgcagcaatatatgcagcagttatatgcagcaatatactccctccgtcccataaaatatcgaatcctagaagcccgatgcacttttagtccaagcggtgaaagatcaaaatacccccatcaagtacaaccatgattagcacttttgttttgaaaaaaatctctgtgaacactaaattgttcccagccccttcctcgatacccaggcatcccaccaccggatgttcgccgtcgatgcatcactgagtaatggtgtcacctgcatttgatgacaacgccaaataccaaacgcatcaacaccaaaaaccagcaagcctccacctttgccatctggatcgtgcatgaagccacgaactagcaagtaccaacaacatagaagaaccaagaacatgaactagcaagtaccaagaacatagaagaaccaagagccgagaagaaccaacaacagagaaaaagagatactacaagaactagcaagaaccccgacgcatgaactagcaagaaccctgacgaggccacgtccgctggtcgccgccgccgccgccgatgccgcgtccgctggtcgccgcagccgactaggccgtgtccgctcgttgctgccgccgccgaggaggccgcatccgcctgttgccgctgccgccaccgatgccacgtccgctggtcgctgtcgccgacgaggccgcgtccgtcgtcgcagccgccgctgccgccaatgccgtgtctgcttgccgccgccaccgatgaggccgcgtccgctcgtcgcgcggccgatgccgtgtccgcttgccgccaccgcccccgcagacgaggccgcgtccgcctgtcgccgccgccgcccccgccgtcgaggcggcgtccgccgccacatgatggtggagcgggagaaggctgaggagtagaggagagagagatggggagaaccgctgggtgggagaggataaggattgagcggtgtgaactgaacgcgaggagagagaggccatgggcccatcgatgtgctcgagacgacgtttctcgttttgtgcgcaggagtcagttttttgtgggacaaactccctcccctagaattcgactttttgtgggacgaagggagtatgccactatcctgctcagagaagaggaacagcagggcagcaggcgtcctgcagtcctgctcctgacgccattttgatctctatggcgagagaggcagagcagcagccagcacgcgctctgcctccccttccccccttcccgatcccgatccccttctctctgtatccctttccctgacaagtggggccaggggtaaaagagtccgaaaagagaaggaaacaacagaaaacgaaaaagaaaaagagaaaatgatggaaaagagagaaagtgatatgaaatcaaaaaattagcactcctagtagtgtattagagaaggcatgcggattgggtggtaagtttgcaaaggcgcacatatttagtggcttattgtcaaaaatctcgtggagagggtgagggagaggaagaagaacgagagaaagagagaataggaagaaggtggtctagatgggcttttctgttaggctttgacatgtgggctgtatatatgtgtactattgaatttaatgactattgaatataaatctctctcaagtaaagtaaaacttctttcaattaaaataattactcttttaaaaataaaaagtgcaatgatgtttgttttaacactaaatattttagtccaaaactaaattatgttatataaatcatagatctttaccaaatcaaaacatacaaatatatttaaccatattcaacttaaaaatacatatgggtcatctagttgagtcttgaggtgagagtggataacctatagtgttgtagattagctatgatattaaggttaggcatatcatgtgcatcgcattcatataaacattctcgtatttagttgtgttttattgtttctttcagtttggcgtttatcttggatttcttgggattcttcattaatttattcgtcttcgatttcaggtatcttaggcaagtccaacacctttgaccaactcttgttctattttcgtaattgcaatctatatgtatcacattgcattaaattatactttctatgattaaaataaatatgctgatggattggattgactggtggagcagtcggtcatattataggtgtgttctgaacttgccatggtggtgggggttcagttacatatatttatcatcataaggttaaacaacaactgttatatggcattcaagcgccgtagcgatcgtggcaaccacatgacctggaatggaacaggctagcttagtagttctttcttaatggctttatcctgcgggcttaaggacttccgcgaatcccatgagcgtggcctagcgatgagggttgccgttgttgcagaatccgattagatgatgtggatcgctgttgttgcgggatcacatgattcgccgttgttgcgggaatcacctgcagagataattgacagatgggattgatgaaaagcttgtgaccttagccttgccagcatacaccatgaagtgtgcttcaagcgccgacaggcgtgggcattaaaaggtttaaggcgtctgtgggtacagcgacacacctctgcagagtatatgaattatgatatgtcactccgacactccctgtttcgggtagaaactgcgaacgcggcaggaaaggaacctatcggaggttctaatacctgtggtgccttatatgcaatagattttataattacttaatatgagtttttactacactgttttatgaacttgcataaaactacttgttcgattatgggatttggagatatatatattatgcaggtgaattataggcatgtatttgttggattgctatagttgtacttgttgagtaccattcgtactcatcccttatatatattattccttgtagtgttgagctaacaattaggtgaagaaatgttctacatgattgatcaagatcaaagcaaagactcgttccatatctctacatcaactgagagttgaaggtcacgaagatatagaatagcaaggtattgttagtgattattttagcaaaagctaatttctttagtttttatttaatggttttcgctacagttgtttctgttatgctactctggtgtactcatttcttggtaagttggttcttactaaggaatgagccgtagaccggtattctaccccggaagtagaatacgagggtcactacactaattctattggatgcatgcattatatttattagggtaatctaaactaggggatgataataattgtttcttgatctttgggctaagagtggttgtgccttatattttagaatggaggaagtactactaatgtaaaagtaattataatcaagcggtttaccatatttgttgggacaaggactactccctccaaagactttaccagatcttatcccaaaaagtcaaatacttataactggagggagagggaccgagcgagtataagaaaatgacagagtacatggtaatttcacatagaattttttctatcacaaatcggactcgctcttccgaagtttggccgcttggcaatttcggatgtagatagtcatatatctggcacacacccaacgtacacgtaaagataatttgaccgaggtaaatagagtagaccgtgtgtacgccgtcgacttaattagatattcatctgccagtgcctcacaaagttcgtaatcaaaattgttaaatattaccacgtttgcagatgaaacattacatcaaacacaaaaaagagcttgatgttctttttaaaagctataatcacatatactaggtacatcgaagtgcgtacgcgcacgacacaccgatatttgtgcatgtattgtaaataatactccctccgtttcagtttacaagacattttaactctaatcgaagtcaatctgttttaagtttgactaagtttataaaaaaaatagtaacattttcaaccaaagacaaatttgtcgacgtttgatgtcgcgattccggtatttgcatagtatgaggattgttggtactaggatatatgcgagactgaggtaaaagatggcgacgaggatttttatacaggttcggacccctgaattgtcaggtaataaccctactcctgttagccgaagccggtctttgctcttattcatcataatcacaccagtacaatatttggggtagcctatctatctattgtcgacttggcggctataaaaccatcccgtagtcgacaacagagtagtcttcctcctcgaatccgtgtccggcgagatcagagacagcgctagatccctcctgacggtagtcgtaggaaccgtatagggactaactatgcttatcaccgatgtcgatatccggcagcttgtcttggcgcatgttggcttgtatgttgatcttgtgtcttgatctattgttccgtatcccctctcctcctagggggccttgtatttatacccataggtgtccccttgtccaagtagaattaggaaaaccaatatagatacaatccgagtagtccttatcgtttccatgtagaactctattcatcctttcttatgcggatctcctcctatatccgaaggttgtttccgtataagacatggtatgtggtggatcctgccgagatttagtcaactattattagatatatagtatccataaccttgacaaaatttattatgaaaatatattcagttattactatatttatctagaaacttagtcaaacttaaaacaatttgactttgatcaaagtcaaaatgtcttataacataaaacggagagagtataaaaggaatatagaaaatatgatacaaatacaataaattgggatgacatctttttagtgatagaagaaatcctacctatatatatccatatgaatatatttagagttagagtaatatgtagactctagaactaatgactgagaaacaataacatacaaaatgagaagacggaaacactaagtttcgtatattttttcgacttactccaaacttgctcctttattattatgcattaataaccaaaacgttcttgtttatttattagaaactttgatgtcgaaatcatcctactaaagatcaatcttctacaagaaatacttttttaaaaaaaacaaacgagactttttttaaaaaaaaaataattgtaatgacgtaggccttgtttagatatcaaattttttttacaaaaacgtcatatcaaatgtggacacatgcatgatgcattaaatgcggggaaaaaatcaattacacagtttgcatgtaaattatgatacgaatcttttgagcctaattacgccatgatttaacaatatgttgctacagtaaacatttgctaatgacagattaattaggcttaataaattcgtctcgcagtttacaggcggaatctgtaatttgttttattattagtctacgtttaatacttcaaatgtgcgtgtatatacttcaaaaactttacacgcaaggaactaaacacacctgtaaataacatgcgtctaagtaaattggcaaaatttgctacatgacactcaaaaaagtgtaattagctaggagacaccgtaaaaacgtgatacggctgatggacactaaaaaattgtgtaattggctataggacaccagaggcaatattttataactactgggtcaaaagaggcgagaaatttttcaaaatagcgaaat

SEQ ID NO: 39494 - DNA, 15344 bp, Oryza sativa
attcctgcagcccagcgaaattgtccctaacacggagcgccgccgcagccgcctcacgcgcggccacctcctggtcgcgctccacgccatcgacgtggccaccgcctgccccccgcgcggccgcctcctgctcgcactcctcgccactgctgccggtctcgcgcacggctgcctcctattcgtgctccatgccaccgccgtcaccaccgacgacgaggaggacgatggcatcggcgcagcaaccatcaccgccgtggcaggatctcccggcagacctgcttgcgctcttgctcctccacctcccgtccctccccgaccgcatccgcctttgtgtgatctgccgctcctggcgcacggatgccgctgccagctacctcaccgacggctgctcccagctacaaaaaaaaattgtgatttcgggtgggggaaggtggcgccaggggcaatctcgctatttcaaaaaatttctcacctcttttgaccaagaaattataaaatattggctccagtgtcctataaccaattacacaatttttgtagtgtgcatcagccgtatcacgtttttgcagtgtctcccagccaattataagttttttgagtgtcctacagcaaattttgccaagttaattttatctagacttacaaaaagaaaaagaaaataacaaaattatatttatgtgaaaaaaatccaaatacaaggataagtgctctgaacttctgaagctttcaacggtaagcgtggacgacgactccacatgagcttgaccgctccatcactcatcatcgttatactacttaagtgcctcaccgccgcgtgaaaaatatcatcagatcgatatcccaattaattccacgattgatcgatctctcgcgcggtggccaaaatgccagagtccatagccgagaatcgcagcaacggcttcgtcttcgccgtcgtcgtcgtcgtcgtactcgccgtgctcacgctcatctgcggctcgacgacgtcgccgctgccatgcgccggcagcgccgcggtggtggcggcggcgtcgtgcgtcctcgccgcccggcggatgctcgccgtcctgtcgccgtggttctacgtcggcggcggccccgtgatccgccgcggccacgagtggtcgcccccgttctacatgtacgcgagggcttgcgacgacgatctctccggcgtcgctctgacgttgggagcggcggcgttgctgctggccttggcgctgctgttcttgcggcggcggcgttcggttggtctaaagaaagtcgataaggtggagggaaaatcagagtgaggaagatgtaaaaaaagattattataacaattaaaagtaatttgtatttaaaacttttatatatttggtcttaacaataataaaacttctatatatttagtcttagcaataaaaaaactaacgctgtcaaaataaggggcaaaatgaactgcaaattttcgctttaaaaattaattttagcagcagcttactttgattgaagattcattgcccgtcgagtccgattcgtttattgcactcttctccccttaacttcacttccttttgtccatcgatcttgtgatttgtgcgttatgtcacatattagaaaatggcatgtaatgacaaacaaacaaacaatgaaattaagtggttgccatttttaccaatttttttgcggtgaaaacggtcgatcgccatgggaatttggccctcacgaaggtcatatcactggccgactttgggtcatggaccgtgatggaccaacacttttaggctgggcaattatccaaatacctaatttaaagttttttttctcctctaagatggtggttttcttaactatttgtcacttttatctatgtggcatgccaacatgacaaacaaggatagaaaataatgtgggacccagtagttagcctcacatccctttcatttcccctccagcccatagatggcgacggtgagcaccttggcgccggggttgtggtcctagaggcccaccaccttgtagacggaggcggcgatgacctgggcgtggtagacacgacgatgcggatggaagcagaggaattcttggtggcgaggcagacgtggcaagcgtccagcttgggctcgcactccctgcagaggcaacggtggtgacatgggagaagcaacacagtggcatcgccctcgccacacgacttgcacaaccactttgacactgctagcgaggtagcgacggtgtcaacgggcaccaccgcggcgcatgccttcatctcgaagcaacaggactggccgtcgttggccgcggtggcgagggggtcagagtcaccgagaagccctcgacactactggagaccggaaggctcccgtgtgctcaaaacctacggtaacaggccaaaaacacacggtaacgacgttaccgggtgctagtgcacgggaacatatactcggaggcttcatcagtttaccgtgcgcacttcccgggtgttttacgattatgcgcacgggaaggccaaaacacataccgagtgtgctgaatcacacggtaaggctgccgtcatagctggactcttgtgtaacggagctcctaacggaacggtggcttaccgagtgtccttcacacacggtaacatttggtgtgttaccgtgattcattcacacctggtaacatgtggtgcgttaccgtgtttgaagcacccgctatgagaacatgtgttaataaaaaaaaatatatgctatttgcaatttgtttactatatccatcagagcttatttccatcacaatataaaccaccaacaagcacacaagagcacaacacattccaacataaatatatatttcagtaaagaggttacaattaataattagcatacaagcaattcatggttcatgtcagttaaagcaatagccaaagttacaatagctaggaacatattatttggttgatgcaaggggggtggcggcggttcggtggagaaccagagtgggtcagaggtggcttgctagggttgaagtgttctatatatagccatatctgttgatgaatctaagccgtccgatttaaatccattcgaccacagtttacaagcagttttgcttggaaaaataatactattcacacgatttctgtacaaatccctttaatgagaacttaaatattcaaattatatataattgttattaaaacttagtttgtttgcaattgttccaaacaatatcatgtgtttgtatattaacagagtgggtaataacactacttgtttatgtgcaccgcttgaagtcacaccgagaacaacacacaggtgggaaatcctaattataacctactcaattaatctcatccaaaacgatatgtggttttgtgttcgtatttatactcatctgtgtccctatccaagtagaacatgggaatcaagccaggatatggttcatctagttctgttggtcttgactagctagtgcgatcacaactgacgttgcctttctatttaaaagataataatacctttcttgcacttttaaccatccggctctcttctcaatcatttgagccatcttgggtactgtgacatcctagcccaattaggatttggcctatgtggctcctgtgagctgtgtgcgcatgtttagtatcaccttactagtttagcacgagttgaaccaatttacaaggcatcttccctccaaccatgccacttccgggttaacccttttatacgaagcgatgaagaaatataagtcgagtggtgtgtgtaagtgggtccgcccgtcggatgggctgggctacgcggttctgaagggagggctattacaggtacattatctcctacttgtctatgaactcttgacggcgacaatgacaagcggtgatggaccgcaacgatgaaaattatcgagttttttttttggatttttatttttgcatccatccacacacaaaaatctgattttggcatgcagatgcgccacccatgtggaaagaactcttgacggcgacaatgacaagcggtgatggaccgcaacgatgacctagctagggttttcgagtttttttttggatttttatttttgcgtccatccacacacaaaaatctgattttggcatgcaggtgcgctacccatgtggaaagcgattttcacatacacttttgggcaaatggacggctcaaccacacgaaaaaaaggttttggaatatatggaaaatgccttttagtagtgggtaagattaaccaatccaaaataaaaatattggttaaaaggatgatccaaagagaaaacatcggtaataaaagttagcgtaaagtgaaattcaatctaataataataaatcaaaattagttgtattatgtgaattttatcgtctactatattgggagtgtctagattgtagcacacgtcatgccaaatttattttcacaattttcctcattttctatacttttacaacttttatgtgttttttagattttataatattttcctgcaattttcagttatccgtaaaaatattgtgtacagtgagttgtgaattatagataccctattattgcgagttgtattgtctactactctactatctttgagagtgtcgatataaataattttcccttacattttacaattttcatgcatttttttatactttttaaacttttcttttaatttgaaattgttagacattcccgtatgtcaaaacgaaaaaacaggcgggaggattccgctccgttgccgccaacaaaatcatagtgcgtgccaacaaaattcaaagttcgtgccaacggagtgaaaacggaagtatggaattcagtcatgttaccgtgctccaggtggtcccacacggtaacttctctgttaccgggtgtttcgtggtagcgcacgatattgttgggacgttaccgtgttcctagtcctacacccggtaagttactgggtgttttgttaaacccacggtagcatctggttgcacacgggaactttcccagctccagtagtgcgacagcttgggcgggggcgaggcggaggagatggttgagcgtgccgcagaggtccgccacgacgtccccgttgctacgggtgagcccgcaccacgcctggctctcggcggttttgctaaaaatttgtcgacaaattttttgttagaaatctcccagattttccaccgtccaaattgcattatgatttgtgctatctgtccgttacaaccaaaaaaaggactaccataacctccgtgggagtcgatcccatgatctgatgctttgaacgtgaaatattttgccagctgagcaagaaggagcaactaattgtttcaccaaaacaatacttacttattagttatactgtattagttatactgtatgtacatattaattatattattagttacactataattatatatattagttacattgtacttacatattaattacatattagtcacactataattacactatagttacattcgtaagtacagtgtaactagggtgtaatttttttaaaagaaagattttggtgtagttacattataattatactgtagttacattcataagtacagtgtaattagggtgtaattttaatttttttaaaagaaagattttggtgtagttacactataattacactatagttacaagtgtaagtatagtgtaactagggtgtaattttttttaaaaaagcttttagtgtagttacactataattatgtattagttacactatacttacatattagttactgtaattacactatagtatagttacaaatgtaagtatagtgtaattagggtgtaatttttttaaaaaaaaagcctttagtatatgtgctgacaagtagttagttttgtggcttggattaacacgccttaatctacactatacgcgttgctttttaatttggctagcaagttggccgtttggtggttagaaaaatctgtgtgattttataacaaaaatctgtcgggtgttatatagatagatccggctctcggtggtggcctgacagaaccgctcctccaggcctccttcaagagtaggcttgattgatgaataggccgaatacatgcacgcgaaggagaagggccaaatttagttatgggctgaattcattcaaggaaatgatgtgggcaaaggaatatgtgcactttgactcccttaactagtggccaaatctaattcgtgggactcaaagtggacttaatttccgtgggcaaattcatttttggcccattgaaaaaagaatactgctatatgtacaacccaattatacaactagaaacatgcaaccataaatcaatcaaaggaaatcatgtttatatcattgtacccatttacaaccgttgatcaaattcagtcgcaagtgagttggacagttgggtcatatacatagcaatttccttgaaggaatggtcatctttatgtctaatttactgaacgaacctaattaaggttgtgtcttttttgttcctgactcctctctcgttttccacacttttttcaaactgttgagcggttccttttttttttcaaaaaattcctatacgaaagttgctttagaaaaatcatattaatccatttataaaataagttagctaatacttaattaatcatgcgttaatgtaacgttccacaagattagttcccagcaccaaggaaagaacgcaggcttagctcatttacggaggcctgtttagtggtccattcacgacggattcggcccattagctccataataatgatttcgataaatgtgaatctaagacaaaatgtatacactgcgataactattgcgataaaatctaaggtgatcatactaacttaccgcctaacctaaccaggtagctatagcttgtcatgcagatgcagcgaagcttctgttgtacaacgatgaagctacagatcgaagactttttccatcgccagaacagcatcatcctccagcaaatttgaatggtaccttctgaaaattccccaaatatcacctctttcaaaagtttgaatcagctagttcttcagaaagctgccattgctattcccatcttcagaaagctgcctttgctagtgagtggccctggccttggacgtgcccaataggctatttactgcgcacgcacacaggcaataagatatccgcgatgttcaaatggactgaaaaatatgacacattccaaacatccttcatggtttctgaaagtttagttaccatatgagagcaaaacatcgcattttactcattttccaaataaccttaatgcgagggcataaacatccttcttctttgctgatgtagcttcactcaccattttcactgcctacattagaaaaacattatttcagaattaaagaaaataagatatgattgtatgaccagtaccttgtgtgtatttcttaaaaacaaaaaaccatagaaccgaaacattgctgaagacttgaaaggcatcaaaagctaagttgaatgcacaccgctgacagaggatgtccctgcgtcatcaattctctgagttcatgctcaaggaaatcctcagatggagtttcatcagctgaaattaactttccctctatgagcactgtaatttctccctttggctgccgagttgcaaaggcttcatttgcttcaccaatagttccccgccaaaactacaagatgtatgtcaaattcaggactacaaagagaaaataagtaaatacaaatatttatgagtccaccatgtagaatataagggtacagcttggtctacagataatacacaaacaattcagtatagctgattggcatgaacaagaccgcatattagtttcttaattcagagtcaataccaagtagaatctgaccagtagcacttcgcagtaggttcagcaatgtaaagctggaaatgacagcactacaagttaagagtacctgcttatagtgggtgggatataccatctgctgtaactaccagctgaagtatatttattttatttgaagaaacagctctagtattttattgaagattgaaatataaacagagtaaaaatttgttgattacctcttcgtgtaatttcgttatctcccttgcaataacacatgacctgaatatcaatacataaacaaaagaaagatcaacaacgcatgcataacacattagcaccacatacaaatgggatgcagcatagagtgcagtatttcagttgtttatataatactactacaaattccacaaaaagaaattccagatcatgcaataagcaatgatatacatgggtgacagaatatcaattacctagaatcaccaaatgatgaagcagcatcagaaagaaattggtgaattccatggggaggaacatagaaaatttgtgtggcagcttgacaggcagatatttcaagcctttcttttcttgatcgagcatgctttggtaaaaaccccactagaaatgaaatatcagaactaacaacaaatattgttcattgttgataaataaagtaagtacataatcattttattaccaaatgtaaattcatcagttggcaaaccagatgcagaaagagcagctattgcagcagacggcccaggaatggggataacagggattccctcagtagcacatagtctagcctgtaagcaacagtacaacatgcttaacatctcacacatctagaagcagcatcgggctttaaaaagaacagtctctgatgctgttactgctaacttgagtagtgtcaactaactgatagcacatgtagaatgtgcttcaataatattgttatttgcagggcatttcactattagacactattcattgcctatttgtttattcatggtttaagagagtagcaggatgtactattcaaacagattggcaagtatgaatggtcaaaggagtgaagtgatttaccagttccatgccaggatcactaattccaggagtaccagcatcactaatcaatgcaactgcttccccttcatgaagtctctttaagatattaggctctctttcacgctcattaaacttatgaaagctgagctgcaaggtttacagtttagactaagttcaatggcactcatcacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaatgccctgcagcaaggaccatccaagcttaaagctaggagcatgtttcaggaaaggagcacacgctccagttacagcctattactacatggaggtagcctcaaggttcagccaaaacaactatgttttgtttttcctttttcttcttctttttttttgtgcagaacagaaagcatgccctccctgatattttcctcatggtaaaaagtaaaggggattgataaaaaataataataactgatgctaattgtgctatcaaacaattaaagtttttttttctccctgtagagattttagcagaacattgctctatttcctcttttattctaaaagaagtgctgctaatcagctgattgcctattcacaaattttgttaagagtttacaacaattgtataatcagacaagtcccaatactttcgccttttctttttaagtaaaacggcataccactgtcagttctattaccctggtatacccttatgaatcactagatattatgacatagacatcaaaattcagaagatatttcgtaggcgtcagcttgatgaccaagtgttttcccacacaaaaatgtttgcagattgaccccataacagattaaaagctgataccttaaggtgatatcctcgaggttcccgattggcgttgccacaagatacagcccggaatccaaatcctgaagattgtaatagatcaacaacagacatcatgaaatagtcatggacaatctaattgaccaatatgtacatattccccacaaaatacagtacgaaagcattcttgcgttctactccagttctccagttcatacagaagagtagaagacacaagcacctgcataaaaagcaacattccgaacaacagctcttatttcacttgagagctgagaaagttcctcatggtccacaggtacgaatttatgcttgctcaaacattagaagaacatccgctcgcaatttggcacatagtaatgcatgaaaaacacacttatcttaacaattgctaaatgtctcaatactcataaaccaaaattacaccttccacatcacctatgattttagttctacggcccaaaccaatgcgttgttctgaaaataccaattttttttctagctcttctgagatgcactcacacagtgaaaccccccacgcccacacatactgaggccatccacccgtgagaaaactttgcaagagaagtgaaagaaaatcataagctgatgtactaatggagacggagaggtcaccggttccgaggcaggtgactccggcgagctgccagaggcggcggcggtggagaggcggccggcgagcggagccgtcgcagtcgtgacgcggagagggaggaaggggaggcggcggggtgccgttaggttcagggcgagggcctggaggcggagcagcgacgccatgggctgcggcggcggcggcggcggccggagagggaggcgaagcgtcgccgccgtttgctcccggagcgagaggggctggagaagtggggagtagatattgtggtgggcttcgctaccgttggatccgatctggacggcccatattggcccagggtttaattttctgggcctttgcctatttctcccaggtaaacctgcatttttaggatcgttttcaccgcgattttttgttttaataagaagtagaaaatggcgctggctagttaaccggtataggcatatgtaaaaaatgaataagcattcaataaagccgttatatattgtaaaatttatctaaagctctcctaatttgtaaaaccgttatatattgtaaaattttgaaatcctaattttttttcaacaaaattttatgaatattcaaatgttacttacaacttgtgttttatctgatttttgcaatgtaaaaaatcatacataataatcgataccattggacaacctatcaaatattgtcaaccacaagttagcctagccattgttattatgttttacgaattaacattgaaaatctatatgtctgttgacgcacccattcattagcccctattcttgtcactcactaaatatacacgttagtggtgcgcccaccaaattatagctattgtataacgttagtttactattctatttaggaatattatatagtatttataaaaatagattaagttctataaaatccgtgcagaaatcatatgttcaaaatttagttacaataattcttagttgttggttaggatcctagggtgtgttcgggagaaagagttgggaacccctccttcccggcacgcaaaacgaagcttgtattattgcatgattaattaagtattaactatttttttaaaaaaatagattaatatgattttttacaactttcatatagaaagtttttgcataaatcacatcatttagcagtttgaaaaacgtacgcgcggaaaacgagagaggtgggttgggaaaatgggggaagaacacagccttagtgtccacagtatacttttcctcccaaatattccatccggctataaatatttgttatttagaataaggtttgattaaactttgaaaatttaaccatcatttttaaatacaataagtttgacaatacttttaaacgtaaatctacacatacttttttattgagaattagcaaattattgttgattatcaatttttttttaaaaaaaatggaccaaatattgtcctaaacttataatattatgaccaaagggtgtactgaaaatccattggcgcatatatagtacgtccagcacaaattcacacttggatttttaatttctttctctatatctcaagcacatctaataactttacatatttgatatgtgtaatatggtatcatataagttatgtgataataaactttaaggtgtgaaatgatttttttccgtgcaatcctcgtgacagcggagagctagcttgctcaaacttgaagccacgctcacaatgtacttatgtaccaagagtcgaagactccaaagaagagatcaagagaccagaaaagtcttaccaattgaaatgaccacaggtgatgctcaaaagagctaacatgcataaatccgatcacaaaagcgtttctatccaaattacatctagttaataaactaagtaaccacaaaggtatcgtagcatcgtccccacaaggttacaagttaaaaggtcttagaactaatcattaatttactttccaaagtcacagcgcaaattgatctttctcgatcattttctttatcaaccataactagtagcgtcacatcatgcatatgggcgtgtttggttacctacatcaagcctaacttatatccacgtatgcaattgtcaaatgtttggttgcccgcgccctctacaaggcctggcgctgcacatgcatataaaggcctcctgactccctagccaggcccaagaggaagccggaattgagcttcactttagagcttggctgagcgcgtacaagtgcgaggatgagcaggtgcagtgtggggatgcatgagttggtgcagtgtggggagagggggtcacacatccgatccagtaacctccctcttctcatttgcttgcttggtgcctcacgaatcgtcctcatctctactgttgttagccatcatccgtcgccatatgaccaccgtcatcgtcatcaccacccaccatgcaacgtcgatagttgctttcctatcccttctcctcactagcctccggcctctcctcgggacaaacgatagtgcttgagggatgccttggggatgatagatggcctccatcttcttcccgtcggtcgtcgcctccatcttccacgccggtcactaaaactcttcctcaccgatgaccaccgcatttcaagtctctgtcgcccctttttgaccccgcaaaacactggatctagctaatggccaggattggcgccgtcggatccggctcagaggacagtatataaatgttcttgacatgctattctgagttttttttcccaatcatgcaagacatacacatactacacgtctacaccacaagtatacacatgtgaatataccccgttaatacatgctaaaaggactatagatcctaaatctcactaaattattctatatgaatggtgtccaaaaatagcaagctagaggagtagatgacagcccaaggaggcaaagaaagataatcccaaatctcactaaattcttagataggtcattttttcctgaaagcattgaatcataggatcaggatcctatcggattcggattttacaaaagtgcatattttttataaaagatctgtaatacattgcaaaaattaaagcctataacattaatttgttaaatttaattgacctttttactattcacattattttcgatccactttttattaatatatagtacttacatatagaatcatatgattgggatcctaatgagatactacaaccatatgatcccacgagattggtagcatcagcatatgaatacaaatagaataacacgagattaattgtttcggcttgctagctaggatatcttacaatatacgatcggggatcctattaattaacaaccttgctactacttatcactcattttgcctagtagctttcaattgagacagaatcagaaatattcaaaatttcttctcagaagcttgttgttcgatctccaggttaattttcatgaacactatatatcacacagcagaaagtgcagtacggtgataattgatgaaatggtggctttgcgtcgtcgtcagtggtgccacctaactgcatgcgtgcatgtgtgtcggcggtaatcatctgcaggctgcaacaggggcagcaagcaaagctggattcttgggcttcacacgtgcgagcaggcgaagcaatcttggaagcgatctttccatgatagtaagagaaagatccgtggcgacgacgacaccacagctgatcatgcatgcagagccgcaagcatactacctgcagtagttaatgtcgttggaaaattatatctctcggcatggaaatcgagaggaaatccccgcacgcacggctgttttctacccttcgcatgtgggattaatgtgatttaatttgtgaatattttcataattagatgattacgcgtattgattggtagcgccaaatctttccatgttttggattgcccccgatctcccttaccttcatattaataggggagaccggtgtcatggatagatgatgatctctccacgatcattttctccctaaaaatcctcaaaccttatctgatcagttgagtgctagagggagaacgtacggctgttatgagacagtgtaggtggagaccaaaaggtcaccgctactctgcaagtgatcgtcggcgaccccctcgggatcaagctggtgtcttcaccgctacgactatttcccctacactgacaatacatgaggtggttcgaggttctacatcctctacatccacttcggttcaaactagatcaattgtagttacttcaaacaacggtcatttaaaatccaattatgtattatagtgatcatagatggctaagcacttatgttagtggatcatataatctacaaatgtgctaatataattaaactaatctttgtgttttgagagtggtgaatgtgattgctagctagataaaaaggaaaagctgatgacgatttgatgaagctgctgataaaattaaaacaatctagctaagagagtagtgatcgatcaagatgctactagctagctagcttgtctgaattgatttcctttccaaccaattgatctagtatcgtcattgcttcacgagttaaggaagatgaaatcatcaaactcagtgcttcatctgttcatcatcgcatgaaatgtgcaaatgcctggaagaaccaagagagtacttaccagttaccacagggcaagacgaagattgttgctggtgcaaaaggatatcagaggaggtccagatgagctccatcactgtccgtcttcttcctctactccgacgagttgttgaggggaatgaagcctggtccgagaccgtccacgtgtacccaccactgtggtacgatctcaggccagacgacattcctctcaacaagatgatcgaggggaagaactgaaattaatggaggagagaagaactgaagaatggaggaagaagaaagcttttctcctatatactagctagctacctgcgt

SEQ ID NO: 39495 - DNA, 28381 bp, Oryza sativa
  unsure (1)..(28381): unsure at all n locations
tgcattgtgtttagaacggcatcggtttagttggaactgtttcagttaggtctgatctcctgtcttagcggatatatctctacaatcataatgttgttctaaatagatttgttatatccatcacattagacagatctatcggctcattgagtattagattatcatatacaatctcgtgctgcatcggttagattcgatctactagattgttgttgataatataagtcttgttaagccgataggttcatgctaatgttttatcggggtgctagccgataagttatttggacgttgcatcggcttgtagggattgcatatacatataagttggatttagccgatggcaacaaaggtttcgctggagatcgaaagccgatgcagccctgcgtcaggtgcccaagttccgccggaagataagtaaaaacctcagggaagagggtggcgatgcgccgagagtattattgatcgatagattgatagattacaatgacaccgggtgtacatatttatacccatagggagatactagtccttgtcggacaagaaagaaactaaaaaggaaaagataaagttcttatcggacactaaacacactttcctaaagataaaagaaaactaacaaactacgcctaattaatagataactgtcatgtcgtatccttcttgaactcgaactccgacgagatcgagcggggggtcggtggtctacgggctacagcttcggatccatctgcatcgccgggatcagagctcctcgccgccatcctccaccacctccccgcatccatcctcgcatcgtcgtcgcgaggaggtgcgacctcgtagtccagtgcctcctcttctcctctgtccctccacacgcatcagctccagcgcaggaggacgcgggacgtcgacggcggaggcatcgagcaggtcgagcggtagctttggcggcgtgcgggcgattgtgagtgcgggaggaggcaccggcggcggcgacaacacgagctcgacggctccgcctctcccctctccattccggcccttatgcgccgccgccgcctctcgtgtaacccaccacctccgttcctccctcacctgctctcctctcctctcctctctccacttggcgaggtcgatggtgaggccgccaccgccgccgctctggcccccgcccgccgccgccactgctttggccctgcccaccgccgctccagctccagtcgcccgtgctccccgcggccggcgaaggggagagaagagaaagagaaagaaagagagaagggaggaagaagaaagggagatagaggatgacatgtggggcccacatgtcagtgggccccacaattttttattttgtgtgtgaatgactaatgggtaccacgcatattttttatttctaataccacttaagcgccacgtggaaagaagaccgagtcaatactgccacgtatgcgccacgtcagcaaaaccgccctccaaaaccacccaaggagtcaaattgcaccggttttaagagtttgggggtcaagatatccagttttgtggtttagggtcatggattaggtttcgatcacttttgagggtcatgaagtgaacttattcctttaaatttagcccatgacagacagattgggcccgttccaaacaaggcctgaactgtatgggccagaattctggcccatccaagcaaggcctacatcctcttttcggccctagaaagcccacttccaacacggcccatttattcttttttccgtttcattcctccgttccgttccacgctctggccatcaaaacccctcctcctcctcctccccccacaaaaccccactctccttgctccgcccccgccgcgtcgccgtcgccattgcgccgccgccgccgccgccgccgacgccgtgcgtcgcgaaggtgatctccgcgtccctagctctctccccctcctcctcctcctcctctctctctctctcctaccttttctccgctcgcgcgcatgcaagcgatgcggcagcagcggcggcggccgtgctccggtgccgcgcggggcggggatcgccggccccatttctgctgggtttggcggggttggggacttacttgggtatcgagctgggaggtgtacggcttgttggtctaatccatggggttatatgtgtcgctctgagttcttaaggcactaaagggggttggttcgttttattcattttttttttgtttgcttgtttgtatgctttgatgcgtcggcgtcgctatagcgagttgttctccgttggtgaccgtgttgggcttggttcgagttttcgtttcgggcaatgcgcaatgatgctacttggtagtacttgggagcagagctgtaccaggggctaagctgatcaggttgttctttgctacgattgagcttcagattacacagttcctttgtttgtgggactgttaggatcccggtgattgaggcttgttatactgcgtctgtgtgcaagccttgattgagctcttgatttgagtcgctcactgcggggttgatattcgatgggattttgccaggaaattttacttggttccatcattaaattgtaggaatgtcactattcagattgttctcattactatttatccttttcgatgattcagtgctaccaggaatgctgggatgaattcatattgtgataagaaagaggttactgtagcttttagcaaaactaaaaggcaagaggaggatgaagtgatttggagaatggtagaacaaggcgctacagatgatgaagagtgtggtggtaccaactgttcggctggcgaaaatagggatcctggttggcctggaacgagtgtcttcaggatgctgattcctgcaactaaagttggcgcagtaattggtcacagtggagaaaggcttagaagactgtgtgaggaaacaaaagcctgcgtccgagtaataggtggccactttgctgctgcagagcgagctgtaagttctccatttagtagtattattttttttcttgatcatccttgacttcccattactatttatactagaatactgtttccttttctgcctgcagtatgctagcatttttttttctttttggcaatgatgatcttaattgagtgcttgcaattaaattttatagcatttggccacaaacaatactgcggggtttctttcagagaaatgtatgaatgattcatgatctggctaacgtatcaagtatcaactagcaaaccagaagtggactatagaatgtacttatcctggatgcagatggtttttctttgcttttagaatgttgtcctgttacgatgttgtgttgacttccaatcgcttttgtggtaactgaaatataacctcctatattgtttttttttgtctttgtactttggattcttatataagttggtctttttcaacataatttttgcaatagcttgtgattcataaaaatatgggcatcatttatgtttagttcaataatttcctcaattttgtttctttcaattttttttattggaaggtaatcatttttgcaaaggaacaacctgatgagccaaaacctccagctattgatgcactactaagagtatatgagtgtataatcaatgatgatggtttagatgtgagatataacaatatagttgtggcacggattcttacaccaagtgaacaggcagcaagccttattggcgatcagggttcagtgattaattatatcaagaaagcttctaaaaccaacatccatgttattggtaactttcttactttgatgcacctcttggaaccactagttccttctattgataaatttgatatcagtggtctccaactctccatatatacagatgcgggtctttggatgatgcactagtgtatctataagctacatgaatttcagcttactgaagcacatggttactcatgttgcttggtgactctactgcattgaaactaaatttcttaagcatgcagtgatgttttagccccatcaaggaattaaatggactactacatcagcatattctgtcaaacatgtttttgctggttaattataagctgagattgtacctgtgaaaaaatatgttcatgcaggaatagttaatattgcgtgtagctatgtacatgttgtcaggtgtccatattttcttatgtgttaagaaagtatttgttatggccagtgttccgtacttatgcggcccgtccaacatgacatccgttgaaagcggaccactggcgagagataattagtggattagatatccctacttgctatctttgtctatgtttccattccattagattgtttgtttcctttttcattagagattcttgttagggaccatcctataaaaggatcaaccatattattttaagaattaattgatctttctctttcttttgtcactcacttaaatagttacagagcaagcagagaagttaatatacataatgaactaggacttggttacacttaaaggattctgatatggcatgaaaattatgtgactaattaacttatttctttgaatttatcaagcaatatcaacaataacacaatgattgcccatggatgcaatgaaaagaaacagttttaagcatgacttcatccatggcggatggagcagggggcgcgaaggtggggaccccgggcctagtgctttcagcccatcatgcctgctatgtattcacggtcaaattatctagtaaccaagcaatggccacggcattgcaacatacagagtagcattttagttgatccgttgattattattttgcatttatcgttcatctattactagattcataaatatggctaaactaaattacatagtttttctcaagtgatattagcaatatttcccgcacaaatggcagtatgaaacaacaaataaaatcttggagggattttaatctcattgatgccatggtgatctggtaaaacatatgcaaaccatccttctgaatcctatttttttattagtgttgttccacggccccttcctcgcctctaaattttagctctgcgtttgacactgacttcatcaaaactacaaaatgcaacatctgtttaatgcgatgacgcatgggtttcattgcatccatcatttggataaaatgggttgcacttttattttaaattcaaaagtttcagttatgattgacctaaatggtattatattagttccatttggtgatatgcagtttcagtatctaatactactttcaagattaaactgctattatttggtacactttccagccttctatatataatcttaataagtactcattccatcatgtcttgactatgtagacggtgacttgccacctgttgcacttgaagatgatatgattattgaaatttggggactgcctgcaagagtgcatcaagcattggaacttgttgcttgtcatttgagaaagtacctggttcatcgaagtgtcatcccactgtttgacccccatgtaagttgccactattttgaacatttgttatttaatgagcaattgagcataccgacacagtacatttttgtcctcgcaacatttaattctgaggaatgattttcttcaggtgtctattccaatctcacctgtggatatgcccccattccactacagtgaccatcatgagggccttctgcacgaagctagtccaggctattactccctatatgctgaagcttttcaacttgaacacccatggactgatactagttattcaaggtatccaatggaaaactttacacatgctgacatatttgaatacagacaagaagcaccagtattttttgggagatatcggtcagtcacacctccacattatgggcatgaagcagaagcatatttatcatctccaatggaattatgtttgcataacaacctgaatacatatggatggcaagcaactccaccaattggtcgatcagatactgttgaaagaatacgctcccttatatctgtgtatggaaaacaggcacatccacatccgctgaggcagacatatcaatcaactaaaatggaaaaacatccacactcggggatatctttgtacagaagggatgatcatccaacaagggtatctccatcacctgctactgaactacccccatctcctgctgtttctgcatataaatggcaagtatctccatccttaaagatgtatccttcaactaatgtcgaaaaccttcaacactgccgtgtttctgcatgcgctccagaagaactgccaaatgtggttgtgccttcgttaactagtcaatctcctgcagtcacttctcaggtttgtatggtttttatcatagactcttgctgacttgttttaattagtcctgtcaacattatttacttcttgtttgctgacatgtttttattgtctgcgcaacactatttactatcatttttggacggtgggctgcttggcaggttataatgaagatgcaagttccaattttctatgctgaagcggtaattggcccaactggtgcacgaattgattacattcgccaagccagcggatcaagcgtcgtgataaaggatcttgatgacagtgcaatgtctattgagatcactggaagtgctgcaacagatgttcaaattgcagagcagttgataaaggtagcagcagcttttataattttgttgttgttgttgtacttacttctgatgaaatgactagtctaagtaagttcattgcatttctgttgacataactggtctttacttttagacaaggttctatttctgttttatgaaaaacacaacatgactgcaatcctctcttttgtgggtattgcttccatttattgtaggcaaaattggttctagagtagccaatttttcctttattgtaaatatagttcaatatctagttttcaatcttattttacctactggacagctaattaattgtataagattccatgtttccgcaaacagaccacatattgctattcatctaatgctcgctagcccagtccttgtatggaaaatcagggtgctggttgctgtcctggtgtatcaggttctagactcttcgttgatatgcatgaactttgacctgaatagcagctcagtacccttgaaagttcaaccacttgctaccgggactgctttttgctttttggaattgcaccttggtttctgtagttttaccactattgtgctgagagcctgaggctgtaagatgaattccacgcttgtacgtttgccttaaaaatatcaatgttgccctaccactctcctgaccatcgttttcttttccagaacttcatggctgaagctgctgccgcttcccctgatcacagttatgacttcattccatcacatttgccagcaccgagatctccagagccagatattccaactacttcactcactcgcagagcaagctgttttacagaacctcgcctgcaagcgacctactgagttcccaagagttctctttctgcacatagtccctacaccggcaatacaggaaatccgcgagagtacattcccagaaagttttgatatccatcctcagatgattaatatgcgccccctttttgaacccccaagacttgtatctaatattttctttttctttggcttttagccatagactttgatccatgagttagaaattgactctgatccatgagttagaaatagaccttgatccatgggttagaagtctgagattatggtataggacaacaattttttggtggattcagggtaagtgatgtacaagatatgtgccctcagatgtttgagagacagtttgtattacatgacaacatgcattatgttatctacaaactaaaattcacttttaattccttgttaactgctgatgtgtgacctgactgttaaaagctgctgccatgtcaatggatgcttgggtgttgcatagcttgcattgatctatttttgtatgtgtggccatgcttgaatctctcgcctgacattcagacttcagacattacaaggggaaaatgccgggtttagaggagagcaaggcagccattctgttcctcctttctctctcctctcttcgtccctgcgtagagagggagagagagagaaggaaccccttttgcctcctctttcctgccaagaaccacattttcccccaatctttcttcagattttccacacaaatctgtacgccttttcggtctaaagaaaaattcagcatcggtatgttcaatcaccctgttatgtatttcttaaaattccttgaaaaatcattggaacaatctttgtatgaatgtgaaaatgctgtgatgttacatgtaatcaattgcgctgcaagtaatttcttctcaagattattcaggagtttttcccctgttataactggtgaaaattttggatccttgctcatattttcctcctttttttgtctgaacaatcagatattggtgtctttctgcaagaaaggtgggcattggcagcaccaacgctccatccatttaccttctgagcaaacagcttcctgtgaagatcaccttttcttggtgctgcaatctgcattggcaccaaatcaagattcaacatttgctcccatatcatcaaaccaagattcagcagtgtgattttggttgccttgaagctgcattgaggaacctttcatgtgatttttttgatgcacattgatcatccatggctgcgaaaaaccatgcgagatcccaggacttctggaggagattctggtccatgctgtcttatgcttgcagcgagctttgcttgatcatcctgctccatgtggccgcaggagcatcctacctggcgacgaggttggcgcgcatccacaagctcaagatgccatgcatcctgtgcacaaggatggatcatgcccttcatgggaagccatggttctcttcggatttggtctgcgccgcgcataggtcggagatatcatctctggcatactgcagtagccacaacaatcttgcacaatgtgatgattctgcaaaagatgcactgtagcaacgaatgatgtggttgacacaaggagatcgaaatccaggcagctgtgttcttgctgttcggagccattcaccaaggcgcgcaatgcgcataggatttctgagannnnnnnnnnnnnnnnnnnnnnnnnnngggaacaaatccctgcagatcattcaaaagataagggtaagttcacttgtctgaactactgtacttcagattctcttataactgaatcctttttagaggttcaccgagtgaatccattgtgttttttttttgtagcctttgtggtgggtattgaggaggtgaatgaatctgatagttcaccacgaacatatgaacaatccacaaagaacaatggcgcttctggaaatgctgggactgcaaagctagcacccagtggatctactgtgcctatgcgcgttttcgtcgatcgcaacagcagcgtaaagaacggtttcataagtagggccaatctttcatcacctcggccatcacaaataatctctgccaaggacagcaattcaaccactcagcaagaagtgaaggcattcctttcacagatgtctactgtaaggggcattgacagttcttggagtgatggagctcctagccccggaatcaatgcgcaaaccgatgaaagcaatgccaatggcaggaggccatccctcgagaggaactattctgtgatagaaccatcggatgcgaacctcgctgatgaagttgagggagagagctctcctgagaacctgaagcggcttcttgagctcaacaagaagtcgatgagtgctctctacaaagagcttgaggaagaacgtagcgcttcggcgatcgcggctagccaagcaatggccatgatcaataagttgcatgaggaaaaggctgcaatgcagatggaggcactgcaatacctgaggatgatggaagagcaggccgatcatgaccacgaagcgattcagaatcttcacgacttgcttacggagagggagaaagaattacttgacatggatgctgagcttgagaacttcaggaggctagtccagaatgaacaattcaatggcgggaaacatgatatcgctggcataatgaatgaaacagacatgccgtttgaggtcttgaatgacttgggctacacgaagaacaccatgtcgggtttcgaagacgaaatggcgtatattttggaatcgataagcagattggaggataagctctgcgtctccacaaacagacttgcttctgacgatgccaaaattaatcaagagggattgataggaggggctgattttgggagctcaccaacgcatggtgaatcaacttctgatcagcaagatgatggaaacaaatctgttcagaaccataaggataactgttcttgttctcatccagaggatgggaaaacgagtgatgcaaatcttaaggatgaagtctcactgttgcatacgagattgcaggcacttgaagctgatcaggagtttcttaagcatgtgttaaactccctaaggtgtagccctgatggactgcagtgtgtacaggcgatagccagccatttactagagttgagaagaattgcaactcagagataattttcccccctgatttcacaccttctggtcatgaggtaataattattctagctaccatttcatagcagtgagctattattttaaagtttccttaacattttgaaaaaaaaacggaaggattttatcattttatgaggtagtaattgatttaccaaaaacatgtaacctgataaaacagaagcctatataaagaagattctagaaatatatccatggtaggagctaccaaggaaatgcacattcataattgatgcaaaattaatgcaagtgttttcatacactgataagtgacactaataattctggcccatctgtatgtcaaaagatggatctggattaggttctttctgctccattgctgaataccatcaggttttagctatgtttgcgttattctcagtacattaatccctcttgtcatttctttgatattcaatttctttatataatttaattataggattgcaaatgttgtccatgaatgctctgcttaaccataaatcattgacaactttggcctaaccttttcttgcagctcttctcatgtagtgctacagaccttcatggtgcttcttgttagagcagcattgaagaggtctagaaatcgatgtcggtgaaagatcatctgaaatgaggaaaaggagcatgcactgacaaaaaaaacttccattccttgtactaatcttcaagttttcattgaccaggctggccccctgttgctgtaattctgtcactgcttcagtaaattactgaaacagacaaaggcatctcctctatatcgatgtgattgctgttaggagcaagtttgtaactgtagatgtaactgatgcttgcggttcttgcaaaagaggagtttaactagtagaatatatacagtgttcatatcaaattaatcaatgtctccttgcttcagaaatgcaaggttttctgcctcatccaattaattttctccatacgtttaaatttctttttccattcctgctgattgtgtgatgcctgatgagagaattgcaaatgggattttcttgtgctattttcccaggcatatatgagtggccggttatttccacaggaattcgtcatccgccactagcaaactactattttagattgaacctagtccacttgagcttttattcctttctgtattgttgcccaaaagtcaagatccaaatctgaatttcacggcttgaagtaattacgtccttatcttgcatattgttgcagaccatttagtctcaactcccgagcttttggactgcatatctcagaaatttcaacaattactccctccgttcctatttactactccctgacgccgttgacttttcgatcaacgtttgactgtttgttttattcaaaagttttatgtaaatatgaaaatatttatgtccagcttaaagaatatttgatgacgaatcaagtcacaacgaaataaatgatagttacataaattttttaaataagacgaatggtcaaacgttggataaaaagtcaacggcgtcatacattaaaatatggagatagtactagtcactgttgaccaatatcgttgcaactttgataattaacaagttttttttttgttgaacgaaaattgtggtatggtcatgtttagcatgcaacatgcttggataatatcttatgttttcatatatatacaaatgtgttgcaaaaataagaatggccaaagtttacatatgaccaatgttgatgataattatatgggcatggagagagtaggatactgtataaagtagtaggaaaaaaaacatctccaaatattttctttccagcactgtatccatcctccattttattatcttctcttatttcaacgctgtttccttctctttgtttttttttttttgcggggatgttatgtttatttaattgttccatagagttgactgaaattgcatttttgaagtacaatttgcatcacatctgattaagtgattatctgtcctcttcgtcatatataactctcttgacgaactgaatccaactaatttcacattaaaaattagtatccacttgccaatactgtatttccaggaaaaaaaacaaaagccaataattagaacattttttcaataataataagaaaactagtcaaattcgtactaaaacgtgaacaacctgtattcccgcacacgagctgactttgcatttatttagatttaaaattgcaagcttgcctattttgtcccaaatgcatgctggccttgagtttaaaataaccatcacaaaaatgccacttcatgtaacacatggttgatttctttatccacactatgagatttgctacagtccaacaaaaagtacctcaaggtcccgatacatcacgctgatccaacgatcggaaacggacaatttggtaccatgaagtaccggtaccttgagatactttttattagattggagcaaatctcccacactattactcttaacctcatgtttgcataggaatatagtcttctagcttttgcttgtttaagagtattccatttccaaaattgtgtggtctggcctttctcttctctctcaagacagcgttttggccaattcaggatgtgatatgacatgagctaatcggagtgccttccttcttcttgtgccactctgaaagtctgaatcttctcccatgtataagttggtatagactgataagatatatacaagcagctttgctttccaagaaagccatgaaagggtggtgctagtgagccagtaatagcattaccgtacttccacatgtcgccggcgagaggtggcacgccggaggaggagggcggtggcgccgacgtcgagaaggcggcggcggagacgggaggtagaggcacgtggaggcacgcggcgttccacgtggcgacgacgatcgccacgccggcggcctatgctcccctcccgtttgctcttgcctcccttggctggcctcttggttggtgcttctttactcatcctgtttcatcctctccatggattctctgatatttgagcttctcctgctctgttgcctgaaatgccatgaacagaaagtttctcagttcatatgcatgcatgattttttcttctgtttgatttgagtaatttgtaattagctaactgttgtttgagcacaggtgtttgtagcttggtcacaggaacactagttacatggtgttctagcctggttgttgcctcactgtggcagtggaatggagacaagcacaccagctacaagcttcttgcaaagagcatctttggttagtactcatcaccattttttttgtcacgacaaaattgtacttttgatcttactgtactgtgtcacaagaagatttctgagtagcagcctagcaggaaaagagttgccaaacgatagtaaatgggattacagattcttcaccataaatatttacttttgatgatctacttgtaacagtaatatacttagcagtgcagaaattgttgcaaatttacctcaagtgatggtaaaaatctgtgcttttgtctgaaggtccctggggttactggtatgtgtcgttcttccagcaagtggcatcaattggaaacaacattgcaatccagattgcagctgggagcagcctcaaggctgtgtacaagcactaccacaccactgatgatggcgccatgaccctgcaacagttcatcattctcttcggcgcattcgagctgttactctcccagcttcctgacatccactcactccggtgggtcaatgctgcctgcaccgctagcaccattggatttgcagggacagccattggtgtcaccatttatgatggtaaaatctggtcatatcttcacttttcagactgaagatttctggaaattgaagatgtggaagaatgaacagaatgaatttcctaatgcagggcatcggattgatcggaaggaagttgattacagtctgcaaggaagcgctgcatcaaagatcttcagagccttcaatgcactgggcacaatagcattctcatttggggatgcaatgctgccagaaattcaggtgaatatctgatattatgctgagattcatgctgtcagtgtccactcaactccaaaacttcactgaaattcagagctctgtgcgagaaccggtgaggatgaacatgtacaaaggcgtgtcgacggcgtactcgatcatcgtcatgtcctactggaccctggcattcagtgggtactgggcatttggctcaggagtacagccctacatcctgtcctccctgacttttccaagatggacaattgtgatggcaaatctatttgcagtcattcagatcactggttgctttcaggtaacacaccagtaacctcttttttttttcacaattttcactctgacagactatccagtaactgtaaatcttcaccaagatatactgcaggccgacattcgcgcaatttgaacagcggattcaggcgaaagacgcaggctacagagcaaggatgtggaggctggtgtatacctctgcatacatggtggtgatcaccctcatctctgcagcaatgccattctttggggactttgtgtcagtctgtggagctgttggctttacccctctggactttgtgctacctgcactggcatttctgaaggccgggaagttacctgaaaacccaggattacgccatgctgtgaaggtgatcacctctgctgtcgctgtcttgttctccattgtcggagctctggcatgcatcggcgccgtcagagcgatcgcacttgatgtcaaaacctacaaattcttccatgacatgtgaatgcagttagttagtatcatgttggtgatgaaatgaatgtctctgccatctgtgccagtggtttatacctggtgatctgacatgtgctaagtattaagtatatttatgatttggaatagcggcaacagttgagggaaaatcaaaatttctcagatttcacggttttaacgctcttaagataaacattttaacactgtaagaaaacaaaatagatgctatagacggattacatcttaaacaagagaacttaactattcaggagatcaaattcttaggcctgattctctcagtgatttagtatactagtgccatcgaagttcataatttgaagagagaatgcaagtgctgcccataataacagtcaaaattgacctatacaaaccatgacagctacataaattccatatagagttgccgaactacggaggttacaaggggtaaaagaaacttaaaaaggctaaccaccacttggcagcagtcttttcaagggagcactaacttattttctgatgcaacatggctaagctcagctaaaatccttcagccttctcttcaacacatccaaggacttctttcgagcactttgcactgtacttcggcctgaaaggctcccaaataagctttccggagcatctctaaacttgtcacagatgatagacaccttcttatgatccaaggatccaaaattcttctccctgattacagggttcatgaagttctctggctggttgctgagcagaagatcggtgagctgcctaatttcgaccaggcaatctctgaaagttgtttcttttctcagctctgacaacccagtgctgtggaatttatcatctgcaaattcctctaactttttcaggtcaatgtcaatacctgcggcagcattagcattgaaccttttcacccgatcactaagaaaaactgtcattatcgagtccgagatgtggctgaatgccccacaaaccaccttgtacagggcttcccttggaaaaacattctgtgcagttgacactaacgtgtgaagatagatgacgacctcattcatgtagtcattcacatgttctggagtttcctctggtgtccaattgatgctagtcaaaagcaacataaattcgtcaatcttggaattggccaaggctattaacccattgtacgctgcattttgagaggctttgagcacagctctagcagtcaaaccggaatgaggcttgtcaagaagacgcctaggaacaccacaaagttgggcagcatgaaagaggaacatgtcacaggacttctcaagaatggcaatatttcctgcaatctgcaccatttgtgtaatctccaaacaaccaccatgtatcaaattcagaaggccatcatttagtacctcaatcaagagcttgtctaggtatcttttcaccacatcataggcgtccatcataggatcatatgacaagtagttcacagaatcatcaataaaagagcgcacgataaggcaagcatctggaactgaagaggaaaatggtgcaacatatggaaaatccggaactacaccaatgggttcaagttgaaatgctgaaacattcatgtggtactcattttccttcttaatgatcatctgctcatatgagtccttagtgaagatgccatctatctttttccggcaatcagaaagaagaagttgatagaatttgtccctattcttctcaagaatttcaagcaatgatgtggtttggtatccatacttcttcatggttgcacccagaagagtgacatagtcttttacgagtaggaggtggttggcagcatccatgcgagagaactgttcctctaagatagatgtgaccttagaaatagctgtcccccacattgtctcaacctgactatcagaaagaagcccatctgcagttcgaaggacacggtcctcaacaataaagaacccagctatctgagcaaggaagtgctgatgagactccatgaacggttgtgtcgtgggaatttgcaggtccaaattaagttgcataagcctgttattgtagtagtattctcggaatttttccccaagaccaaggcatgtgtgaatgtagtttgctcggtatactggtgtaagatcgaattccagtacttcctcctcacctatgagatccaaatccaaggcataagcatgctcgtcaaacccaatacggctgcagtcctctgcttccctctgttgggaatgtattccctcatttttctgacgagccaaggatgcctggcttatcgaaaccttaccaatttcctttgctgtccttctgatatacaccagccactcattaaactcattgcaaactttcttctcaatgtacagcttgacaattggtatttgcttctgaacagccttttttagaagctttagaggaatattttgcagaaaatccttctcaatcaactccaaacttttcaaagcagaatgaagcctggcttctgcaatgtccttgttgcacatctggcacagactggtgacttgcaaacagatcttcaacatccctagggcttcctcaacattcttattcactgaatacaactcaagaagctcatcaagcttcaacagcagggagctagcaacctcttgcaggcgcaggttttcgccggacagcatacccttaagctcatcggcgtcaaccaacacgccgcggagctcatcgactgcaaggatgaactcctcgtagtggaccctacagagctcctcaatctcaacctccttcattttcacgatgctcctgaggccttgcaggagggactcgggcttcccggactcgaacgcgtggcggacgatagggcccagatcctcgccgttggcgatgaaggcagcaaggcccaagccagcgccaccgttcccgctctccccgccacccctcttcttggtctgagcagtcattgttcaactgcaaaacacacacacacaaaaaaaaaaatggcatgctgcacacagtaagacatgcgtccaccttaagaaatcgggtaccccctaaatttagagtgctacaaatgattagcatatgaagaacgcagtaataattagtgaaaattaattagcaagccaagaaattagcacaagcgttgaagtgtaaaccaccaaatttgttaaaataaaccgacctaacgtggggcgtgggggttcagcattttttcaaaaaaaaaactactattatactaagaaatacggaagaaactgaatgggttaattggaggcaaagtagtcaatccaggtcgggatggatttccaaatccacgccacgacggctcatgaagcggcggggagggaggaagggagagagtgctacgggagaagaacgagtaccttgggggttcgattcgagccggggatggaggcgagtggaatgaggccggccgcgtcgcgtctccggaccttgctgcgccggccgtgcgcgcgaggaggccgcgcaggggtgggggagaaggggaggaggaggaggccgcacacgccgtgtgcctcggggcagctcgccggcggcgcgcggcggggagggggaggaggcgaggcggggcttgcgggggagaatgccggcggtgcctctgcctccgccggcggagagagagagagaagagagagggatggagagtggagtggaggcgagtgatgagtgatgggaggagagagaagaaggggcaggggagtcatttctccatttcccctcaatttttcttaaactaaaattccaaagaacgatttttctccgaactaaaattcaaacttcctctatcccttcaatacaagagattttagctatgcaccgtctttcttttggcttatgagccgtagacaaaatttaaaattttaaaagtgattttagagttaatttagagatttattttttcgtagtttttttcgtgtgcttttaaattaaaggaaaaaatatgaatggcctcctgaactatagtggtcgattgaattacacccctaaaccacaaaccagacattcttcacctcccaactatataaatcggacaaataacccccggttcaattcgcggtggttttgatcctctcgcacgccacgtaggatcaaaactaccgcgcacgtaggattaaaaccaccatggattgagccgggggggttatttgtccagtttgcatagttatagatgaagaatgtctagttttgtgatttaagggtataattcgatcgaccgtgatagtttagggatagtaaggatataaatataaaagctcactcattaatctttttcctaattagctgtagtccaatggattaaagtgaatttgaaacataggaattttcgctagaaccggttcggctgttggaggagccgtgagcgatttcctcgttattatgctcctaggttttgacgactttgttgttgttgtcgccacgccacatgttgacgccagatcgacccagaatgaaacggaaacaccgaggtgacgatcccatcccaacgagtgtgcgtacgtatctgccgttggaagcatcgtgcagcaaggtgtcgtgttcaggtcacaaagaaaatcatggagaaatatcaatgcacgaacaaaagcgtcactttttaatcagcttaacaaggcaccttctaagcacctttgctgaccaggtcaccagaataagtccaacttcaaaccgcaccttgttttaggcctatttaagcttgttggtagctaagcttctaagaataaaaaaaactaggttttttagcttgtgacttctagtttatttcctagattctacaactatggcttcttaaaatctaaatcaaaagctagattgtttgaatgagtttctgattttgaaagaagctgcagcaaacatacccttactaatacatccttgaatgcaagctgttgcgaccaggagatcacaaagcagtaaagtagcatcaaaagcaggaacaaaaagcttagtgtgtaggaccacaccacgaatgaatgggttacaacttgcagtcacgatttacattcagaacggcacagtgatattatataatatacctctggatatctggaactggaagcaaaatagatggatgcttgatccacggatcacatgtacataaaccagtcaatagttcaggagaaggtactcaagaaatttgttgtttaatcaaaaaatttcatgcggcaatactatcaacatcctgaagcatttctttcttttttttgaccgggacctgaagcatttctttcagtaacatgttaggccaaaaaaataaaaggaacttgagctggtttctataataatgaacttataaaccatgcaatatacgagatagctagccatttgctgtaactcatctccgttcttcactggctgcaatcgtgggttggatttctctggtactgctcgaaataccgatatctgtctgttgtttccgcggttagaaatcgactggtcagactgcaacacaaactacatcatagttaggtagctcatggcaatagaactcaaactaaattctcagataattttggtggaaatttagaaagatttattttagtggtcctttgtaatgtttcagaagatgatgattgtggaccacaaacatctcaaaagaaaatcgcaaatatcaaaagatatgtctggacagttttgccatttgtctccaggatgtataatccaattcatgacttgtttaggtgctcatacaatgaccaaccgaaaataatcattctagttgcacaactgccaaagatgttaatgaagcagatggtgcaataaacagaaaaaaatcatcgtcaatttagcgattgtttcacaaaatttatcatccaaatttcaaaaagaaaaaacccttactccaaatgattacctcatttatgcagggcaggtgtatctacttctgacttgtggcctcatctttcattttggcctgaagttgaaaaggcaagaataaacataaggaaacaaactttatgaaccaggcagttctacagatgagcctatactttcagtatttctgtacactatgtaatatttatatcaaggagtatgtaactgtaaattatgggttcatcaaacctcatccacagcatctctccggaccttcctagtcgggcttctcattgtgacaagttcttctgcagtggttgggtggacacctatggtggcatcaaagttttgcttcatcaacccagcctttacagcaattgcaataccctgtcatagtaatgtacaccacaaatatattaggcaaacatgaacaaaatgatggctaaatattaaataaagaactcacaaacctgaataatctcgggtgcatcttcaccacacacgtgcactcctagaactttgttagtattagcacacacgataaccttcatgtatacacgatcaggtagaccagaaagagtggccctgagaggtctgaagtttgatgtgtagacatcaacatctccatacttttcgatcgcctacagaagtgtatagtttacttaaatttctcgtgtgtttttgcaagttaacaagtttgtaagtttacaataccttctcttcagtgagtccaacttgtccaattggaggttgggaaaacaccgcagatggcacagcactgtaaaaatgcatatcaaagagtttaatacaacagttatgccaaattacagtgtacatgattctactattgaattataatgttaaatagagaacttgacaaaaaaaaatcagatttgttagtcattttgaattgtgaagaaagaaagggatggggcagcggatgtgtttgaacttatgcactactgccacaagagataattaatgcataatgtgcacaaaatgacaactgtttacaaggtacacaatttagcatttcttgaattcttgttaatgctcaccaagaacaatcagtttgtatacacaaataagggaacatgaagcatcaaaatcgcaaggttcaagatcaatacaaatttatatggatgttatatatatatgtatatacacactaaaaatacatatacatgcatacctgtaatctggttttgtaggttcattgccaaaaatagtccttgctaatgccccaccttccattaatgcaaccggtgtcaagttcaccctgttagtaacatcacccacagcccatatagaatcaactgaggttcgagagaactcatcaacctaggataacatatatagaccaagaatttcagttatcacttaatgatcatctaataattgagaaaatgttagattatgtataatgtatagaatcataatgtatagaatctatgtagaatacacagaaccttgtttaaatacacataccacaatagcaccatgcttgtccattttgaccccaacctcttctagacccaaattctacaaaggtatggattgtatgaagatgtgtatccagaaaataaatgtatgcccccaaaacaaacttggttgagaaaagtggaaatgactggcataatattaacctttgtatttggttttcgtcctgttgcaaacattacatgtgagaacccatttatgcttcctttgtttgtcgtcagagtcagcaagccatcgtctgatttcattactgcttgaggagtctcttcggtatgaaatgtgatacccctcaaagacatctgatcggcaacaaaatccctgacctacaaatccacatggaatgagaaaataactcaaggcatgacgcattgacacacttcagttcaaaaacgaaattattgttctaatggatacttgctcacctcctcatcaaagcctctcagtactttcttctgtcggatgaaaacatgaacaccactttttaagccattgaaaatgccagcaaactccaaagcaatataccctcctcctactatcgcaatcttctcaggtcttgaaggcaggtccaatgctgcatctgaatcaataacatgctctatccctggaatgtctggcatggatggccgaccaccaactgcaatgagtatgttttttgcagtataaagctttccatcaacactgacagtatgtggatcaacaacctgcataatatgaacaggtagtatatcaacactgtcattgctgcattgatcctttcaacaaaactgtatatgcaaacttaacccaatttacaaatttgtcccaacctttccacggccttcaattatagtgaccccagaattctttagcatgtttgtctgaacccccaccaagcgctgcaactctaaattcttgttggtcatcagagtgctccagtcatgctttggctcagtgccatacctccacccaaagccatgactctcttcaaactcatgagagtatttggatgcatacaccagcagtttctttgggacacagccacgaagcacacatctgaagtatggaaaaactgaacatcttacttgcacatttttgcaattggatatgaaatggaagaaagatgctatccgcacattatagatactaagcatttcactctgcagacgctataagcaaattacagatatagaaggaagctggaaacgcgtaaggctaactggttgataacaaccagccatcgtgacagagctctctaacttttttgttacttgcgtatatggagagccattcatgtaagtatgtaaccctaatagtaaatctcatatcatcatctctacacatatattgaacaacattatagtgaataccacaaaagcctctgaaattaagcatgagctccaggaatggtgaataagaatctgttcttatagtcatagagtagactcctagtggtcgttgatcataacagagcactggatcgtgcgtgaaattgttcaatcctctcctcactactaaatcataatcctaaacaaacaatcagaagcaaaccatgcacaccatccgaattccaaacaaacattaccactgaacaatgtgtgcgacttgaactaggaagaagggtggcgaagttcactcacgttccgccgacgccgccgaggctgtcggacgcgacggtggcgaagggcatctcgcagacggcggcgcgggcgccgtagagggaggcggcgacgcgcgacgcccgcatcccgccgctcccggcgccgatggtgaagaggtcgtagtcgtagtcgcacccacccccatcgccgcccgcagcggccccgttatccccggcggaggcggaggcggagaacgggcggcgcgggccgaggcggaggagcgggccccggccccgggtggcggcagccgcaaccgcgagggggtggcggcggaggtggaggaagcccccgccgccgcggcgggggaaggagaggacgcgggatatggtctggaccgcggcggcggcggaggaggaggaggaggggagggtcgccgccgtcgccatggctgctgctccgaggcttccgcggcggcgcgggggcgcgtgacgagacgagacgagacgaggcggaaatcaaatgcgttgcttcgaggcggggcgcgtggtgtggccgtgtgtggggctagccaggagacaaaaggcgaggctttgttgcttcggtgaggcatgacgtggcatcggcgggtataggtcataggtggcgctggcgcatagccgcggagccgcctgagccttgggccctcgaggtgccataagatacgctttgtaagttttaaagcgtatttttgtaactccctccgtaccaaattagatgtcattttgactctgtaaattaggtgtcgttttaactttttgctttcaattttcgatcattcgttttatttaaaaaattagtgtaaatataaagaaagtcatacttaaaatattattgataataaagtaagtcacaaataaaataaataataattatataatcttctaaacaagataattggtaataaaaactcaaaaataagtattttgggacggcggtaatgggccggatggcctgcaaacgtctactgtgtaccatcattagcttagtttagctttgtgctaggtgtgtactatgtagcctagaacggcccattcctaatagacgtggacagatggggtatcatcatttggtgacccatttcagtactccaacatgcgggaagagagggataggtggaaccgtggatgttcacttaggccattcacggtgcataactgtatacatgtaccattcaatcctaacattccacgtcatggattccataccacatctgctactcccgtaacaaagtgaagtccggagagccaaagttagccacgagttcctcgtcagatttgttagagtgttggggagggaggggaatagcttgggctatgcatccgggggaggaaccgggggaaagaggggagacaggagtggcaccgtcgtggggctcgtcgccgcccccggctccgcaggtcgccggcactaccgttgttccccgctcttccccgatgccaccatcaccaccacaggggaaagaggggagagaggagcagcgctagagaggggagaggccaccgacggagagagaggtagcgccgccacagctgcccgctaccctccagctccactcgactcgacgcctgagatggctgccgcgcttttcctcgtccttactcgatccaccgccaccagagaggagagggtaaggcaaggggggagggaagaagccgccgccggagatgggagaagccggcatggcgagaggagaggggcagcctcaaccgaggaggggtggatctagtcgcccctctctggcaccgtcgcgccgccaacgccgccgctgcttcgggggaggagaggaagggtggatctagccgccccgccgccgttgtcgccctagtgccggtgccgccccagtgccacctcgcccgccgttttctgcgcgatggggaaaggaggaagctgtgcaatggggaaaggaggaaaggagagagaaagggagataaaaagtgaaaaaaagatactagtggaacccactataggtaacttgcattgtaaagtagtatgtggctaatgcggttcttcatctaggtggcatgtgaagttcgccaaaatcacagggcgcactgctactgcccttactaggatgccacatgtggaccccacatgttttgttttactaggatgtcacgtcagtcaagacaaccatctatactaccataggatcttatttaacctggttgtaaaagatgaaggtttaatattttcagtattacgatttgaggatgtaattcaaactcgatgtcaatataagatgtaaagtgaacttattcctctatgcttggccttaaccccacccaaagaagaaagactgttacccaatttgaatttcttggtgcaaccaaggacatcatttttttttcaattttggtatatatatgttgacaaatattctggagaaaatttgtcaaattttgggacatcaatttttttcgattttgctatatatatgttgacaaatattctagagaaaaattgtcaaattttgagacattagatttactctaagattcgggtaagatggggaaggaaaaaaatcagagtgcacgcagttgagggaccacttcatgcgagcaacatgctaccccttgctaatgtttttttttttttaaaaaagaaacagttacatacacgttacttctttttgttaaaaaaaaagctcaacctaagatatgatatgacatattctatgacaagtaatctagacacactcctatctggacaatctagattggtttttttagatggagggagtatgtagtttacatgtaatttattataatataataatacaattatgttatgattatattgtatttgtgaaatttttatcgatagatatatagtttcatatgtaaacaggataaaaatgatcacggaaattaatatggataccgagcagtttaaataatagatatgatcaattacagatagatcaagctttgtttctagagatgctatcgattacaaccgttttcacccccagtaaaccttactacgttttctactgctaaaattgatccacacgcaagggcagtaggatctaaaccaacatcatcactatacttctaacggatttaagtgcttctccagctaaggacatcatctgatggagcaaccatgccaaactcaccgtgacaaccgacgaggcaccagtcacaactcacaaggtagtatatcatgcaaagcaacagagcaatctgccggtgaaacggcatacaagaaacacgtaggagtccacatatcctgtcaggtgtcaggttacaaaaattccagtgccgtccttttcgccagtggcagagcaagtgaatcagatcttattactactagagcagtgcaggtgacagtatggatggacctttgcagcaaagacaagcagaacagacgcaggcaggaggccgagattgagacgagatccatggcaaaagtgagaaacccaactagtgggaaacaagatgcattgtgtagtacagtggtacttagcctgtaaggctgtaacaactccatggggcaaccctgtggaatatgaaaataatagagactgtaactaccccatgtctccattgtgcaaccctgagtcaaatattactctaaaatataggcaaaataatgcctggaatggatggaacaacacaatggtgccaaatgatgttaggaagggataaataataaggccactttatccagcaattccagtttataaacagcactatggccaccgaaagaggctatagtgcccccatctcaagggcaatatcaaaaattggcaggcacgaggtgtcacatggggatcagatcagcaaatcaattagcacttcaagtacagttcattcggcaaatactgcaaccttgcaatcacaatgcaatgcaccatccaaaacaaaaggcacagcaaaaccaagccggttaatggaggcgaaaataggatggtcctatgaggtgagaaactatatgctaaatatatatagttaggtatcaccagtgctatcccatgaaggaaaaaaacaccgatgagttcaaccgcgtttggcaggagaacggtttgcaggagtggtcgatgggcacgtgcagaacaaggaacccctcttacgagggtttaccgagctggggcttgggttgggagggcatagatgggcaattcatggtggtgaggcctgggaggctcgcagtgtagttaaggatccaccacatctttgcaacaagagggcctctagtttccctttcact

SEQ ID NO: 39496 - DNA, 4171 bp, Oryza sativa
aatgcaaataaccaaatgcactaaaacaactaataacatgtgcaagtgccagccaagtttgacagtacagagaattcctggctactgttgcaatgctctacaatgtctatatatatggcatcaacctcaggctaagtactggggagaaaggtacagccctgctccttctcttttacctttgcctcaacaagctcatcacatgttatcaaaatgttgatatacaagtaccgatctaaggttgtaccatagaagatcagcacgctgtcaatcaggttagtgtatcaaatgcaattgcatattgttgctcacattgcaatggtaagattcatgtatatcatggatccttgctttagatcaatacagattatctgctatttttagttatttccgtgatatcaaaaattgaacaatgttgtctgatcatccgattaatcgtgattaatcatcctgatcgctcccctacctccgatcaggcacaggtaagtcgatcagccgatcagaaagctgatcgtccgattaatcgacgattagtcacgattaatcgtcttatcagggtggaaaacgatcagttcatgggctgcctccctgagaaaaatataattttgggcctgccagcccagcccatgttccattttgggcagatgatgggcagcaaatgatgcttcttcttctttgaccaaatgatgcttgctttttaccgtatactacagactatagagtatttagtacataatatatagcatatatggcctgctgaacactcctatatactaaccgatcagcctcgattaatcgccctgattgtcctgattggtgcctaggcgatagggctgatcgcccaatgagagaacattgaaattgaacaatggaagtggaaatgcaatgcaaggaaaaagatcaccccaggcacggcggtaataactgctcaagagcacatataaattaacaatgaatctactatattagtataaccacaatagttgcatgaaccaatcataaaacaaaatcatgatcagccattgcatccgttctttttgttgtaatagtgatatggctctagtaggaagattggactttaagggttatgtaagatctccaacacatatcaatttatatcagttttagctgtttgcattcttaacagatattggagcttgaagctggaggtcaagatcagacgaaaaacaagggggcaactaatggaggcatgtagattaataaaccctacatttacgtaggatgcatacaattaataaaaattctcagatcatctgcacacaaaattggagtaaatcaaattggtctattgattgtttctatcttttatgttagtgggactagtaaacatatgaaaggaacttaaacacgaaatgtgacagtcaaatctcaaaatgttgactatcatgagtgcactcgattgctttgttagagcttacaattacactgttaagttctgcagtacttctgcagtaaatgagtaaatgtcttggcatttggtaatagaagaacattgacttactaactttatcgtgtctagcatgaaataaccttgaaaatgagcaggcaataagcatactattgcttgtagttgataaagaagtcataaacttatgcataggctaatgccatctattttgcaaagaaataacacagttgcttgctataaagaagttataaacttgtgcctagaatagaacatgtgtagacagattatcatacgaagttctggaaaaggtttactaacttatgattaaagattccgtaaacagatagagctaagatggcgcagaatcttctttcaggaaattggtcaaagcattaacatgagtatacaccatcagtacatgagagaagtgaactgtactactccctccgttccaaaatataaggatttctaggattcaaatcttgtaccacaatacaaggatccctgcactaattcccatcatttcaatgattccaaagcattgccaatcacatgcttggaaagggaatctaagcaattcaaaattcaaaaattgacaactgaaatgactaaaaaggtttcttttgacctaatcttagcatttgccaacccagaaacccttacattttggaacggagggagtaaaattttgatctgacatctttattttcagaagcttatattggtttgcattgcggaatacctatactcatatcagaattaagaatacacatgatagtaatatagtatgcccagtaacatttgagaggcaaaaatcatgaaattaatgccaactgagtgactgaccaagcaagtcctagaattgaagtaaaagctggcctgaccagcaagatggacataagaaatgcaagggaatcacttcaagcttcacctactcatgatgtcctccaaacaaggcagggaggcatcattcctcaaccatttatgcattggaatcctattcagctttacctgctgaaattaacaactagcagcatctgcaatcatggttgctaaatgctagtaggaaaatcatccaaatgtaaagggcaactaagctcactgctagacataaacaggaagcagctttcgtcctgtgaattgccttttcaccagaagaaagaagaaagttgtttctattatccagatagatactcaaaatatcctaattcctaaatttaccataagtattagtgagctgtctgtttcaatagcaagaacactgaacttcagagatagctgccttatttagcatatgttctgccctttttcattcttacgatcagattcaagattattaaattaaaatcagaggtctgcaatgtattttgtagctttaggcttttttggaacttacctgagctgtcagaattacaaacataacactataaaatggaacaaccaaagaaaagaaacatgcatgctaaaacatcatgaaactccactacccaactccaatgtgaaatgtaaaaatgctactatatgcctatatcctaacaattcacagataccactagctaaaacatattttccagaggtggtttgttatgaatacctttgctggtccaagagcagcgatggattcctcccatgacactatatttgatatacatgtggcaaacatagctagaaactgcaaaagtgaatggaaaactctgtaaattatgataagatgtagagaaccgaactcaaaataaattatcttctagcttctgagagaaaaaccaatgttcagagattctgtctgaaagtgaggatagaaacatgaactcactaacaaagatactacggaaaaggatggccaggaaagctaagtgcaagcaatcatactgagttgataataggaatctgatatcaaacaatatctgatacacgagacactacacaaggtactgccactatacacataacttccatgaccatgcagaggtcaagtctcccaaggatctgaaaccaatccttatataggaagacaaccaggcttcatgatctactagtagcttgtacagccccaccactatgaaacaatgacgcaaccgatcttgctagtggagttggttgtcgtatgcatttaatttggacctatacaaagaaatggatcttgcattgcttaacaattaaacaccctgtttttaagtaaaaattactaccaaatggagttagagtgaacttgtcagtcatgatgactaatgcaagactacgatgacgaagaactccgatgagaacacatgcaggtcaatacaaagcaggtgaaagttgttgaggcggtaggtgtgtgttgatcaaatcatatggtaattgaaactgacataatttgcaatttggagcatgttttcaattgttagcatataggagtagaacaactcaaagcaaagaaactataatgaataaaaaaaactaatgatttgatgccatgacataagctgcaacaagcgtagctgtctagcacacactctctgcaaaatatactaactaacaactattgatgaaagagatttgtgtttgaacatctgtatagtattgtgggattcaagacatattacatatgttagttttttttacatgatgatagagatattgtagagatttttttttgtgagcatttgaaatttgaacacagatcaaagaaacaatccaaaatgagtgcacagcttatgtggtctagagaaattagttagaagtgcaatgtgtaaacaaaatttaatg

SEQ ID NO: 39497 - DNA, 5979 bp, Oryza sativa
aaaggtccaatatatttaatttttcccaatctttcatggaccccaatatcacaactaaagttgattcatttacctaatccccaaagctgggtgacaaatgaaaatcagtgttgatgtgcttttgaataaagcaacacttttatataagaaatttctggataattatgaaatggcaagcatttggtagccatattttcgatgacatgttaggcttttagagagtaaacatattcaagaacaaattcatatttcagtaacacgacctttacaaagtaaatacaagttgatcatttccaggtaataagaccccttgcaaacttgctcatgatcctgatagaagtttcatacagtggttgttttgtaagctatggatttgtgtcaaaatagggggggaaatatagggaatacatccataaattacacttcaataggcatatgtaccgtttatctggctatcctaaaccagatctgttactaaggtgtaacacattttccccaatttgtcatcccaaccaaccacaaatcctgaacgcagactcattgcactgtaacaaggtcctaaaacaaaatctcattgataatgtgaaccacacatgacaaaactccttaattagcaccggaaggcccaagggtttgcttaatccatattgatccatgggctattgctagagaacaaacattgctaccgaagaacgcatcaaaagcacaatcaagaatagacgccatcaacccatttgctatgactcatgagagcaaccacggcccagcctgagtcatccaccacaccacagcaacaattgggtgtgtttggttgcttgcattttcctagcctggctcatctctttcatcctggttgagtctagcccagatgaagagatacacatgcaactgttttggttgtttgcatcggtttagcccggctgagatgagattttgtttggttgagtgcatgagagatgcggtttggaaaatattttgtttggttggttggatagatttgagtctggttacctcttcatttaattgggtgaggttacctctataatatcccatacaaaaatttcaaatctagacaataggtataaacaatttttcacatacaaagaataatattggtattaaaaatcagccagcattctttgcaccaaagcgaaatttgttgagttctcaaaaaaaaaaagtcaccaaaatttccccaccatttgactgcaaagcgctggaaaaaaaaagaaaagaaagatagaagcgtttgtcctcctcattgtcgtcgaggagaggagttcttgcctcatcgctgccagccgttcccggctcctctgccgccggccggccagtaccacgctcctccgtcgctggcctctcatacggatctgccacgcgcgctcctccgctcttctctcaattgaaaatagaaaagagaaaacaaaaaaaaatcccctcaatctcatcgttgacttgcttcaccggcgctcccagctgctcctagctgctcaacgccaccatggtcgccggatctggtggcctggcggtcggagaaggcgattgtggcgacagaaaagagaggcggcgccggcaatggcgaggaagccggcgatggagatggcaagggatgtaatagcggctgcagcttctccaccggggtcggccgagggagctcgaggtcggccgccagtccaccatcggagaagacgccgaacgagtggtggtgaccgtaggggatttggtggaggcggcggcggcaagggagagagggaagaggagagcagttgagaatgggaagatgaaaatgagagggaggaggtgagcggacgccagacccctgccacgcgcgtgcacccactgatgcaacgcttgcatccaccttgcatcgagtgagccaggctgaggagcgaagaaagccatccggccttccattcaacccagacgccatagggccaatgcatccagcaaaacgttgcctcgatccccagaaactaggccccaagacggaggaacaccccccaacatacatacatacatcgaaattcctaaatccatctctcctaaactttatagccacaccttccgagcaggcggggaggggaaacctagccccaccacgcccctcggcttgcggtatacggggggaggaagagagagaggcgcgcgcgagggaggggaaggggaagggaaaccgtgggtgcgcgggctctgctgctccgggtttcccgcgcgaaatcggcggcgcgagtttactcttttgcccctgactcactacccccaacccgaaacgggacgaaacggacactgctctcctcactcaccttggggggcgcggacggcggagagcggcgcctcctcctccgatccgtcgccggcggagtgagaggcggcgggattggagattttggcgaggagaggcgatttgtggggagaagcgggggtggcgactggcgaggtgatgacgggggcagtgtcgcagtgaggagcagaagcaagcaatgtaggttagtcagctcgacgtgccacgtggggtctcctattcgttaagaggagtatactagtaccgatttgcaatacgctagaaaattacctatattatacaatactacctccgtcccaaaatgtaacaacttttgctatgaatatggatatatagttgttcaaattcatagctaaaaatgcttatattttaagacagagagagtatatattaaggatggaaaacgaaaccgctttgccatatttggtttttattttctactaatatttttttataggattagtttcagaaaagaagcacaggatagagtggaggacgactcgtattctaaagcgagattgctaatatgcactcagacgtgtgatgacaaaggcgtgcgtcgtgtgtggctgatgccacgtggtgtgcaggagaggccaagggtgaggacacgtcatagcttttttatatatgtacgtatttttatccgttaaaagtgtatgtgtatacatatgtataaattttatatacgtgtatacaaagtttttattacttatataggataagtagtagactagagggggtgtgcatcgctagggggaggcacgcgcacaggcaccaattagggctcccttttaaagtactccctctataaaaaaaatctagttttaggtttaaatctgaatacacatatccaaatttaaatctagagttagtttttttaagagaggggtagcagagagaacacatcgacactgttaggctagtttaatgcatgcgttagatgtagcgtaacataagttataagttgtttgatttattggtattttaatattttgataatactaaaattactatgaaaaaattggcgagatgtggttgtttgatttggttacaaatctttgtaggtatttgggactttttttttagactcctttgaatcactggaatgaaaaaacggagaaataaaaaaaacataggattctgattagaacgtaagtgtaaaacagatgattgcaaaacataggaaaatatataggaatgactgtttaattgggccgcataaaaaacacataaatttaaggagagataaagattcaaaggattcttttcatgagattctatcccaacctcatgttaaattttcttcaaaacttgtatgagaagagtcatttcataggaatttcataaaattcattccttcgattcaaaagaccatataggaaaaatttctataggaatgaaatcctctaaaatttctatgaatttcttttgattcaaagagagccttaaaaaaatggcaatgacatttttttgttagcaaaacaaatgctatccaactctattagcattatgtttttctttcctgcaagttttggcatcaaacatgcttatagacctgctcttaatttggacaaggaattagactaactttcttttagaatcggatggtttaattttgaaagaaaagcgaggttaattggaacaatgctaaattgagccaaccagaatgagctttccttcgaagtttgaaatcatgagcgttgcactactggtagttccaagttctgtagataaatttagataaaccgagatttaattcttagagcatcgatctgcaatctacccatacaaaaggaatcaaatgctttatacgcacgtgtgatcaagattgtcagtgtcacgaacatatcatatgctccctccgttttaaaatgtttgacaccgttgatctttttaatacatgtttgaccattcgtcttattcaaaaaatttaagtaattatttattcttttcatatcatttaatttattgttaaatatactttcatgtacacatatagttttacatatttcacaattttttttaataagacgaacggtcgaacatgtgctaaaaagtcaacggtgtcaaacattttgaaacggagggagtagtattgtatgatcatagtatcatagcaatcctggctaaatgatatgcgttgaactacaaatcatttttaggcaggattgccgctgtcgatgtttgatgtcgcaattctggtatttgtatagtatagggatcgtcggtgctaggatatacgcgagactgaggtaaaagagatggagacagggatttttatacaggtttgggcccctgagttgtcaggtaataaccctacatcctgttggccggagccggagttgcttttattcaccataatcacaccagtacaatatgtggggtagcctatctaactatcgtcgacatggcggtctgaaggtctgactcgtagtcgacgtcgacgacaaggtagtcttcctcctcgaatccgtgcccagcgagatcagagatagcgctttcgtctctcctgacagtatccggagacaccgtaggggactagccgtgcctatccctgaagtcgatatccggcgtcttgtcttggcgtatgttggcttgtatgttgtcccgtgtattgtgtctcctctcctcctatgggccttgtatttatacccataggtgtccccttgtccaagtagaactagggaaaccaatatggatacaatccgagtagttcttgtcatttctatatagaactctggttgtctttccttatccggaactccctccatatctgaagtcagtttccgtataagacatggtatgtggtgggtcctgccgagatgtagtcgactactattaggtatgtggtatccataaccctaacagtagcccccgacttcaatgcaaatgaacgaattcatattctcaaccgtagaccctggagtaactgttgtcgtgctcatgtgaccgttctcggcgagttcagagataacgttagacttcccttatcagcctcgtgcgggcacctatagggtttgtctgagtcaatctccgatgtcaaccaaggaagtacggagtagacgactaagtctcccgtcttgccgtaatcgagaatttggattgaaatcaagaaattctatctcggctggtacaccatctctttatttcgtattccttgtcgagatccagcaaccattctcgagcgatcgagaaggtgtagagtctgcgacggagccttgtcgacatttgtcgtactcgccttagtcgatcttggtgtagaaccatagagacatggagtcttcgtcaatgtcgaatagaattttcctgaaatcaatactcagaagagaatatcaaatagaaatagcccccgagcgaacgctcaaagagtgacatgttataatatatatggaaaactaaaaatgaattaaatttaccgaccaatgttttgtgtatgagcttcttctctcttaccgactttgatcagtcagtttgtagagtcatacactctccctagaccctagccttgtcgttggagaatcgttctcggaggagaaggctcttggacccttgacctgccttggttgaacaagcactgatcctagcccccagccgtgaagttggaaaactcaatttccgattacatgacttggttaatacgcacggcgagaactcttacatgaccagatcttaca

SEQ ID NO: 39498 - DNA, 27294 bp, Oryza sativa
tccccagccgaagttcccttaggttcctcggaggccttgtcaagatggcgtaaagggacagtaggataggtttcaacgctaggtgtcgtcgtggtaaggaatctctgggtaaaacacttggcgatagtgtgtacttgataccaactttgttggagtagaggtagtaggagaatcgctacaccgctggtcgaggaccaggtagtagtcgtaactcgaccacttgaagtaaaaggtagtgggagaatcgctacaccactggtcgaggaccaggtagtagtcgtaactcgaccactggaagcaaatgtacgagagatcactacgatcaactggttgagaaccagtgagtaggtgtctctcgatcatttggagtcgtggtacgaggaccgctacgctgccggtcgaagactagttgtagctgttcctcaaccatctaaagtcatggtgcgaggaccgctacgctgccgtagtcatacctcgaccatctgaagttaaggtgcgagagattactacgtactggttcgagaaccagcgagcgagtagaattatctctcgaacaccaatggaagttgcggtgcgagagattgctatgtactggtgcgagaaccagcgagcgagtagaattatctctcgagcaccaatggaagttgcagtgtgagagattgctacgtactggtgtgagaaccagcgaacgtgtagaattatctctcgaacaccaatggaagtcgtggtgtgagagattgctacgtactggtgtgagaaccagcgaacgtgtagaattatctctcgaacaccaatagaagttgtggtgtgagagattgctacatactggtgtgagaaccagcgaacgtgtagaattatctctcgaacaccaatgaaagtgctagagttggtttattacatgtgtatctcatgtggccagcatgactcacatacccaacttatagcatatccggatatccgttcgcaatcatgtcgggtgatcaagccgacggcgttcgtgaggaattatccgttaacaaccttttcttgagtagtccagcgatggccggtgctatgagatagatcgtcggtcttcgttggtaggttgggtgcgataactccgcatttgtcgataatgttctcgataatagagtgtactcgaccataacctactcgagtgctcaattgttcctaaaaaatattttctagaaggcaagatatatagcagataatatcgagtatgtacttaaaaaaactgcatggatcttctagcattatcaggatataacatgcagatgtaaatatcatgcattatgtaaaccgtaaacaagcatgatttatacagaagaaaacagagcgagcccccagcgttaggccgtagttggcctaacatcggggacgcttgcacaatagatattgtataaaaaatatgctctaggtaaacataataaattatagatctgataatgctgtatgatctgaataggtacgataaattacatataaaatattacgtacttttgtagatacatgccggatatatctacgaaattagtagattaatttaaaaattcaatctgctaattacctctgttgatgtagttggataatctgcacatgtacaagtgaagcaaccgtggatgagtactgtggtggttactcctgtatacacgtggctctttggctttgtgcccacgcatgtagacaaattgacagcaagaccaaaatatacacgctgtaacagcgtgacgttaggtcctctgccatggtttgtattccgagtagaaatcaaggagattaatggatgcccgctagttagcctggtgcatgcgagtggagcggcatacagggcagtttcgctgtccttttcgtcatgtgcttgtgtgtcatcgagaatcaacacgaagccgacgaggacagggctcaagcgggagcactctcctgattagatttttggcggcgacgtggtctcaaagtaatcaatcgggccgaggcctcacgatcgacaacattgaaccgttgttctccgcagcggcgacatcttgaagcttggtcgatctcgccggatcgaatagttaatgatgatggttccgatcttgtcggggcacgtactctggtcagattagatctccctctcaaccgaagtcgtcgagtaggttgttgttggagaatccatctcttaaactcatctcgtcgaaaccctgaagcaccaaaatccccctacctggcgcgctactgtcgacgtttgatgtcgcaattctggtatttacatagtatggggatcgtcggtgctaggatatacgcgagactgaggtaaaagagacggagacagggatttttatacaggttcgggtccctgagttgtcaggtaataaccctacatcctgttggccggagccggagttgcttttattcaccataatcacaccagtacaatatgtggggtagcctatctaaccgtcgtcgacatggcggtttgaatgtctgactcgtagtcgatgacagggtagtcttcctcctcgaatccgtgcccggcgagatcagagatagcgctttcgtctctcctgacagtatctggagacaccgtatgggactagccgtgcctttctctgaagtcgatatccggcgtcttgtcttggcgtatgttggcttgtatgttgtcccgtgtattgtgtcccctcttcttctaggggccttgtatttatacccatataggtgtccccttgtctaagtagaactagggaaaccaatatggatacaatccgagtagcccttgtcgtttccatgtagaactctggttgtctttccttatccggaactccctccatatctgaagttagtttccgtataagacatggtacgtggtgcgtcctgccgagatgtagtcgactactattaggtatgtggtatccataaccttgacagccgcggtatcgagatactagatattgtaatcagacaatgtttgaatctagaaattagaaccatctgaattggtttatgttcatctatgaaattatgtagtagtgaataataataataataataataataataataataataataataataataataataataataataataacaacaacaacaataataataatagcagcagcagcaggagactgttcgatacgtgaccttaaatacattcttgaattgtttttggggaggaggacagataaatatcactgagggttgatggataggatcttctagggtaaggaagagagagggtgaatcctatctccatcatcatggctttggacagatgtccgcttcagactgaaggaagctgctctatttaagccgtacgtgatcctacagctcttgtctcatgagtagtacttttccctgcgctggctgtggcaaggtccatgagttgagtgattagagctagtagaagccttcccggtaattaatgtatggaacattgtcctttggtttttgtgagtacatggctagaataaacacctgatgtctagctatagaatagatagattagtgtaaaaaatatactaatatattagtgaaaagactaatactctggctaacagcagctacatgcatgcatggaagcacctactagtacttgttggttctgtccctttagcatagtcacatcaactagctatcttctattagtagctgtcatgcatgaaaatttatatattgaggctgtgtttagttcgtgtgctaattttttttttaaatttacgaacacacatttgaagtattaaacatagactaataacaaaacaaattacagattccgcctgtaaactgcgagacgaatttattaagcctaattaatccatcattagcaaatgtttactgtagcatcacattgtcaaatcatggcgtaattaggctcaaaagatatcgcaatttacagtcggactgtgcaattgatttttttcgtccacatttgatgttccatacatgtgtccaaatatttgatgtgacagaaaagttagaagtttgaagaaaaaagttggaatctaaacacggcctaattaatatcaaagatttgcatatttggctaggcgaaacgcacgggtagaacgatagaaaactaggcaagactacgcccatcaactattttacttaatcatctctaactaaatttgcttaccattattacattgagatggtgatactaacaatctaacagtaaatattattaatacacgaataatggattgatgattttatcagtgagaataataacgtgatagtgatacttagcctgagacggccgatacctgaaacaacgatatcgagtcggctgatatcagtgtgagatgaggaatgcctcacacaactagggaattcagcggcgtgattctcagattagggtatcactaattgggggagaaaatggattgaaggaacgatattatgacgattattttaatacctctgcagtgtatttttaactcatttactatgttaaatgtcttctattatttatcggttgttaatatctaagggtagtagtattttctgtctttaaaaacatctatatagctatatgtactaatcttgctgagtatgtgtaatatactcatatatttactatttgatgtgcgcagaaactagtcaagacgagatgtccgagggaaatgatgacatgcaaacctaatggggagcgtggtctacttagtctttagaagcatacaagaggacataccatcatgctaggtatagggtatcgtcttggtaataataagttggtaagcgaatcaaccgatgtattatgcaatgtagctggtgaaaaataaatggaaccattgttgaaagtgtccaagctctagttgtgatagttagatattacatcttgccttatatccttatggacttatatatatatatatatataaggatacgacagactgtcaaaaaaaatatttgggtcgtgacaaattatgaatacaaactcggtagtttattgtcaggacctaagttaaatgaaacattatctctagtgtgtagttttctcttgataaatatttgtatgccacatattattattactctattcttgttctgaacggttacatataattgatacaaatacggattaatggtgtagggggtgatcgcaaacgcgcgccccaagcggcaatgaggaagaattgcatttgcgtgcgatagcgggtcacagttaaggtacgaatttccccactagcatgaactctgtggggtcttcaaatataagaggcaaccatttcttcttgatacacaagcacaagcccttttgagaaacccttgtagattgctcgatggggagggaggcagtgctgctaggatataaattaatagccgaccaattcggcttcgtcattccatctctcctgtagaagtaaatagtgcggtttcttgcaaaaacctctctctcggccagttatctttcggaaatgctaatgggcgggtgatcgctcccccacccgcctagcgatcacccgcccaccctctcccctatactactagatgtactcctccctcttctcccccttcctccttcccttctcctctttctactacagtaaaccatacaattttttttaaaaaacaaaagttagaaaaatttatgtatagaaataccatatataaaaaaaatttgaattcaaatttaaatttgaatcgggtatgtaaacttttgacttataaactttgggtctataaactttaggtgtataaattttagatgtatagaaatactacatagagaaaatatttgaattcagattcaaatttgaatcagatataatttaaattcaaatttgaatcgggtatataaactttaggtatataaactttaggtgtatagaaatacttatatatgaaaaatatttgaatttaaattcaaatttgaaatgggtatataaacttttgacttataaattttaggtctataaacttgaggtgtataaactttagatgtatagaaatactatatataaaaaaatatttgaattcaaattcaaatttgaatcggatatataaacttttgacttataaacttttagtctctaaactttagatgtgtaaactttaggtgtataaactttagctgtataaatttactaaaatatgaaagtaatgcggtgccaaaaaagaaaaccagaggagggaggaaggggggaggtggggagcgaatctgatcgctatcccatccccacggtgatcgattgcccattaggcgtacccgttatctttcacgacagagctatcctttgttgacgggtcgtgccactagattactatcgtctatggcccgcaaactgacccaaatataatttgttttctctatgaaatccgagatattagagcccatcgtgtctgtcctgggatcataatagccaatttcaatctaatctatcgagaccaagaaaaacaacaccaaccttaaccggcgaatgatgggccgcttccgtctcattcttaatgatctagctctgcaggagctagtacatcttaacggtcgttccatacttccatcatgtggtcgaatgcccgggattcccgagcgcctagatagactgttcgtctatgtggatggggaagagtttgtttccctcgttaccttttgaaaccctcttctctccatgttgccggccctgccagagaaaaggagattctaattcgaatccttctggtgtcgtctccctgctccatccatgacctgatcaaattgatgcaaggagaacgctcctgaggaagcatcgaaggcaaaacagtgaggtattttcccaaaccattagatttacaaaatgatctttccgtttgcttattatgtatcaatcttccataggataatcagatggataatttgcatgtttattatgtaaagaaacctagaaccaccgtccaccactaggccgtcgtctcccacggttatccccctaagcccagcgatttctcctctcttccatctatcccaaccctcctcctatccccacccaacccgggaccctaaaggcttaaaccctaactcatcgagtcaccgccggtcgccagagttagagtagaaggagtgcatcacgaatcgggacataatagaaggttagcaattccgatatttaaaacatactacctccatctcataatacaactattctagcatttaaattttatccataatagagctgctgctctatctatttcctcatcataatcaatggcaactcccttttatttagtctcatcctattctttgattattatttttaaaaaaaagtgtatcagtaaaacggagggagtacttagtgtctatgtgatgagtttaaaattttgagaaacaactggttagtaactagcttatgagagtctggaaaacccagcttctagcttatagttcattttctagattttataactacatcttcttataatttggatgagaaactggactatttaaaaaagttttaaattttataagaagttgtagctgttagaagctttctaaacatgtaagaaagcaagaggaatgtgttactccctccatctcataatactgtaatatagcaatttagtaccggttgaaatatattctagtattatgatgaatctaaacaagttactaggttactatattatggacggagagagtatatgtgattttcctaatagtgtatttcctccgtccattaaaaaaacaaacctagcacatattaagacacatcctctccatctcatagtactgtaatatagcaatttagtaccggttgaaatatatcataatagtatgatgaatctaaataagttactaggttactatattatggacggagatagtatatgtgattttcctaatagtgtatttcctccgtccattaaaaaaacaaacctagtacatattaagacacatcctgatactacgaatctagatattgtgttatattccgtactactccttccgtctcgtaaaaattaacctagtattaaatatgacacattctattactatgaatctggatatacatatgtccagatttattgtcctggtatgtatcgcattcaattttgtttttttatagagagagtagatttgtattttatttgaccgagagaatgcatggcttaatctttgagacaagcatatgaaaaggataagaatctgcacccccataaaaaagtagaggcccgaaaagagcccaatacccaaaggaatccacccaagccgatggtggttttagccacgggtctcagtctcactcccagattctactcccgctcctccatcgtcgtcgccgcgagtttgctcctctcggcggcgccctcctcgtcgtccccgcgcgctcgtgccgctgctccggccagcgggtactccccgtggcgaggcaggtgagcggggctcttcgagttcacgaggtgtcgtttttttttttcggggggatttctccaggaggattagtagagatcaggtgtgtcctcctttggatcgcttttatctgttcgagcgattgcttggtccggtagcgattcgggtgtgagactgagccatctgcgcctctgttactgtttctgttttttcctttaatggggatggttttctgaaaattaggatggcacccagcggtatgagattgttgtggattgtttgatttcctggtggttggtgaagtcagaaattgagcagtactctctgtcataagacgttttaactttggtcaaagttaaactactctgaatttgactaactctgtagaaaaaaaagtagtaatatttacaacacaagcatagtttcattaaatttatatgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagcaataccaaagtgtttcaaagaaggattaccttgacttaggtctgcctccggcctaaattaaatcaacctaagttaaatggagtctctatcgttctgctgcaccccttctcaaacaacgcgtttgatttccttccttataccaaaggaattccttctttctcttgccgatcacatccaagggtcgaatacatcctgtctttgaacctttgtagtcctatgcatagtcagtactatagcctcactgtcctcgtcgaggatagttattcattaaggttaatttgattcaatgaccagaattctgcgaggatatatagctcggagacgacgggcaaaaatgcgttcatttgcctcaaacttttcggggtagaagaactcgttagttgtagttgttccgaagggacaagtcgctcccctctgctgaccggaggaagcactttggaaaataaaaactcgatctatacctccgggcagcagagcagagggaacggagccctcgtcccgaggcctttctatgaaggcgagcagcccagcccccttgttgaaattttgatattaaggaagccgtatttcgcaatagcagctccgagaagctgggcttagggtgcgcctcctgcggtcgtttcagtgattcaattggctggcttcccccagctcagactgatgccgccacctctcccaggaccggaatgattatccctgcccgatgggtctacattcatcctagaatgtcgtcggcatccaagctttgaacaatactaaaagctgcaactcgtctgctattccgatcttcctctgattcaagtgctaccagttccttcttcaactccaggccaggcaagagccgagaagggcttcccaaatttttcccgcggaggagggagaatccgcgagtccacgacctcctactcccgagcggcctctgactgaaaaggatcgaatttatttgagtttggttttacatgcggatctggaaatgcaagaggacctagaagaacgttgctccttagatgtatgcagctgaggcatcctaacgaatgaacgatttgaaccagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctacgattattccaaaattgccccttcgctttatcaacttccagttataagttgtaacttacttcaaacgatttgagacctcttgatatccaacattgttcttaccagaaccaaaggccacaggttattgctaatgccttccactatactcaacctgcatggcaattacttaatcaaagtcaagatgcctatccacataggaaaaacccaaagtcaaaagagcaattggcctgcaaaaataaaggatttgttctcttttgtaattagaacaaacataaacaaattggatagaaaaggagcggaaaccgattgattgtacacttgctgttctcaactgggcctctgaatctcctctggtttcacctttgcgagtcgaagtaatttccggaaagacacagaggagctctcatgcgtggaccaacagtagccctgtcctctcctctttgttggaagatgagtacacatcgggtaatccgcccacgagagcccaatcacaagaggctcatatagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgcccaaaatgcctctagaaagatcagacagaagtaagacgagctgtaattgtacgtacatgtaaagaactcaaacgaatgtcaaaacaaaggaaagatgattatcttataggaagactgccaacactgactggggttgttcaatcttaagtggagtgagttaaatgacttggcttgctcaattccttcccggtgtaatttcataaaaggaatagcactcaaagcttgaagataagttttgtactcaattaatttctcagtccctctaatcgggtgggcaccggccggccggatccccctgaaaaccgtacgtgcgggtctcctttttgggtataaagataaaggagtcgagtttacaattgaataaattttcataatacatttgtcttgggttaaaaatattactattttttctataaaattagtcaaacttagagtagtttgactttgaccaaagtctaaacgtcttataacctgaaacggagggagtaatatgaatcactagctagctggggatgtaatttactaatttacataacatgtgattgaccattgctgcagataatatgtcttgtccacttcggctagttcttagtttgctgtattaatgtaaaatcagttttattcagtggacagtgatctattagcctcagtgccgtggttgctttattgggttcaaaagaattaattgaattgttgcaaagaggcaatagttttgatagtgctaagacaatgacttgtattgtaaaaaaaaaaagtgccacatgatggggacagcgcgatgaaaagaaatcagttgtaatgacgcacaattgttttgttcttagaatatgtattgttttatttttatttttatgttgaggacctagtagcaagtcttatgctcgaaattcttggtctgctttatgtagtgatcacttgacccatcttttctggcaatgctgatttaacctcattgactccatctggcagcattagtagaatatcatcgcacccaacagctatggctaccacacaagcctcagaagcagccactgagaaaggattgcctttggggatggatgtctccatggtggatgaatatgcttcccagtccaagctgctgcaggaattcgttaaaattcccactattggcaacgcttggatcttcaattccaagactggtatgtgctgttattgctatctggttttactgaacttaggtttcttactcttcttctcgtgttgtgcagaaaacacatctagggcgatagtttctgttggccaaacagatctgttggcaaacaaaaagaggagcttcctattaaattcccacatctcaaaaaattcctcaaattctgtggatttccagtggtctcccttcccaatcgaaatgagtggagtttcagcagtaattccatcgccatctgggagaaaacttttactaatacggaattctgaggatgattcccctacaaaactagaagtttggggcccctgtcagttggagaacgagattcacattgcacaatctgttcatggatcactctatgtcgacgaatggtaaactatcctgcctcttttagaacaactttcttagttttttgtgtggtagtgggtttttttttggaagaaagacagaggtaattagggacgagagattgctccattcgccactttttgtacttcatgtttcttaaatgcaggtttgaagggatatcgtggaatcaagaagagactttagtagcttacgttgctgaggagcctcctcaaccgaagccagaattcaatgattcaggatacaagaaggctggctcgtctgaaaaagactccaagagctggaagggaaaaggggattgggaagaaacttggggagaaacgtattccaagaaaaggatacctgcattgttcgtggtcaacatttcaaggtgtgtttctggttgttctgaaggttgaatccaaaatagctttaaaagtactgcaattttgtgaggaatagtttcattgcagcggtgaagtgcgagctgtgaagggcataccgagaacattaagtgttggccaagtgatttgggctccatcatcatcacatagcctggtttttgtggcgtggtcatctgataatggttaccaaaagacaccaaggaaacttggaattaaatactgctttaacagaccttgtgctctgtatgctgttcctgatcctttcatggaagaagctgataagccatcacttaagtgagaacacctgtccttgatgacaatatttattcagttctatttcaactatgcaccattgtaggcttcctgttctaacatattaaggtattaattgtcacattttagttattttctagtgatcgtgtgacactgtaaattcttctctcagaataattgtagcagcatatttttttcaaggaaaaaaaatcttccatatatattttcactcttttttcctcattaatcctagtcctgagcagacaaatgctaaatggattgtatgcatcatgtctcaaaaaatagaaagtttatttctgatgtcatttctgtttattgtacagtgtcagtaagggtgaaactgcacctacaaccaagttaacatcagagttgagcagtgcttttttcccacgattcaggtaggactgcattcagttttctttgctcagtactgttattcagtttaggccatatgtctcaactattatattggaagaagtacaagctacacatcctagccgtatttctttaattatgcattataattgttaggcgtaatttttcttctatggtttaaaatattttaatcaaattcccttaaagcatgtcaattgattgttcatgcttgttatcatgtattttaacctaaatatttgaacaatcataattcaaatgggagtgaatttggaaagtggagcattttgggctgatgagtaggtgtctttattatttccttgttcctgtaatcctgtggattgactcagtagatattaatttactgcaacaccaatacattttatttgcacatctacaattgaagttttcatgtctagattataacttagtactggtagctgatgcatgtagatgaatgttaacaatgcgtcgcaaaaatgatatggaatctttattgtacagtccagatggaaagtatcttgtgtttatctcagcaaagagtgctatagatagtggaacacacaatgcgacaaattcaatgcataagattgactggcctgcagatgggaaattggagggcctcagtgttgctgatgtggtacaacaatgcctttcctttacttgttaattttttaatcgatcattttgtttagatggcttccttttatatatagcttcaaagtcatggcttggaaaaatacataaatctaaccagtgtttatttgagcacattgtttgcctgttggctatacttgattaaagatatgtatttctggactttgtgaagtggaacttcaattatttttttaattattgaagtatctaaattcaatttcagttaaaagaacgaagttcagagggtaaaatttataatggtgtgtttctttttataggtgctctgcatatccgatatcaagttcttaatgtcttagctgttatgtaggtacctattgtgatgtgccctcaggatggttgttttcctggtctgtactgctctggcatacttaggaatccatggcttactgatggacaaactatgattttatcttctatttggggaagtaaggaagtaatactttctgtaaatgttgtgaggtgattacaagcatttttatccatcagttagaatgatatggctataaagtttatttatttatgaaattacctattttcttcacagccgtgaagtttcaagagttagtcctcaggattcggattattcatggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatctaaccatgttgcatttactcaaggcaacactaaaatgcatttgtaagaaagttctcaaagctcatggtagaatactcttcttggttgtttgcatccttaaggatgcatgctaagcttcatttgcattttaatgtttgaaaatgtactttagtagaatactcacatcctctccccttcctaaatttttatattttataaaattgattcaggtgctaagctgccctttgaggctatttttgtgtcctggaaggattctgcaacaagaccaacaattgttgttcttcatggtggaccacacactgtttacccatcaagctattcaaaatcgttagcatttctttattcacagggatataaccttcttgttgtgaactataggtgagctttatttttttttcttccagtagttcttctgttgaactaggttaaaataccctgtcctttctgaattctgctttggaaatatatcatattaaacactaacattaatgtccacgtacacaccattctgttgcctagaggttcactaggctttggtgaagaagcactacaatctcttcctggaaatattggttctcaggtgcactgttgttgatttatttccatgttttaagattattttcttaagttgccagaaattttatatgaactgtcattacgtacaattgtttaatactcatgaacaggatgtgaatgatgtattgacggctttggactttgttataaagaaaggattaatagatgcatctaaagtagctgttgttggaggttcacacggtggtttcctgacaactcatttgattggccaggttcttagcatgcctttgttattctgaattctttatctatgcaattattcattacatttgcagtttatatttcctttagggattcaattatttgtgcctaatcgtttgcacaaataatctagcacaattcttgttgtaaactgtatatactcatttggacataattgggaacagtgtcttttgataatgtgtattggtctatatgaaactcttatatttgagaaatgtgctgtaaacttataattttgggagggaggttgtaatttgtaaaagagagtagtaagtttaatataagtacccaagcacactaagttatggtcagtgaacttaaaggctcaaagctaaacttggatatttcaggagctctgtagcagtgcacagctaaaaattcttttaaaaaaatgatgacaccaatttatattagctattaaattatatattacattgcaacgcttaagtccagaataatatcctagaaaaacattcttacaagagttaggatcagcatttgtttccttttcttggaagtaaagcttcactgcagtgtaagccgagctgtttttaccttttcatgattaagaagttcacatgtgatattctcaagaatatttcctgattttagaatataattatttccttgacaaaaatagtgagaaactactgctgcatgtgggaactaggtctatacagtttctttatgactatacatgcaagacaataagagttcatgataggtctatacagtttctttatgactatacatacaagacaataagagttcatgatgcacaggcaatagcacatggattcttctatttatcaggtcttcttggattctgttgaccttatgtttcatggactgcaggctccaggcacttttgttgcagcagctgctcgaaacccagtatgtaatttatcattgatggtaggaacaactgacatacctgagtggtgttttgtggagatttatgggaaagaagggaaaaactgcttctcagagtatccttcatttgatgatctttgtcaatttcaccagaaatcaccaatatcacatatatcaaaggtatgtagattctgcatacttaaccttttacaaaatctatgcttgaggaagaaagtgtagttccctcatgcaaatttgctccttgaggactttgagtaatcttttcttgacagtttaagaaaatctgcaggtgagcacgccaacactttttctccttggagcacaagatctcagagttcctgtttctaatggcttacaggtaatttcttatgcacttctgtttcatttttatatgatgaaagggttgtgaaatgattactagtagcaatgttgcattcatgttattgtttgcgtagacaagttcagtcaattttcctgaaaaccattagtgaaagcatatgattcatattgttccactatatactgcttgtatctatttatttattttcacttttacaaatgctggtttatgcctaatcataatcgcaacatatgcagtatgcaaggaccttgaaggagatgggagttgaaaccaaaattattgtctttccagaagatatgcatggccttgacaagttagttgtactttttaatcattttacctttgttaccccgatcagtgtcttctgtgttgcaacatttgactaagtcaaccttgcgtcccctgtgcaggccacagtctgattttgaaagcttcctcaatataggtgtttggttcaagaagcacatgagcaaataaacaacatgcctctgttaccacactctcaccttgcttaataaatgcttgtaatttgggtcaaagcagcccaaggaaacgtggttctgttggcattctaataaattaagcctgctgtaacatttctgtactgggataattcttgaaaatgtaaatgcatttggttataaaattttaccctcgtggtacggaactatggattacaaatatgtgatgttagattatgctttactttgaactttgaagtacttctagttcacggttgctgtcctgtagcctgttgggcttgggcattccttttatttttatctttttttaggaaacaatgggatcataatttcttttgaatttcagtgagaaaaaaatacatgaaagttcagttcaagttaggcacatggaaatgctgattgagaccactgtaacttctgcttctttgcatcaagatcccttgaagttgccttctggataatctcattttcatcagatggtacaaagagctttgttgtttcatacgattttaaaaaggacaacaatataagttattgcaaaggcttcttgtgctgttcgatgctttcttcgtggatgcggacctgacgcaaccttttgtccttattgctgggttcctcttgtctcattgtctatggtggtatgtacgatcattagtaactttttaagattccttttgttattttgggcccattctttgagacctgacacaaaaagaaaaccaaaatttgatgccatctgatcctcaccaattgtttgttgttaggtttgttgggatcgttgctaaggactgatgatgttttaaagctcaactgcagtcttggatcaaccactctgccactagactccatttgcacttcactgcaaaagcagaaaaatatatgtaagtattctcctttccttcgtctcctgaaaggctaatacgatttataatctgattttattgttttgaggcttctaacttgctgaattttgttggtcctaagttgtttcctcctgcactcagtctggtcctcttgattattgctgtagttccagaagaatctgattttgttagtagaactagtcccagacttaacatccaggatttaatattttttagtgttcatcgtattttttagttatgtttatacttttgtactacatgaaaatcaaagcatttagtgtcagagttctccagaaaaggattttggtgggaaggaagaatgaaagatacttcattttattaatcttaggtagccattatagaagtttccatgttttgtttgtctaagtgattcaatattttttcttgaattggtgcattgacaacgtcaaatctgtccatggattgcaagatgaacaattgggactgttgttcttgagttgttaatggaatttatgaagtataaattaaaaaatagtttgtgtctgaactacattaaagtgtatgaaatctgagtcttagtacggtagtacctgaaatttttcacgggtaactgcaatttgaattatgaaagagttaaggtgatataggttgagtggtgtgctctaacctctaggctcttttggcattgaaatgtatacccatacatcatgaagttgaagtcaggaattcaggtttctcagttttcatcttatcagtggaattgacaacaaaatatacttgagcttccctgcagcttgtttaacatactatattcttgagtttcccttcagcttcctcagcatattaacctttgtgacaatgcagatttagcttaacccagtagattgtgtctttccaaccgaccttacaagtgatttgaatcttctttgagaaagacaatccattgggaatggatgcactggcatctgaagaatacgcttcacagtcgaaactacttcaagagttcaccaatgctcccagcattgacggtgcttgggttttccagaccaacaatggtagggatgattttcgattatacctcattagtaatcatcattttactattttccagaagtggcgtaaagcaactcttgtgtcatgtttgcagaagacagatccacagcaatgtattcgattagccaaacaaacctactggcaaacaacaagagaaaatatattttgttttctcatattatgagaaatggtactaaccttctggactttcaatggtctcctttccctattcaaatggatggagtgtcggctgtcgtaccatctccatcgggatcaaagcttcttgtggtgcggaatggagagaaaggttcccctacaaagcttgaaattgttgatcaatcacatgtggagaaagagatacatgtagctcagtctgtccatggtccactttatactgatgagtggtaaaagtacagcataatacctgcacttttcagtccattcaacctatctgtacaatattctggatcatgatactatttttgttggcacaggtttcatgggatttcctggaaccaagaagagaccttaatagcatatattgctgaagattcacctgaaccaaaaccagtttttgatgatactggatatagaaaagaaggttcttctgagaaagactgcaataactggaaagggcaaggggattgggaagaggattggggtgaaacttactccaaaaaagggagaccttcattgtttgtccttgacattaataggtctctcagcaccttctaattaatacataatgttgacctgaccatagatctgacaatacgacttactgaaaccgtttatttgttgtattcagtggagaagtacgagctgcaaaaggcatttcaagatcattgagcgttggccaagttgtgtgggctccaccatcttcatgtggaaggcagaagtatctgatttttgttggatggttagagcacaatgggtttcagaatactcctagaaaactaggcatcaagtactgttctaataggccatgttctctatactcaactctttgccctttcgaagaatcagatgttgataatgcaccagctaggtaagtaactgagcacccatcttcagatcatgctgtaactttgtaaagtttacaaatttactttatttatcactagtttgttgaaataagaaaatgtaaagctctgaataactatgcttatggggcagttgtaagttgatatttccatgacatttttccagtgattctaaattagagcctgcttcagtagcaatcaacttaactccaagcataagcagtgctttctttccgcggttcaggtatgcccgcattagtatttgcgtattttcttgaaggaccttaaaccatgctagaaaaattcttcacggaaaatctctaattattttcaacagcaaggatggaaaacttctggtgtttctatctgcaaatcgtgctgtagacagtggagcgcacaatgcaacagattcactgcataagatcaactggccttctgactggaaaatggatcaatacctcgaaatcactgatgtggtatgtcctcagatttgtcttgaccggtacttatctgctgtctgcagtcaatttatttaacttctgaactgtgccagattccaattgtaatgtgtcctcaagatggttgttttcctggtttgtattgttcttccatgctatcgaatccttggctttctgatcgatgtacaatgattctgacatctgcttggagaagcactgaagtgatattatcaatcgatgtgttgaggtaaacaaggttgctcacatatgcctttctactgcttcaaaaatcattgcaatatcccatgctatttccttaattcctcctgcagtggaaaagcaacaagaataagcccagaaaattcagagtactcatggagtgctcttgcagtagatggccacaatgttcttgctggtaattctaggtgcacataatcagttaacttatgcatcaaattttattattttgggtgtaataattttattttatttttgtttgttttctagtgtcaagcagtcccatcgacccacctcaaattaagtatggccatcaagtgtcattgaaggatcagacatgtacatgggtctgggacgaagttaataataatccattgatggcagctaacaataaggttagatggtgtacaatttgaagtatacttaggtgttctttgatgctttgaacaatgtaatttactaaatcaggcttttttttttcattctcacattaccatctgctgcaggtaaaggctttgttgtcacatcaccaattcagcatactaaaaattccagtcactaacccctctgatgacctctctgatggtatagtcatggacacaaatattttagactatcatatgtggcttatcatccttcaccaagcaaatgttttttatatcctgcaggcagtaagcttccatttgaagctgtctttgtgtcctgcaaggacagttcgcacaaaccaactattctagtccttcatggtggcccacactcagtatctgtatcaagctattcgaaaacatcggcgttcctcgcatcacttggatttaacctacttattgtaaattatcggtaagtttgctgaaacatttctacagttctgatcaattaagcttatggcatcatctcactatcatctgaaaaaaaaagagggacaccgggttttggagaggaggctttgcagtcacttcctggaaaggttggatctcaggtatgtaatccagctaaactctgagtctttgtttctcatgaaccaacctaatttctgatgtgtgtcaaactgtcaagcaggatgtccaagactgccttacagctctagactatgtcattgagggaggacttatagacgcatctaaagtagctgtcatcggaatttcgcacggtggattcttgactacacatctgattggtcaggttagcatcctaacagattttagcctctcaaaggaaaagaagaagaagaacaaaatcctaatagaagttagtatatgtttcttgttcagcttgtaatttgttgttattttgtttcaggctccagatagatttatggtggcagctgctcgtaatccagtctgcaacctatcactgatgattggcaccactgacattccagattggtgttatgcagtggcctgtgggagtgaagggaggcaacatgcctctgaatctccttcacctgatcatcttcgcctcttctatcagaaatcaccaattgcccatatttcgaaggtgcatttctgttctcgccttcattcaaagagcaaaaaagaaatgttcttactgatcaagtcattgttcttaaaaacaaatgaaccagagaaatcaagtgattagctactcaaaaaggctcactgaactttgctgattttttttttctaaaaaaaaaaactttgctgatttcaacaggtgaaagcgcccctgcttatgcttcttggaggagcagatcttcgagtccccatttctaatggcctacaggtacatcaatagccgtttaaatttgcctcagtagtttccactttcaattcgttgtagaaatagtccataacaaaaaggctagatcctgaaacaacctaacaatcccgtgaaaagaaaatcaatcgacgggctacatcaaacagacattctttaaattcatctacactcgattaataacctaacaatcctgcatttgcttcactcatttgtcggatttggttaaactattcctgctcggatgatttcagtacgcaagagctctgagagaaagaggcggcgagatcaggatcatgatgttcccagacgacatacatgaaatcaacatgtaagcaagtaactgaaccgaatttcagctcatctgctttatataaaatgtcggcaacagccgttcggaaaaaaaaaagacattcagatgccattgtactattgcttttgtgcctaattttctccctcatactggaatccatgcttttgttcagaccacaatcggattttgagagcttcctcaacattggtgtctggttcaagaagcatcttagcatatcagcatcagatgcatctgcatgaagtcaacttgaagaaggggaggaagaaattacgtggtttaatctagtccaacaggtagatgccattgtaagccttgttcatggagctcgtccgtagacgagtgctccaaaatattagagacttccctattgaaaaaagtaaatggagactttaattggtttgagttctttccttttcccttcaattcacatgcttgatgattggatgcaaattcagtcggatttactaattactactagctactgctctgaccgtgattgatgatcagtccaacaacaatacttgcaaaatagtgcaatccaggagggtgttgttctttatgcacgttggcccatgatttttttttttcaaacaaagtcaacagccgcgcgagcaagtacaaacctgattcattaagtaaagtgtggttttgtgaattttactcttgcccggcgaaaaatttactgccccctgtgaattttcctcttcattctgaaatactttgcacaagccaactcacccatcaacatgccaacttaatgtaagcaattaaattggtgaaaaattaaacacgccatcagattgctacgttaaaactacaaagctggaaagcacaacaaggggggcgagagctataacaattttacaacaacaattgactatatcagatgtaccaaagaccatgtcagttcttcgttgaggcttgggcaagctgagatgctactttgtttgagaagaagctctcgagcctgcacaaaaagaaggaataaaaccaaatcaattagacaaccaggtgactgagatgctactttctttgaactctcgagtatgcaaaaaaggaacaaaaccaatcacttagttagacaaccaagtgactatggccttgtttagtacgcgaaaaaaaaatttttgggtgtcacatcggacgtttgaccggatgtcggaaggggtttccggacacgaatgaaaaaagctaatttcataactcgataggaaacagcgagacgaatttattaagcctaattaatccatcattagcacatgtgggttactgtagcacttatggctaatcatggactaattaggctcaaaagattcgtctcgcaatttccatgcaaactgtgcaattagtttttttgtttatctatatttaatgctccatgcatgtatccaaagatttgatgtgatgtttttgggaaaaaaaattgggaactaaataaggcctacgtttcaaacacggacgataaataattaatgccagatttcccccaaggtgaatcttctactggttatgatagaaagacattattgagtgcacataaatccaacatgagatgtaaccacccacgtttctattaatggttaggctaaatattttcaaagaaacattgacagatgcctgacttacaggtagatgaatatgcaaacacaagattgaagttcattgctcaccgtgaggcacacttgtaatagattgtatcgggagagttataagtttttgcattgctgaacattctcttcatgtcagctacaaacatctctagcgtcacataatactgctcagactcaactctttttgacattgtcttcaaatctgcagacaagcttagtgttcagaaactgaatagcttagatggcacaaaacatagcttcgccaagctgggaaaagaagggaaaataatcccctaaatcattccagcataccaataggatctttgataatgtcataatagtcaggaacatcacgtgaatccactggctctttgaatggccaagcatcaggatgctcattcatattctacaagacaaagctcttatatcagaattgataaaagtatgaagtatctttcgtaagacaacagtagatccaacacatcaggtcattgcagatctacaacatctttggaacataatcctttgaaaaaattgtctatagagcactgtacttggttgtcatgttaactcccaatcacaaaacaaaattagctatatctgctggcagatactcttttgttgccgatacacactaaaagatcaggtctgtttgcccatagttttgtttgctggtggccattgcaatccattagcatagtagcatatgcacatgactttaaggtgtgttttgagtaatgacatggatccttagtgttacattggtgtagccagttttgcctaatttctaaaccacactggactgatggttgagaatcactagtggctcacctgacaatcagcttaacgtttcaaaggataaatatgactaatgtctgaccatatgaagtagagttcacagtgaagtataccagaaatatttgaatattaaacttataaaatgtggccatttcaatcattgaaccattgaacagaccatccagctggtctggctttagaaaatatgcttgaaacagaaagggtgcaaaaaattcaaaagggagcaagcaaagtacaggtttatccagtgaggtcaaaccaaatggttgcatgtcatataaaaagatttgcgaagataaaagacttgccttcaacaatgaacgcattagattagtaagttgttgcctgtaagtactgtaatcaggagaaaaggctgatcttgatttggaatgcccccactgatctggcgtccacccagcttcccctgcatcacattgattgttctgatcaggcttgcatcatagctaaaccagtaaacctaacaaggcggcaaaacaaatatggtcgaataagacagatggatgaacatcttattttagaattctgttctgtatatttaacaatctccagttgccatatgatcatttctacaattggctctaaggaaaacatccttgggagaggacaggaatgcggtagaagcaatcatcatcgatagctgagaggcagcaccgcagtccgcagcactccaatgggatagcagtgcactgaactcatgaatgtcagaatgcatggtatcacactctggacaactccttgcatcctgactgaggccctgtttggcagggctacagctccagctccacctctactggagctagagctcaaccaaacggtttcagctccacccaaaaagggagcagagcgggctggagtgatctgaaaaaaatgaagtaaaggggtggagcggggttcaggccactccacagctccactccacacactgctcctagagttagatttaggagttaagagccctgccaaataggacctgaatgggggatgatgacaaatttgatagaatatttggatggcatgcatggccctacgtgtcatactt

SEQ ID NO: 39499 - DNA, 2632 bp, Oryza sativa
gccttggatgtcttctggtttcatcgttcttcttggaataccagcttctttctacaaataaaaaaagagaataacaggaataaacctgttaaatgccatgttttgatcgataaggttaaccaagattgtgtacagcagggtcagaaacaacaatgcaaaatacattatatgtgacttacaccagttatagtccatttgtttctgtcctatctagtacaaacccaaaatgaacaagataaatgtgacgggcactggttgccagtaaaattttttaaaaaaattcctttatttccctagatgatgccattacctaacaagatgcacactggatggattcctcgttaatcataccaaggtgtgcctcaaattttactaacatgattagttattccatttttgagaaataaaatgtgcaagtgacacaccaaaactttttgcaatggattcattggcacaaaattgaattgaagtctaacatataatagagacaaggcatgtttgacaaggatatcaactaaaacaatccttttttacctaagactagcagttttttctccaacagcaggttcatctattgcacatatcaaactgataatatttgacagaaatagattccaaaataagaaggaacaactaaccttttggaagtcaattccagaataaacaatatggcagtttgaaagctctctgattttctcatcaattgcctgttcagtcaaaatacagtcagttgccaaaacaaaaagaaaacttcaattggcttataatgatatgaatatcccagttgactaatgatttgcacataaagttatcaagtgctcaggagtcaggacagctgaaaaggagtaatattgcttccagtttatgtttaagcagcaattagccttttatgtcacctgtctttgacgcctaatcatcgttgccagatcaacatatggcaacttttgatcaattctgcactccatcaatattcctccatcatagtctttaatgtacctggaatcagcaactattgagttcaacagataaaaacctgctgtagcctagtacaataatactctcagacaacaagtagtgttatcattgttacacttttattaggagttactgactcactttatacttcaaggaaatgataaaacaatataattgacaataaattgcttacccttgccatctttctttgtccaatgtgatctcctttgtgaaaccctacaaattgccagcagcaaaggacaataaaataaaccaaattattgtttgcaagacatatgctaattgatctcttttgtttaaatcgtcaagaattcttatgatcaagaaactactaagtacagaaactgttgctgaacatatgcctaagggaactaatttatagctgaaacaaaactgtaggacttaggagataagttgaactattaaagattcaaagttagtcacctgatacaatcttacaaagactgctagacaatgttggacacaacatgtttagaaataactttataaaccatgcattgaaacattctttttgtcgctaattctatgaagtcactatttcgttaggttcaagtgtatttcgtagctgccacttgagaacaatcacaaaacaatgaaattttaagaaagaaagcatataaaagagttcagtcaaatagtcaaacctgctttacaaaatagccaacggcattgttatctgcataagttaagaaatgagtgagcccatcagcatctcgggcatgttgcttcaggtgattcattaaccgtgtcccatagcctttaacttgctcatcagctgtaattgcacaaaatgctatttctccaaacttctggctacaatttcaaaacctatattaggacagaaacttatgctgcagcagaaaaggaacatctctggcatggtgcatggcatgacgcaacagaaataatcaattgccagacaaacagaagtgtgcatgctgtcctacaacataacctttactgctttgagatcactgaacaataaatagtagaatcctataacacaatctcattatcaaaaatcaacgttagctacaaaaacttaaaagaacagctcatagcttccattagatttcattatcaataactatcagatatctaaacaaaaaagtaccacaacttgatcattcatgcaagtgcaaatacatataacagatgtcaatacatcatacaagttctagcaccaaggtggaaatattaccttgtataaggccggtaagtaatgcctcctacaacaatattattcctgataaccatcattgatttgtgagttctgcaagacacatcacaataatttcttttataagcactaacgaagagagatattcttgtcctctgcttccaaaatacgtagtaggcacattacactgagaattacctatccataacaagacggacaatgtactctttgggcatgttaggaagctgccgagcaaagatattcttcaagcctaccaacctggggaaaaacatcagtcactaacaaatctgaggttgtttggaacaataattttagcatacaaaccaaatcatatgttcatcaactccatcattagaatagcatagaaatttcagcctccctgcttcttcctgcagaacaatccaccaattttag

SEQ ID NO: 39500 - DNA, 4846 bp, Oryza sativa
aaacgtaagcatgtgtgacgaaacgtggtgagtactttgggaagaacagacgatggatgatgggatctgctgaagtaatggaggcttcactggaataccactggatgcaattactggtctatttttttcacacatttgaaatattaaacgtagactaataataaaacaaattataaattctacctgtaaactgcgagatgaatttattaagcataattaatacgtcattagcaaatgtttactgtaccatcacattatcaaatcatggcgcaattaagctcaaaagattcgtctcgcaatttacatgcaaactgtgcaattggtttttttcgtccacatttaatgctccatgcatgtgtccaaatatttgatgtgatatttttggcaaaaaaattttggttcttaagagcaggtacaatagcaggctataagccagctgcaaatatattttaaggagttaaataaggagagagaagtgcagcgggctatagatttgtagccagctgtagcacggactccaagacgcagtgtgtgtatgacatgtaggaccaggtattaatagtgtagtatgtaactattgtatgaatgagctattagattgactatagatgaattggagttagtagttagctgtactattgaacttgctctaacacaccctgcgttagttacctccgttcccaacttctctccctcgtttttcgcgcacacgcttttcaaacttctaaaccgtacgttttttgcaaaaaaaaaatatatacgaaagttgtttaaaaaatcatattaatccatttttggaaaaaaaaagcaaatatttaattaatcacccgctaatcgctgctctgttttccgtgccagggagtgagggttcctgaacgaagcagaacagtccattaggcggaaaacgagagagatgagttggaaaacctagggtaagaacacagccttaaaaagcaaactctcatgtcgtgtgccccccgcctaggcgagacgacagtttaccacatctctactacttaaaaaataagaggtgcttccatcgtccgtcaaaaaaatagagtgaaaaaaccggacgaaaaaaatctgtccgatccaaaacaaaacggacgaaaataaaccggatgaaaaaagaaaagaaaaatcaaatctgtcatataaaaaaagggcgcaataaaggaaaagaaaaacgaatccgattccacggtaaaaaaaaagggagaaaagaaattaaaaaaggaatctatccgattctaaaaaacgggcgcaaaaaaacaggcgaaaaaaaaatcaggtgaaaaaaaagatcggccaaaaaaaacgaatcagatttcgttggcgcggtaagaaaagagcaaaaaaaaaacaaatctgtccgattctaaaaaaaaggaattatatgtgacgcggtaaaaaaaatcgaatcctattatatttgacacgatactatatatctctatcttctctatctctactacttaaaaaattaaaaacgtttccgttgtccgtaataacaaaaaagaagggcgaaaaaaacattaaaaaaaagtttgattcaatttacttccgtcatgcgtaaaaatcgtatcttatcttaatctcaatctttccgaggggaaaaaaagaaagaaattaaagaaagggataaactagattgatgttcccaaaattaaaagaggataaacgatattgaaactcccctaactcgaaaagaaggaataaaatagatttaaatttcccgacaaaattctccaaattcgaagaaccctaatttcgggtaagaaccataagagtcaaaatccaaatcaattaagctaaaggttcgggttacttatcggacttgaaacccatgagcacaccggagctttccaggaagcggcaccgccgcaccttcacctcctcgcagtcgtgtcgggttccctgcgcgctgtcctggagcaccccgccaccatcctttgccgaagacgggaagcgtcggcttggcgttgcccctaccgccgacgaggtccaggccgctcggtgctcgtcgccgtttgcacgcctacctagccagaccgcggacgtcgtggcacggctttgcgtcgccctcgggtgcgcccccagccggcgaagcaagagccgctcggcggtcgtcgccgtacgcacgcaccagcttgccggaccgccgtcgttccgctggctcgtcgtcgaagagaaatgggatcaggagagagcgatttgggagctagggttttgcccctctctcccggtcggtgcttcatccgaggcagggacgattggagccgtccattagatcggacggctcagattcgcctagcgtcaggccgtcgccgccgttgattacgctgcgcctaatgggccgcggaagtgcatcggaccgtccccgcatatgtgggccacgctcagctgctcagcttgcgggccgtcgaattgatgactcaactcgccgaagatgggcaagcccaagtttgggctagcttgggaagacctatgccgaaagcaaatttgatcaaacaatgtggctcacatttttcaaattaaagtctgtcggataaactcctaggtaggctcgaaaaataaatctaaaactaaatcctaaatcctatgctaattgatcaaattagactcggttctacttatttgttaatataccaaattagacttgatttttacagatttgaggttttcaaggtgtcacactatcaaacgatgtttttccgttgcaacgcacgggcactattgctagtcataaaaagattaaaaaaaaggaagccggcagcatttgtagaagtttgaaaaaaaatattttaatagatgatttggaatcacctgtacatttcgacaatgctactgaagtagtggcgttaatgccaatgggctgtagtccacgggaaatgaagcaagcttggcccacaaaagatttggactagtcaaattattgggcctattgttgccatcccaaagggaaggaaattcaacactcaacgtcatcctttctgccgggtgttccagacttccagtgaaatttaactgcccacggtaaaatttggaactggccaattaccaaatatcataggaaaattttgaactttttaccagtagctagccggaatacttgtaaattcaactttaaaatatgtagtactaaatttacaacttctcgaccagcaggcgtccataacgatttggtacgacgtgcattaaccgagccaaaatgaggagcaataccaattttcatcctgttaaaacgtacacatttcacaaaagaacacatcttcggaagcatcacaagctttactgaaagtatgaaactacaccaacgatgttcagtgtaagaaactgtacaaaagaactttgtctttggatatccttgacaccttacatccacacacgtccagcttacacgttaactgttggctagatacaatttagaaaacataaatacgtgtgctacatgataaacgcagcttatctagatctgaagcaaaatatgatccctactgacaaactctacaatgtacgaggtccatggcctaacctagcacacgaagttagcctgtatatatatgcaacaccaccatacactgctgactgtaggtcagggcaatcatactttcactcttcaaacaaaatctgacactgaccaccaggataaccgtggcacagcaatctcctgaagtttggacagccctagctcccttggacaccatgatcttgccgaacaaactgacccttaacccgcggtcgctgctcggctagtagcttcctgctctggtatcgcacctgcacagcaatgtaaaaatgtaaaccacagtttctactattcagcaatacaacaaattggattggaataaaatggcaagattagttgcttgtgacctaccttcttctcaaagcacctgtctttcctcttaagccggaacttgttcagtgcagcctctcgttggctcaggtggcgtaaaccatcaggattttcaggaacaacatttgatgattcagtaggggcaatcatgtggttggaagagctgtcacagacactgccactgagcgtttttctggcgctgtccagcacagtgctgctcccactttcaccggtggttggagaaacatgccgcggctcatctgtaggaatttcaatgcggagatgtttccgattagcacttagatgactccgagcagtttgttcctctacattttcaacctgcttagtatccgtatcttttggaccattctgctgcagagaaattgcttgtgtggttgcgtcttgccaggtagatgttttgctattccaaatgggaggagctgattgtggatagaaaagggatgccacaggtgcaccgttccagaatggctgcccatcaaatgttagtcctccaacaggaacaggaaatggtacaactctaatgggaggttggtttgtttccctcttgtcttgagagggagttttggaatctccatttttgttttcaagatctatatgtgttgccgaggtgctgcatgcctgagcatcaccagcattaatggtagatgatgctgtcctgcagttgtacctatgaacaagaaatgatcggaagtgtgagatctcatatgttggctcttggtaaaactgtgtaaaggagcaagttaaccagtaagttagattatctaaatgcacaaaaagagagatcatacaaaaatttctgctacttccatattatttcatgttttattctatgcttgcaagaccatactgtagcaaatcaaagtaaaatatgtctacgcatgatggtaggtaaataaatgatgaaatatcaaagacgatattttttttctgttataccagtaggaaaaatacatcaacgcgaacata

SEQ ID NO: 39501 - DNA, 10699 bp, Oryza sativa
  unsure (1)..(10699): unsure at all n locations
ttcttcgttcatttttctcctggctctctaatctactgtagtcagatcttctgagagaaagttctaactggtgtgctggaatggaaaagcacttgtcatcatttccacgggaatttgctctcgcaacatccatctccatatgtgtgttattcttctgctgattgtcaataatatgaaccagctccatatccctggaagctttctcacaattaatatcatttgaacatgtcatcctcctcagtgatgcatcctcttccctccgtggaatcaagttgccatcattagatgctgcaaaacgaggaggaggtaatatcaggaaaaaaaatgcattcaaaagataattgatgatatgaccactttcagtgtagaagaatgatatggaaataacagagaaaagaatgaaggatgttttattaccatgaattttagtccctccatttttctcggtgttcttgtggtcaggcttggagaaatgccttcccattggctgcttatattccagtaaattgttggtttgcctactgtcagcctccagttctgaccttgtacatgaactctgcaagaggggatccaaaattcagtccacgaacaacagcgaacagatctgaactcagcataataacgacagtccctactgctaaggatataaagactatgcagtatgatgtcttgaagacaataacatgctacagattcagttcaagtgtgtaacatcaaatatccagtacttgaaacaaacaagtattccgtaataggctttatcaaactgttcgtgnnnnnnnnnnnnnnnnnnnnnnagcagccaaaaaaacttaccttactgttgtcatatgtactccattttgcaatacccaagaggaccgaactgtgacatttcgctgacaagaaaatactattctcactcaaaacacagttccattacccacctgacttgaaaaattgataaattagttcaccaacattgatgcagatctgaagggctaaatacatcttttgcatgaagtaataccatttttatcgtgtgggtaatgaaactgcttttggccaaaacatcaggtgatggaagtgttacagttcggtcatagctgggcaatgcaaaatgatacagcacaaatcccatacgtggctaatgattgaaattttgtacgcaagactatctttgggcacacatgagcaggaagaagaaagaacaggtagacaacgtcatgttaactgattctaaaacttacttgagcatcactttcttgttcactgcattccatgttcttgtggacaacattttcagtcacatgttcagctttcgtcactccggtcttctgctcatgcctttctgtaagattatcttcttgttgagtatgctgcacatcaagaacaccgctggactgtaaaacagagtaattgaagtttgttgattagttttgtgaaaaatgcagaatccaaattttaatatataaaaacgagaaagcaaatgtagtcatgctaaaacgttgcaaatatgtgatcttaccagttgttttctccaaacatgctgccataagttccttaattcattcttccgtattggcttaacaaggaaatctgcagcaccctttagcatgcatttgaaaaccatgctaacggaatcatttgaagacatcactgagaccaatagaaaaatgaagcatcagatggagtaatgggattagaaagatatgagaaaggcatggcatagagtcaagttggatacatacttatgacggggatattcttgcatgcgtcatgttccatgatcgtggagagcagcaggaacccagacatcaagggaagttcaacttcagttaaaacaaggtctatattgaaagatttttcctttagtatgtcccacgctttcacaccatcagaggctgcggcaactgcaagaccaaatatgttgcataagatcgacgaaaaacacaatagtataatttaaccaagatcccagagaatacgcgaacaaaccaagagatcaaaaaagaaggaacgtgcctaaataactgtactttaaaataaatttgctttttttttgttttaaaagaggaaactgcatttttcagctctaactctgtcccaaaaaaggatcaaatatacaggtaaacattttgcttcaggaaaaaaacaaatatacatgtgtagttatttcaatttaacacaagatacgaaatggatcgttaaaatacagctatatttttttcgaaaaaaaaatgatattcggtaatgcctcaacttaggtattcctgacgaataggctgcactacaccaaatttcgtctactgaagcagctctggcaaaataaagaaaaagagacagatagcaaggaattacaactacagaccaaaatcagcatattgattaacatatcttctgaaaaaaaaaacagatcacaaatcgtcacatcccaaatctccccacttgaggtctaatccagtaaaatcagctgccacgtagtaacagttttacagcgcagaaacatccgcaactttgcaacttcactagtgagattagccactcgtgacaacaattcgagcaaaaaacaatgaacaaaagcagtcaaccaatttaaccggatcaaaaacaaactgtgcggcacagacgctcacctcgatacccgcacttgcggagcagcgcgcagatgatgtggcgcgtggagtcgtcgccctcagcgagcagcacccgcaccggcatcctcggcagcatccgcgtctccctgctcgaccccgccgccaccgccgccgcatcctccccttcctccccgtccccgtcctccaagtccaccaccttcctctcctccactccaccccccattcccccgccgctagctccgcccctcgcccctcctcgccggagtcgcccgcggcggtaactaccctttcaccgcgcaaggcgcaaccacctctcctcctcctctctctctctcctcgagctcgccactaggaaaatggattggttcgtgggttcgcgaaaaccaaatgccagtgtgggcgacacgacaaagccgaagcggggggaggaggcgtgtgtatatacccccacaccaccacacaggcaactccccgtcaccgacacgtgggccagtcaaccagagggacccacccgccagtgggcgagcgaggcgaggcggtggcgggtgggggtgggagcacgtgagcgagctccgcgcacgaaatatctgtactacactcgaccggtgggcggggccgccacgtcacgcgcgcgggctgggccccacgttgacgtggcgtgcgcggcgtcagtggttgggatatttccgtttcccccgcgagatcgcgacgaggagccgagggctctcgaggccgatattttctctcgcgggagggacacgtggtaggcccggaggaaaaggggaccaatcttgcggccgcgcgggacgacacgtggcgggtggcgaggctaggggattgtgggggagatcgtgtggctggggatgggcgcgtgggcctccgctttgtttaatcgtgcggctggggatgggcggggtgggcccgggtgtagcggtgcgagtttttttttttttttggggggtgggctagtggttggcgtttcgtgcggtccacgataatatctgggcgggtggggactcgtggtggaggataattagcgtggattaagtatggtttaagggcggtggaatggaatgggtttagtgtgggttggaaatatctaattgactcatttgacaacctttgacaccgtgagcgagcccgtgacggatgtgaagatatttgtcaggaggattctggaagcgttaggtttcctccttataattaatcatacaagttgcaaagcaaaaaatattcgctaaattttatgattccttatcacccacatattaatagtactaatatagtgttgtggtaattggcaaaattacgtagcttgtcatattaagttgtcggtactcagtagtaatattgtgaatgcatgctttttattttttttagggaaaattgtgaatacaaactaaagagtggttgtttgttgagatgggcagacggggtgcaaaaaagaatggacgaggttgattcgaccaagtgttggcctacatcaaccatccgtgtgtctgtgtcctccatggctccatgcaccatcaacacccacacacacccacacacacgcaaaaaagaggtagtacactagtagtactactccatataggagtagcacactagtagcactagtgaaaacaacttttcgaacaagccgaacaatatacactcgcccgaagaatatccaaattccgccaacacacatcctgcgccacgaggtccgattcgatccacgtcgaataatgccgcagctgtactccacttacacattgttaagctacaattaccacaaacagtacagtaatactacatatagtagtagtacgtaacattggctctgtccgctagatatttccaggctccaaccgacgaagagacgaggagtcttatcggttgtccatattttctaataaattattttgatttattataaaaaaataatatataattaaaagttttatatatttgttcataacgacgtaaaaggtaacgttaaaaaaattacattgaaaatattttaaaatcaagtttgaaaattaaaattttagcttttattttgatttattagagcaagtttaatagtatagccagctactagctccaattcatttatagccatctaatagctcattcatataatacttacatactgccctattaatacatggtccacctatcatatacacactgcgtcttggagtctatattacagctggctataaatctgcagcccactacccttcactcttcttatttatcttcttaaaatatatttgcagctggcttataagctgctatttacctgctcttaggataaccgatggagctagagacaagtggcggcgaccgcatgccgtggataatccacgggccattggccgtttcgttgcaatgatgctgcctcgttgccgagaggaggagacagatagaccggctcgcgtcgcggctgttttgtgtggtggtagtcgtcggtggtggggtcggcgggtctcgctcgcttccgaaacaacccacttggcgtggccgggcgtggccggccgccccatgtttctgagcctccaaggtaggactcgatcgatcgatctcacgggaaccaaactgaccggatgacatggcacgccatctcgctaaatatcttgacggactaacaacgctcgccgttggatgcatggtagtagcaaactagttagctgctaccagccatcttttattctttttggttgttatcggcataattttttttaatgtctagtaatatcaaaaataggctaaatgcattgttgcaaaaaaagtattactgatatttgtaacaaattaaatgcattcgtatatttgtcaattttatcttaaaaatggtatggtccaaaatgacatcaactgaacaggttgttggccaaaatttaaattttaagttttaattttgtaattgatttttaagttttttttgttacaggttattttttataatgatttttcaaattaatatattatttataaattgtttttcgaatctctaataagtattacggcttattttttttgaaaggacagtattacggcttattaacaaagcgaaatgacttgccacaaagttgcaagcaacaatatcgcaatattcgtggggcactagctacagtacagtagttataaatggacagatggggggtcgagttcacgtggcgcggcatggcgcggcataaacctgtctacgaatttgatgaccttcttgttgttgctgctagagaagtcatgcatctaggatagtactggatgcagagatattttgaaactgtgtgcgcctctgcttttcgtcgctggggtcgccgattcgggcggtggatcgatgactggttgacggttgggtgctgtagctataacttgggagggcaaaatggtggattaattggatggctagtttttctccttgtggatgggggctggaccgctggaacgctggatggatggaccaaacatatggccaagcacgcgcgcgtgcgacacgctcgacgacggccgcacgatccgctagtggccgcggtccgcgatggtggcgcacggaccgcccgtgcaaatcgccgggaaatatcttcgcgagcagagagatattttcgccttgatctcgattacgcaccccgatcttttttatggtcgatctccaggctgtctctcagtctctcgcgtgttaatttggagtgagtacgtgtaaagccatttttttccgcgctatggccaggctcgcagcggacgtccacatccacagcctcgatcgcgattcgcgcagcatgggttgtgtttggttggttttgcaagggtggcatgtgccgtgctagaatcggacattccgcaatgagaccgacgagagggagatcgctcgatcgatcgatcagtgaaaggtgctttagctagcatagcaagcgatagctaagcaggcacagtggttgcccgaccggttcggcgagatactactgtacaagtggatgatcgatcgagcagctcgcgggcgagacgaagctcgcgggcgagacgaacgacaagtgaagcggccgtggccactagctgtagcttttactagctcgttctcttcgtgatctctttgggtggatcgattgaaacgtggggacggaggaaggtccccatcgttttctctaatatagcattgctaaattttgtttttttagacttaattttagtttttttatcgagatttattttttaataatggtatacaagtcgctaggtacgtatatataaaaatctacctacaaaattattattattattactaatacgttgaatgacgtatgtgatgaggacggagaatgctgtgttgttggaggaagtgtggtgtggttgctccacgcgtgcaccgggcgttctcctttctccggtgatacgtatacacccaactaggaggcaaaaatatctttgctaggtctgcgtggctgcagttgacaagtcctagattttttcgaaatatcttctcgatcggtctacagttctgtgggtggggacagcttcctagatatccggcagagcactactactattatcctacctgatgcaaccatctggctgctggccacatatactcgggtgtacatgcgtgtggttatggatcgatataatcatttcaggatcactcatcagttaaggttagtggtgtgttgccgcgggctattagaatttagaacttagaacttataaacacttcaatgaatgactgtcacagttcgatgatgtgactatatatggccgtgttcctccctcattaagatgtagattataccttagattttgtcaccatgttttttaactgctaaacaacgtgcttggtacgaaaaactttctatacaaaagttatataatataaaataatttttaagtatgtaataattaaaacttgatatttttactagttaataattaaaactcgagtaatcatgcgttaatggttttatcgttttacgtgtgcacttaaacttcattcttattgcacaccacttatatatgaaatctcatttttaataattaatattgactgaattacaactatataaaaatagaaaatatgtgccgctctagctgattttcttatgtgatcaatcataaaattcagatataagataccatatgatgtcttgaaaaagatattacgaactctcacctgtacgctatctcctgaacaaacataaattctgttcaaatgtgtgttttgagactatttgaagccagcagcatcactccatgttctctcttcctactctccatacttgggaagttgggttgaagtgtgaggccgggaagaattcaagacatcatggtccacagcccatatgaatggcccgagacaacaagtagcctactaactattaggctccactttgggccaagcccatgttttgttgggccggagcctacaccagtacaccaccatcttcctcgttcggttcccatctcccagttcgagcccacgccatcacggccgcgccgatgctcccgtcgccaccggcgccgccgccgatctcgccggcgcggctgcacaagctcgtgacctcccagccggacccgctcctcgcgctcgagctcgtcaccgtcaccgcgccgaccaccgcgccccacccgtcgacgctccacgcgctcgcgctccgcctctcccgccgccgcgaacacctcccccacgcgctcgcgctcctgcgccgcctcccgtcgccgccctccccgcggatcctcctcccgctgctcctctccgcgctccgcctccgccggcagcctcacctcttcctctccaccttcaactccctcttcgtctccggccccagcccgttgccgctccaccccgagcttctcctccgcctcctctccgttctctcctccaccgcttcctacttcccgtgcgcgctacacctcctccgcgacgtctccacccgccttcccctccccgagccgctcgtcctcgcctcgcacaacctgctcatcgaagccgccacccgctccggccacctcgccgtgtcaatctccctcttccatcgcctccgctccctccatgtgtctcccaacgccgagacataccgcatcctgacccagtcactctgccgcaggggccaggtccacactgcggccaccctgctcgacgaaatgctccacaggggcatccctgctgacccactggcatacaccaccgtgctgaatgcgctctgccgtaagaagcagcttcgagaggcttaccgcttgctgtgcctcatgcgaggccgtggggtctcacctgacattgtacattacaacacggtcatcgtcggagtgtgtcgtgagggacggccactggatgcctgcaaggtgttcggagatatgagggagagtgggtgcgcgccaaatgcggtgacatatactgcggtggtgaatgggttgtgtgtgaatggattatatgacaaggcagaggcataccttgatgatatgttgggcaaagggttactaccacatttctctgtgttccattcagtgattaagggatgctgtgcagttgggaaggtcaatgaggctgcagggatgatgactcgaatgcttgatcttggaatggttccacatgctgagacctggagttcagtgatcaggagtgtttgtagtgatgaggataatgtcgaggtggttttgttgcaagtgatgaaaggaataaagcacctctcaaacataaattcaaggagtacttggacatgatatcatgtggcatggatgcaaggaacacctattttatggtgtgttgtaacaatcagttttgaaaggaaacagtagatgatgtgcaaaatgtggaccacaaccatttttctcatcgtatgcagctaatttgatatttgagtttatttgtttatatgcaggttaggagatattgtctgacttcaactaaggtatgctatcctattgcaagaaaaaaaaagttatcgcccttaattaatgtgattcatatgattgttttggtagtacattttgaaggttgattctgaatttctgatgcttgttagttaaagaccatactttgttctactctgaatccagttgatcatttatactttttcttatgcctcttcaattgtgtgcattcgcagatcttataatctgccaaagcccaaagattttggttcaccttggttcatgttttctggattttgttagaccccagttctgtgtactttgtggaaactataatgttttggcagcaggagctgactcagctgagtgaaggatcagcaattcagcatggagatcatctcacggcaaatatgggaagctcactggacgttggctgaattccaactgctgttgtcaaggtgcatctgatcttctcacgacaagcatacactatacatatcgttgcaggtgcagacaaaggttttacgactatttgatttcctgatacaacgcggcaaagctgctgggatctggatggttcactcgcacggcttgctacatttttgtgcacccactgacctcgtcgtacttgccgtgcccggtggtatcctctccctgtgactgcataggtagtgcggtactgcctcagagagttttgtgtgctgaagtagagaaatttttgtaattctattttcactgggtgatgtacctttcaagaattcaaaattaccagcgattaccggtaacagtggccatgctatgtactatgagtctatcttgtatagacttagaacaagccccccttcattcaggagataaaaaaatgatggattcttgagattttagatttaaaaaatgattatgtacacgtattggaaatgcaaacgtgtaatcgtattgtactgattatgtaatgccatacggtgtccattgacatttgcttattcactctggactactcgtttcgtgctgaatcatttgcgcctaattgattaggccatgtctaaattttgatacaaattcctgctaatttcagaagagaaaaaaaaagtggtcatgaatagggtttaccaaaccgaagtggtcatgaatagggtttaccaaaccgttttcagtgggttactatcctcgctcgatttgacggttatcacagtaactaccgtggtttaaaactgaaatatttaccgcacgtgatagccgggcgataaccgtgcggt

SEQ ID NO: 39502 - DNA, 2288 bp, Oryza sativa
  unsure (1)..(2288): unsure at all n locations
ctgctgctgctgccgntgccgccgccacactcctcccatggctctcctcgcgntccgcctcggccaccaccaccaccacctcggcctttccgccccgcgcgacccccgcctcctcctccgccggaggctcgtggtcgccagctccggtgccgtgaaggcccccgcggccgcggcggtcgtgtggttcaagcatgacctccgcgtcgacgaccacccgggcctcgccgccgcggtggctgccgagccgcgccggcccgtcctgccgctctacgtcttcgaccgccgcatcctcgacggtacgctgctactactgcgcttgctagccccttgcagcaaatgtctcactgagccactggttttggaatgcccgggggctgtgggaagtgtgtgcgatgtgttcgacacaatgtcttacggatcgcgcggtggtttgatcggacgcttgcactttggtgtttactgtgtactgtctctcgcgtgcccggtaacctggctacgttttttttttttgctacgtttgtgcaaaatctagtgactttgatgccaggattcgtggttttgtagaaatgtgcagtaaaccgaagtcgtaggttttttggctgccgaatcaaagtgtaagctgtggattggttgtagtgcgggatgatactttctggttctgctaattcagaaattccctagcataaaagtgaaacatatggtttgccttaaaatagacgctagtaaatggagagaacaactgcttttcagtcccaacttcttgaggagacctgcacctccactatctggtatgtgccagatcatgaaggttttgattggaatggacgagatcaagggtgtgttttatcaagtcatgctgtggaaatgggtatcagaatctgatgttaacattcatatacaagtaacagcgtgcaaagttatactgtaatctgtattatgcagtgcaagaatcccaagtaatcacactgacagttggcattgacattagcctttttatcctttgcaggttactcagacacgatgctggaactgctactttttgctttggaagatcttaagatggttttgaagtctcaggagtctgatcttctcataggcttgggaaatgctgaagatgttgttctcaagcttgtaaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcattcctatcgggaaaccctcctgagatagtggtttggagtgcctcattgtatgactacaaggtaattttgtatctcaggttatcattccctattgctatcctctagcaacctaattatgtttggcatgctaaaatcattccaccagaatccgagggaattgtcaacatcacacaaccaatttttgaaggaaaaattaccgatgaacacacctcttgctgccccgtctttacctgctctgaacatagagatagagacaggtgtatttcagttctcttttttttttggttagtgattatatccttgatcatttttggtgtgtgcattatgataccatgacaatttcctgttcaggttctctccccacactggaagaactaaaagggtttcttaaagagagtagaacgtcagagaataattgggttcctctcaagggcacatcagccagatctattcttaaaaagactctcagccagataaatgtcaaaaccggtgttgcatcaagtggcagcgatggaggagaggataccactgcatattatgctatgtcagggaggaagatccaaaattcaatgttcacatcagaaagctcaacagaagttagaggtggaacggaaatcactttggatgctttagctgcatacctgaaatacctagaaggaacagggaaggctagttggcaagagtacgtcgcaccacttctttttaaaatctaattacattcagcactattggtatgtttgtaactttgtatttgaaaatgttgcctagctcataaggtaaatgcagtctatgatgtcatatcagtcatcaatgatttttctgataacaggctttgtttaaatttcatatccaggttgcatgataaagtacggttaactgaaactagagatggtgcctcgttttgcactttgtttggtcctgcacttcagcttggagttat

SEQ ID NO: 39503 - DNA, 1012 bp, Oryza sativa
atttaaaaatgagcaatcgatagaacacgaagcaatgaaacaacttaaccgatgaggattacttcgagaatgataaatattttggtgtccttgatcttaatgtcatttgcttagggtatatatgttcaaacttggatgaggagagtaatttagtaggatcatttttataaattctaaacaagtaaaaaaccaaaagctacaatgatgtttgtgaaaaaagctagaggggttaaagggattccacagcctctcgtacatagctccgccactgccctcgagggtgtggagagactccgttgttgggatgcatgaaataacgtcgtactcctcctactggtactcgatcaattcaagctgcatgcacgcctgctcgacgaaaattactctacgtgcggaatcaatgggcaaaattttagtcttggaacgaccataaatatcttcattgattttcaggttatattcggtgcagctgtattaaccccttctcacagtgcaccaatttttttaaaaaaaataaaatgtgaaatttaccattatttgtttggaaaatgcaacgctttatctatctgaaatgatgatgcatcgatatgctggagaccgaacatgcatttactacaactaagcagtgcatttactcaagccgccacggcgccggcgctgctgcttccccagtatatttcgcttcccaactgcagatacacctacgatttggttctgctaagattgtgtttagattcaaagtttggatacaaattacgaagtgaccaccagttctactcctatagtagcagcagtgcagcactcctgctactgttggatgcttgaaactgcaatccacggatgatcctggtcgacgtcagcgtagtaaatgcaccatctccttgattcgaacttttcaagttcgcagaacggtaaacgtacaaggcatgtgcatactagtatatacaccgtactcctccgtatgtactgtacgtcttgcacaccataaattaaattggaaaaaaaaggttta

SEQ ID NO: 39504 - DNA, 15099 bp, Oryza sativa
tcctgcaccccatacaaccaaaatcccttatatttagggatagagggagtacatcgtactattgatagcattgtacgaaaaaactgtagcacggagtactatgcacaattttacattagcgtatactttctccgtaaaaaaacgtatatagaactggatgtgacacattttaatataacgaatctgcagagagatagtttgaatgggacggagggagtagtttgaaccattcatcgtaaaaatgaacaatcaaaattatacgcagtcgtttaacttaacgttacaagtataactgaacttgatctgaatccttaatcgtagtgttgcgaacgctgtgcaatttttgtgattacgtgtgctctccagttcatccaagtaaactgccaagccagcccatgtccccaacgccacaatcttacagggccggccccactggtgcttcgtttcgcatgggccaaatgcagcaccgcttgccagctcgtaattgcggcccattaacctaaatgggccgatcgagtggtggtgcagcccaaccacaaggccacgacaaaaaaaacgtcctcctcttcgagtcgtccgcttccactcacgccggctcatcctctctctctccaaatctgtggacatttcacgcgcgctctccgctccagcctccagccaccgcccaccggccggcgatgtcgacggcggcggcggccgcggcgtccacctcgctccggccggcctcccagtccgcgctccgtctcgcggtttcgctccctcaccaccttcgtcgtctctgattctgtgtaatttatcatgcgccttcgtctaaccgagtagtcttccccggttaaatcgcgcagggttcgccgcggcggtggtgctggggagccccggcgctctcccctgcgaggagagcattccacgcggacacgcggaggcggttcgtgttctctccttgggcgtttgcttctagtatggaatggagttgatggccttttgtccgaattagttttgcttcctgtggtgtatttgggggaagtcatcgcagacctgtggattacccttcatgttgcattgttgtctcctgtgggattaagtgtttcatgagattggggtatttcgttgtagattactgttctatgcttttaaattgcaatgccggtaattttgttgctacgagttattgttcagagtagattacttctataactctcgctgttccattggagttgcttatacagtgcgctctctaactgccaccagcacagttcagatgttcttcagggtgttttagtaacatgagtttctacggtcctgatgcacatttctgattcatgtgcaaatctacatctaccattcattcctaggatttcatactatttggtagctgcaatgcggcaggatctgtgatttgcctttccgaattcattgtgatggtgcaaatagacagatgaacagtctattattattcttaatttaagaacctatgtttgtattaaacaggaagactttgttatatgcaactgataaaggcccagaagaatccttgaagaagacaattgaagttgacaggttgatcgagatgctgagggatgcaaatcctagagaggtaactcttcatatcttcaatctgactgtttattctactactctccatcccataatatagcaacgtagtgctggatgcccgtatccagatccatagtactagggtacgtcccatccggtcctaggttgctatattatgggacagaggaagtattagataaggttacagtctcaggttttacaccacactaaaagatctctccattcaattgtaccaatttaaatctgttaccaaacctctatagtatataattctccttgctttgagcatgcttccattagttcttggttcaaaatctgtagaaccaatctaagcagtacttgatgacttggtcgtgggagcattaagcctcaagttctgtgaacaacatgaactgttcaattttatttacttcggagttttcatatttacctttagtttcttatcaggtttattttacgcatttagaaatatttgaagtatgcttatccttgtcagtttatcactagattttattattatgtctatggtaattctaaatactggagcattgctgaacagaatatatgcagtttgttttattttcatttaattgaattaagccttgctttgttttgaaattacttttgacatgaaaattacttgatcaacttactaatttacccttccttgcatgtgacagcttgatcaaatagtggttgaaaatgttctggcgttcgatgagggtttctgggttcggctggcagcaagaattgatctatgcaaatcggatgatgataaagcatggttttcacaattggatttcttttttgttactatggaatgtcgatcccgttctcttagctcgattaatctaactttgtgaatggtgtctctcttctgccttttcagaaagactatgaagaattggctgaaaatgtcatgaacatagttgaccgtcttgtccataagactgatgtaagaacaatattgggtcacattatttgtattaatggcaacacttttggcatttttatcgtgatcagaaaagttccttgaatgctgctaatatttacccttatctattcaggaaaagattgaacagtcaactgatgtgctgaaggcaattattagtcctgtgatgcacgaaggtgaaaacgccacgtggccaccgagagatccggaggctctcaaattgatggagaaagtaagaacgaacatagctattttttcactgttattctttactgggatatttcatcggtgccttcctatgaatttggtttatttcacattacctcacacatagcatttagtcgctttaggcaagttactgttttggttggctctacttcacatgaaacagatttatattccaatctgtagtgtaactagaaagtgccagttttatactccaatcttgtatttgttttttatggtgtcctggtatcgccaggaaatttcaaatagagaaaaagaaggacagctagacgaaggatttctgtcagaggttaatgctcagttgaggcaggtatgtgtcattttctacattgtggattaactttgttgatatattactcagcatagagtagttttgctactcattttactattacacccttacatgtgtttaggctaaacaagatggagataaaccaggacttcaagctatgctgcagaaggtgttgcagctgtatgcgtccaattttctccaaaagcgtagttacgcttacaaaggtaaatcctgttcattcgttttggactgttgaaccacaaccactgagaatgattaccctttaaattgatttgtctatctttcattttcagggggagaagtaatagtgcctgaaagttttcttgaatctgtaataaagggtatgtatcattgtgcggagagattgtttgtcttcaatcaactgatctcaacctttaatatatccagattgtgccttgcagctccggaaaacgagtggaacaagctgttgcttgatgggttaacagtggggaaaggaaatgtttcaccagaagaattttatgctgttataaagaagagaattgagagagtcttaattcgcacagtaatatcccaacctttggagttatacagagaacgcaatctcttttagtttgtcaggaccttgtctttagtttagcatcccctcagcacatttttcatttttcctcttgttatctttttgtttgacaggaaggaggttcttatcagcagcgcatactcgttgaatatctaaaagagatacaggctagagcggaggaagttgtgaaggtgcttcaaggaccaaccatatgatgatgtctggtggtcgattttaaacagtgcaggttatccagttcgatcatggttttgacgcatcacctagcaaaagcttagaaggcgacaacagacaacctaactaggtatgttgttcttcgtttggtatgccgttgagaacactagattctattacttgtctgcacatttttacagcctctgcctctcagttgtctgattcaggaacccgagataagcatagcgagaagagaaacagatccaaatgtcctaaaggagtgcgtgattttcattccccactttggtcttcatctcgaatggccgattttgctgttggaatgtttgatttctgttctgtctgattgacacttgacacgagtgagcttgactaagctgtagtaacatgtgaatcggtttttgttgtgtaagggagaaggttcaatgctgagcttgacttgttactgaggtgcttgttgaactcattttaagttactgatccctgcaactgttgattatcctgatcctgatagatcattgacgattcctcgtattccctcgttacaacttacaagtcattccgctcgtgactcgctcgcaactctgcagtaaaatgtttcagaagccgagcctcgcactatatatttaatgatatatagtgaaaataaaaaaaactattgttggatctaaaaatgaaagtacaagatttatccacgcaaaaactatactcctaaaatagtttcttaccctatatcgtagacaagtcttatacgtctatttttttaatcaacgatcatataatttgcgatgctacaggcctcatctttttaacttacgcttatgtttatcagccaaaaattgaattttcaatcttaataaggttttttcatcgaagtttattttccagcctttgcttttagatcactaaaaatacgtatataaaaattttatttataaattacttttcgtttacaaatatgccgattcgctgggctccggtagtgttttcataagatacaaagagatgaggcgacgtgccgtgtattaattggttggcttcaccttgtggcagttggactctgccttccaaaatactctaccaaaaaacagcccaacaagtgggagaatcggcttttctcttcccttctcttccgcatgctggtcgccgccctccgcgtcccggcgccgatcccctcgtcgctcccctcgccggcgcgccctctcctccgccgccgcagcagccaccgcctgccccctccggccgacctcgtcgatgcaatggccgacgccggcggagccaccacgaacaggccctgctaggactccttcccgtagctcgcatagaagccgctccccggcgactgctgcggcagcggctgcgtccgctgcgtctgggacgtctactacgacgagctcgacgcctacaataaggctctcgccgcccactcctcgtggcatcctccggcagcaagcccgctaccagcgacggcgccaaatcatgaggcgaatcaggattcaggagttctgaggacgacttgcagtatgcgtcccttcctctcttttcattttttttccccttccccaaatcggggtcttggtgtggtactcctaccagctagtagtattaaaattactcgtttgattatagtgaaacatttgtgttatctcattgtgtatgctgcaatttgtactagagtggaatggttgttgttccaacgaaaaattccctgattacatacagagaattgttcatggatagttcttgtgtaacaaacattagcattttggcagaattcttgtaaacaaacccccaacaaatcacctatgccattagaatcaggagaattagcgagtttaacttacatcttgtcccaatatcgatggggactacaaggagtcacaagacttgttcaagcattgacgtagaacttactgattattatcctaaccaccaaagggatcctcaccgtgtgagtgccatcctcccatgtcaggctcccgaaggtgtacctccctttcaccttcaatttggcctggaatgtcaccttgaatggcaactttctgacggttgagttgaaggttaggagcgaggggctaacggtgacgtccacgcctggaggagcttctacacgagctctgtacttcgacaaagcagggccgacgttggtgaccgttcttgacaccgtcaattttcccctcagttcagggatggtgatggatggaacattcaggtttaactgcgattttggcgtatgttgacatgttgtttgctgttgagtcatggagctgatggctgaggtgttgtaacccatggagcaaaggaagcgcatgtagtcagatactcccatgtcatacacaagaccggggtgcgcagctctgtttggattgacatggccacctccataatcaaatggatttgcgtcattgtagggtgctgcctctgataccatttcaaacccatatgcatcatgaacattggctgcaaagatgtagagttgtcaggtgaaggcaatctttggtgtggtgaagcagataagcattatggtattacctgtcgtgaccaatgctgatttcactgcagcagggctccaattaggatgcattgatttcagaagagcaactacacctgaaatgtgtgggcacgacattgaagtcccggagtcaatcttgaagttaacagatccaatggccgatgatatggcagcagcaggtgaccatgcagccagaatgtttacacctggggcggcaatgtctggctgcaaaagaattgatggcacgggaagatttgattttcctgtcacatatttgatcaaatcaaaggataaacttagttcatcaactaaaggagatgccttaccttcaggatagagggggacaaagaacttgggcccctagatgagaagtatgcaacttctggggctaccagctctccaacaattgtttttggaaagctaaattgggccactgggtttctgtatttgcaaaacaacagttaattgcatgaacccataattttcacacctggtggatcatatccaagaaagttttgtgtacctcatgcttgtcgtgtatgcaagtatagctgttccaacttggtaatccacttgaacacaaggaatatcaagtgaagatgctatatccttggtcaagaattgcgcaaagatgactccaacacctcgagccttttttacagtctctacggccactgaggctgacctctgtgctcttgtttggaagcaaagcactacatttccttttactagagtagcattcagagatcctgcagtgcagcttctgcaaagacatcagcccaaatggaagttgaaattgtaggatggatccaaagtgaagagaatgacaaaggttaccttgcatcagtatcgtcggcattatcagatgaaatgtcttcagcatagactatacgcacactttttgaaggatgctttccagaatacagtgtttggccctgcattatcatgccatcagaataaagaacaatgtgccaaccatctgcaaccattagtgtttgaagctataattcagattacaccataccacgtaagtactattgttgccaagaatgatctttgcaaggaatatccgatcaatggtgcccgcagcaacagtgacaatccatggggccgagttgatcaccgtctctgaataaggaccggagttccctgcagaacaaacgacgacgactccttttgcgacagcatggaaggatccaattgacaagacatcatcaacataagcagggagaggtggtgcttgtcctagggacaccgagatcacatcgacgccatcgtgtatggcatcgtcgaaagcagcaagaatgtctgcagcggtacaatctccagtagcccagcatactttgtaaactgccagccttgccctctgtgcccctccccttgctacacctttggcaaggcccctgaagctggcattggctaccagagctccagccgctgtggatgccgtgtgtgtgccatgcccaacggcgtctcttgccgacatgaactcatagatatcactggtgttcatcttgccgtactcagcttcataccctttgacgtaccatttcgcgcctattattttcctatcctatcatgaatctgaagtcaccaacagaataactagtagcaaaattctctgttctcctattgcagtgataaaatttcacaagcaaaatagcaatgtgaaactgaaggctcaagagcaggccaacctgttgcagttagaggcattgaacttctctccggcgacacattgccccttccagcgccgcgggacctcgccgatgccgtcgtctctgaaactggccgactccggccagattcctgcaaaccaagagcatctcaatcctcacattgtaatgtcagcatcaattgcaaactggcaattgccagttctacacatgatgaagaacaggtgagttcacctgtatctagcacaccgatgatggaatcctccccaaatctgctctccaagaggattccaccacctgaaggcgacggattcacccccatgaaatcccagctcctggtggtgtgcaggtcaagaacacgattccgaacaacccgcacaactccaggccaatcttggtgacaaaaaaaattcaatccagcagaagagtacaagaaaaacagagtgagagagatagagaaacataaaatcaaattttggtttgccaagaacagcagcaagatggccggcggggaatgcggcgagctcaccggagagccgcgccgcctggccgccggtgagcacggcggcgaagccggagaagccatgcctgtagctgtagaggatggcatccatggccgcctgctcgctgcaaagcgcaaggcaacagtaaaccacgccacatctaagcaaccaatgctccagccatggagaaggaggagaagaagaagaagaagaagaagattgcaacctgccaagaacggcggcgagcatgccgtggtgcgcctcctggaccagctccggccgcagcccgtggtgcctctcccccatgtacacaatgtacacctgcagagagagacgccatgggaccaaaacagcgtaagattgacgctgccagaagctttcttggggggcagaaatcatcaaagcaaagctaagaatgtcccggttaatggctcacattgctgcgagaagatgagcagggctcgagcagcatgaggaggaagacgatgaagagcaggggagacatggccatggcgtgtgatgagtgagcgtgagctcaaagagggaagctgacgctgataaatttttctctctggagtactcgtagaggtgaagtggagtggtttgaaagggaggagctgagctgaggctgaggggggttggtcggtgtgcaggaggcggcctctcttctctgtctgcttggactggattcaaatctcccactaaatactcctattggagcattagagcaagtttaataggataggccactactaactccgaatcatctatagccattgtaatagtctatttatacaatagttgcttactataatattaatatctggtcgcacgtgtcatacacacattacgttttggagtccgtgctgctcttctctcttttcctttatctctttaaaatatatttatagctggcttatagcttgctattgtaccaacactagtatagggcaacaacaatatatacagtaaaagtagtccatatagatgggacccacacatatggactataactattgttatcttcacaatgtatatagatagcaactagtattaagaggagagaggaaatagagagaaataacatattttattctatatgggcaactcatatgcttatgggtggcttttgctattttcttgctatggactagttccataatgttgttagatggctaaatagaatattttattgcttatgaactagttttagactacattgtggatgccctaattacgactctgcaactgcactgtatgcactgtgcggccgtgccccagtggattggtttgttttctgtttgttcttcgtcctgacctgacgcagcacaaacgctcactggtttgtttttttttttttaaaaaaaaatggggctgtgaggtgctcactggtggagtggcgatcggtgtcgtgctccctcaccgcgccgtattgctgggtctgcgtgcgatgcgtgtgtgagccgacgatgttgccgttcggccgaacgcgtcttgcccgttcttttgcttgctttactcgatactctcgtactagaactacaaatctatctaaacataaattttatctgattctaagttcttatattttaggatgaaatgagtatttgcttggtgctcagcttgcttggccatgctctttctaatttattcacaaaatggttatttgctcaaagttttctaaatacattttctaaaaggaaattcctacgatagtttgtttttaaggtatttattaggcgtgtttcttaaaaaaatgatgataattaagtagataattcgtgatataatccgtcagaggcatatggttgtttcgtagctagcgtagtggttcttcggatggaaagagatggccagtttgttctgtgcggtgttaggtttgccaccgacgcgtacagtgaccattagtcacagggatatactgatatgtcctcatttggcttcacaacttcacacggattttgttaatttgatttcaccagtgagcattatggcgtgtgccgagcagtatcttgcttgtaacttgtttcaaactcaggtgttccttaaaaatgaattgttggatcgtcctccaatgggtatgtgctcgacatctgtctcgaatctccctggctcaggcacatgggtatggttattttttatgcagaagcagactatcatttcttatgcagaatgcagataatgttattgtcctaatcacttctcattattttttttctatcctggattaactattagtacaagtggaagtgggaacctcgtttgttctcatttgtggaccagaagaaagtggcacaaatggaactgtataaaaccgggaagttccatataaaggctgtgtttagttcacactgaagtttgaaagtttggttgaaattggtacgatgttatagaaaagttgtgtgaatgaaaggtttgatgtaatggaaagttggaagttaaaaaaaaaactttgaaactaaacagggccaaaccctactcgattcagaatattcttggtagctatacatagagcaaaaatattatatcttcatgcactcatcatcttttactttgcgctgcaatatgaagtagtagtgacatcaaaatacctttatggcaatcaaaaagattattgatatcatatcattttattaagctactgatagtggcactatggacagatgacaggcaacttgcgttgacccggagagtagacttactccctccgtgtcaaaataaaccaatctcgtattaagatgtgacacatctcagtacatcgaatctggatatagaccgagtttagttctaaaatttttcttcaaacttctaacttttccatcacatcaaaacttttctacacgcacaaactttcaacttttcggtcacatagttccaatttcaaccaaaatttctattttgacatgaactaaacacacccatactctatttttatgaggttgacttattttaggatggagtatgattagtgggctgttttgttttcaagttccaacagggacgctgctttctccttcagtgcttgcactttaaactttttatgtgagaagctcaggtcactttaatggcgtctggtgttgagaggtagcagtagcatagcaatagcaccgttgtttgcagcttgcgtgggtccagcagagcagctgccatgaaccggaggacgagatcaccacctcacaatttggaaggcctgcagctttgcatgggggccgggaaaaaggcaaataattccaacttttcggcaaatcattcggaaaaggcagcgaccaaatttgaaaacagcacagcaaactgcttaggttaagtcagaaatgttcttttagcagtagtcaatgcctagtagctggtcagactttaaatctacccttaaatattacacatgcgaatgcgcttttaatactatcaatattactacatccgtcctaaaatataagtatttttagctataaatctagacacgggtagtacacatgtggatgtgcctttaatactatactcacctctttactccgtctcaaacaagtgcttgtccatttaaaagttgatttttttcaagaacagatgaagtactacactaataagttctattgatatttgtccgtttaagcatatatgcatgtgatgtgtgtattttatgtaattttgaaaaaaaaattatatgtttattgatgtgttcaatactcatttgaaatgcaggaattaatttaactccaatgaaattctagcaaaaaattctttgttccgaaggagctctcaaggttgggtagggggcactactgccgctgagtattcctcgaatgcttcgtgaaatctctctcgcatcatattagtgctccacttggagcacatgattttttacaagaatttcaccggaatctatacggaatttaagaaaaaaaaaactataaaaacttggcgttttgagtactccaggctagctagagtgccgtttgatcggcagggagaagtgggggaggtgcgacagtgtgctgcagtaggtacgacatttactcggtacatttgctttacatgcgattgacgtgacgtcgacttcaccattcaatcatcgtcaccgtaaagtttgaactcggctcggcgaccatacggatcacaacacaacgccatcacgtgtgctccaatcaaatctttcctcctcatgcctctgcacaagtgcagactgctgttcaatgttcatctctgaaagcattcgaggagtaactcaagagtcagaagtgcagaacaacggcaagtatacagtgtcaggactacaagtacctgctactccattcgtccttaaaaaaataataaataataggttttcgtatctaacgtttgactgttcatcttaatataaattttttttataattattattttcattgttgttagatgataaaacatgactaatattttatacgtgacttatctttttaattttttcaaataagacggatggtcaaacgttggacacggaaacccagtgtctgtcttttttttttttttgggacggaaggagtagtaaaggagtagtatttagtacgagagagcaaaagaacagattaacatactcctaatactattatggcttttcctgcatggtgaaaacgataaccatatgctactctgtacgataataagcgcactattggatagcactcttctacttatatctatcaaccttttgccctcaaggagttaacagttgacatcattcaacatttcaccgaccagatcccatttttgcttcaatgaagcaggaaggctgtcgcatgtacaacattagtttgtatctggccataacattacaaaaacgatgcaagtccaatggaaagaattaagagcatccaagaaaccgtccatttttgctcaatgtggctcggcccactcctcaatagggatgtggttattgtaatttgtaaggatatggcgtcaggtagtcttctgtatctcatgtcggtagcaattttcttcagatctccaactgaacaacgacgggcaagcagcatagttcctatttaggtggtcgacggtccgggtaaagtatgtctgcgacgttttccttgatgtaaatagctgtcttgtttagattctttgcaacgcctgaagcgaccaatcccgcgcttttcctaaacctgcagcagcctcgtactacatcagtaagacaatcacaagaaagggacaggaaggggaaatctgaaagctagctttcctcgcatagaaatcctgtcctgtaagttgcccgggtctttgtccttgttgccgagagctggtggccgctgtaataagaaacgcaaatgtattaaacatcaatctaaacaatgaagaaatggtacacccaaagagatgggtcttattgttgtagaagaacattggccaacaaaactgaaccaaactctcaacatgactgataatttgacttaacactccatttttcccagctaataccatactattagcaaatatttctatagctgtctgtgaacaaaagaacaagtttgtacatgactgaaacatatggttaaatggaaatacccaagctaaagtttacagaaatgtgtaattgccaccgtcaaatgcacatgacctacctatggacttaatactgagaaaatggagcttcaacccaccttttggtacttactacgtccatcccaaaatataacaacctttggctatgaatctggacacacatagccaaagttacttatattttgggacggagggagtattaagttgtaacatattgacagagttttaaaaagtttgatcattcataaatcatttgaaaacaaaactccacaattacctgtaccaagtcatcatagagttttattcaactgtagaccaaatatgaagaagttgtggcatcaagagaaatactttagcataccttcctttctataagaggcagtagcaggctcattatttggtgatttcttctcaaccaatctgctgtccaccaatagctgtagtgacatttttcattgtcattagacagaagcaaagcacaaaggctagcacaaaaaagatttataatgactataaaatatacacttatacatgtatgtgttttcaataaaaaacagaaactattaagaggcataagtttcattcatgttgttctcagagagcagtgtcaataagtgaacagagtccaaccaccaagcagtcagaaaaagaacaaaattaccaaccattcttcaggttgcacaaatgtggtcccacctcaaccttataggttgatgatgccaaccaatatcctacacatggaaatgcaagaaaagaaaatccttctggatgcttatgaatgaaactagtgctcaattgcaggatcatattgtagtttacataaagaatctttgatacatgtagataccaaaatatgcctagcatgattacttccagtattacgcaatcagatgttttacgtgtgaaatgtcgtattataggtttatgtaaagaagctttgatacacgaaaatcgtaagataggtctatcacatttagttacagtgcttaggcaaacatagatttttgtctgaaataaaaaaaat

SEQ ID NO: 39505 - DNA, 4689 bp, Oryza sativa
  unsure (1)..(4689): unsure at all n locations
ctacgagatggaaaccaacctcaagcccctggcaatatggcaacaacgtcttgccctccttctcgccgcttcggccgtctttgttatccaccacaaacatggagtaaccagcgcaggcgtacttgaactgcctcaaatcatgcccctgcgccgccgcctcttctctgggctcgtccaccacgtagcttgggactggagcaccgaaccaaacaacaacagtttcgtgagattctccgatcaatctgaacccgaaccaccagaaatcgatagagacaatttttgccgatggattgaaaacccgcacgccgatcgatcgcgcgctgcgattttttttttttggggggggggggggggagattagggttcgtttcgttttaccttgggggatggagcgcgggatccccacgcagacggggttgaatccgcgggatctgagcatggacgagtagtagaggcagcccttgcaggatttccccctcctcggaagcgccgtgcccgatggttttccggccgccgccgccgccgcgccaccgccggccgccggcgattcctcccccatatcgcgctctcttttcctctctcctctcctctcctctcgactccccgtgacgaagagatttcgtcgtcaaattttgtcctcccctgcgctggctgacatgtgggcccgccaacctcggcgattgggttcccgaatcgtacccgccgactagagggcccaccagtcaggtcagaggatcaagacaattcacgagtagttacgttacttctttggatttttaaaattttgatttgtactgtaggattaatttcaggttgccgtgatacttgtcacaattgggctgtgtttagttcacaccaaaattagaagtttggttaaaattgaaacgatgtaacgaaaaagttagaaatttatgtgtatagaaaagttttgatgtgataaaaaagttgaaagcttttagaattattttagtactaaacacggcgttggtttcaattgatcgaatcggtacgaataattcataaaaaaaaatcaaatggttgttaccaattctcaattctggcaaaagtcgaattatggttccatttatactccttaacaagaccatgtacatacacagaagtgaaaattatatcagaatcaagacctgataaacagcaccaaaaaaaaatctgaaacgccaggttgcaagcagaacaaacagaagatttgaaatggcctacaatcccagaactgatacaagaatctcaatacagaaaagaagcaggacaatcaacaggctacatgagacagaattactgtgtacaacaagcatacatccagcacagtaaaaggttggagcatatcaccagggggggtgctttagtacccatttcctacctgacaccaggatttattcagaatgtattactgcttgttccgaagcaagaaacagaagggtaggatgcacatgatttataactacaactgttctacatgacaattctgaggagatgcaactcgctacaatgcaccaagttcagaaacatgcatatgtgatatggatgtctactgaggaactacaacaaaagggaggatacaacagatgaaactgagaacggatctactgcctctctcttgattgtgacctagtatcagtcagcctgtcatcatgcctgtcactatccctgccgttgtgcctgtcatcacgcctctcgttgcctgacgattgccgatcaaactgccgatcagtcctctcgttttgcctgtcgtaccgtctctcgttacctgaattttgcctatcgaagtgccgactgtttcttgatggatatccatcattcggtattgaatgggaaaagttgcagtgctcaccattcttgcagtatcccttgtcgagtatagaatagcagactccccttttaggcctccacgaccctccatcaccacctgactgcgacctccaagacctcccaccagagtcaccgccattaaaatcaccaccatgcccagaatgcctgcctccattgtctcgctgctggttattccaatttgggttcccgcttggtgaattccagttcatattgttattatcttggcctgtcccatttccagtactgggacctggattaacctgcatgggagcaccccatccaacattttggttcatgtttccaacttggcccccccaaccaggataagaatttgtatttccttgtgcaatggccccccatggagccattgcaactccttgcatctgagttcccaccattgctgctgcatttggagtgccttggccttgagttgcccacatcatattcatattggtgtttccaggatttggtgtaacccagcccatgtttggaactgcatttggctgtgcttgcatagccaaacccatgttgtagcctgtggcactttgtgctgttcctccccaagacatgttcatgttgttctgtccaaccattccccagcccatgtttgcattaccctggagagtagctccccaggtcatatttccagccgcctgaggctgagattggccagatgtgcttgccaattgtgcccaagcagtgttttgattatcaccaccagccatggctgtggacgagggctgcactgcttcagcagatggtgttgatatcagctgagatggctttaccgagttggaagcatcagtttgtaactggttccttgcatctgcaggtaatgccatcagtttcattaggtatttaaaccataattttcattgaacaaaagttgcttcgggattaaaagcttcctttgtgaaacaacagatgctaatacagtaaaagagaagacaatggcataaacaatgaacaagcattgagcaataccttcaagttgttgagtatttgattgcacccctccaggttgtgcaccagatagtccaagatctgtgaagaaccaaaaaagaatgtttaggccatattgaaatacttcttcgcggcgattttataattctcagcctattaccattcattaaagaaacggtgtacattttttttatatattaagtatttgtttcctcaatacattgaacgatataaaccttcgcaaagagcctaccttcacccgatgacctcatcctttcacgcgaagcatcttcccccaactttgaatcgtttccatcagctaatctgccatcactttgtgataaaaaagatgctatctggttctgggactgcaactgtgaattaactacttctgcactcactgtcgcaggacctggtacaggagttagctgacctgcacttcctaaagctgcattttgtccaactacaaagctacccatggcaggctgagaaagtgtcacaggatttattgcagttccaaactgacttgaggcgttccaacttccactaagagattgttggactgcatacgctgcttgagagttttgcattccataataaccttgtgtactagattggatagtggctggtccaagatttgccgcatcgtttccctgaccagcccttcctgagaaagactgtgtgctacttagaactgctgattttgaaggttgttctccagctcttgttccttcctcaagaagggaatcattacggggcctaccatcaacatctgaactgcttccaactggcggttcccacggcggtaggtctttctcaaacctcccgagcaaagcatctgtcaataatattgaatcatcttgcttctcagtagacttccatatttttaaattcggagggaagtacccactgccattccatttccgcaactgcactattgagaaaggaccctggattttaccggtaggatccatgtactgccagattttttcagactcattaataactgactgtgatgcatgtgttccccctgaccctatattggctcctaaagtttcagatgaaacaccagatagaccatgtggagcattacctgcagtagctcccactttaactgcgtgtgtaccgatgtttgggctatctgatttacttgtgtaaccagcactttcaccgtgagacgaaaatgcaggtctgcgtccaaggggtgactcgatatgtgtactggattcgccccatgtgtttcgattagactcccagttggtttttaaatctctttgtgcaggactcctaccctctcctttacctggagatacaggattattatctttcttagagaaagatcctcttgacttattgaagctgcctgtacaatagaaaaaagggagtgatgtcagatgagcacgcatggatcgaaaatgaatattatggggcggaagcaaaataaaatcaagtacttcttccagtatcctgctcttgttcctctggagattcataatctggatccatggtatggtcagcatgaacttcaggttcttcattcagcctacgaacacgctcttcaggggtacttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39506 - DNA, 2250 bp, Oryza sativa
  unsure (1)..(2250): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacaacatcttcagcatttcccaagcctatgagaagatcagactcctgagacttcaaaaccatcttaagatcttccaaagcaaaaagtagcagttccagcatcgtgtctgagtaacctgcaaaggataaaaaggctaatgttaaagccaactgccagtgtgattacttgcgattcttgcactacataatacagattacagtataatttcgcacgatgttacttgtatatgaatgttaacaccagattctaatacccatttccacagcataacttgataaaacacacctcgatctcatcccttccaattaaaaccttcatgatctgacacataccacataagtaaaggtgcaggtctcctcaagaagttgggactgaaaggcagttgttctttccatttactagcgtctattttaaggcaaaccatatgtttcacttttctgaatcagcagaaccagaaagtaccatcccgcactacaaccaatccacagcttacgctttgattcggcagccgaaaaaaccacgacttcggtttttactgcacatttctacaaaaccacgaatcctggcatcaaagctttgggctttggcagattataagatctgcgaatgcagaatctgggtgctgccgttgcagctacaggaaagcacaattgaagaggcataagaaaaagtaaatgatctactcgattcagagtaaatgtatttgaaaattactactagaacagagtatggttttaactaacaagcatcagaaattcagaatctacatacaaaatgtactaccaaaacagtgctagaactcaatatcaatagcgctacatgcttaattaagggcaatagcttttttttttcttgaaacaggatagtgtaccttagttgaagtcaaacaatatctcctaacctgcatataaacaaataaactcaaatatcaaattagctgcatacgatgagaaaaatggttgcggtccacattttgcacatcatctactgttttctttcaaaactgattgttacaacacaccagaaaataggtgttccttgcatccatgccacatgatatcatgtccaggtactccttgaatttatgtttgagcggtgctttattcctttcatcacttgcaacaaaaccacctcgacattatcctcatcactacaaacactcctgatcactgaactccaggtctcagcatgtggaaccatcccaagatcaagcattcgagtcatcatccctgcagcctcattaaccttcccaactgcacagcatcccttaatcactgaatgtaacacagagaaatgtggtagtaaccctttgcccaacatatcatcaaggtatgcctctgccttgtcatataatccattcacacacaacccattcaccaccgcagtatatgccaccgcatttggcgcgcacccactctccctcatatctctgaacaccttgcaggcatccagtggccgtccctcacggcacattccgacgatgaccgtgttgtaatgtacaatgtcaggtgagacctcacggcctcgcatgaggcacagcaagcggtaagcctctcgaagctgcttcttacggcagagcgcgttcagcacggtggtgtatgccagtgggtcagcagggatgcccctgtggagcatttcgtcgagcaggttggctgcagtgcggacctggcccctgcggcatagtgactgggtcaggatgcggtatgtctcggcgttgggagacacatggagggagcggaggcgatggaagagggagattgacacggcgaggtggccggagcgggcggcggcttcgatgagcaggttgtgcgaggcgaggacgagcggctcggggaggggaaggcgggtggagacctcccggaggaggtgcagcgcgcacgggaagtaggaagcggtggaaaaataacggaaaggaggcggagaaaaaactcggggtggaccggcaacgggcttggagccggagacaaaaagggaattgaaggtg

SEQ ID NO: 39507 - DNA, 3781 bp, Oryza sativa
  unsure (1)..(3781): unsure at all n locations
aggaggcggaggagaagctcggggtggagcggcaacgggctggggccggagacgaagagggagttgaaggtggagaggaagaggtgaggctgccggcggaggcggagcgcggagaggagcagcgggaggaggatccgcggggagggcggcgacgggaggcggcgcaggagcgcgagcgcgtgggggaggtgttcgcggcggcgggagaggcggagcgcgagcgcgtggagcgtcgacgggtggggcgcggtggtcggcgcggtgacggtgactagctcgagcgcgaggagcgggtccgactgggaggtcacgagcttgtgcagccgcgccggcgagatcggcggcggcgccggtggcgacgggagcatcggcgaggccgtgatggcgtgggctcgaactgggagacggggaccgaacgatgaagatgatcgtgtactggcgtaggctttggcccaacaaaacatgggcttggccccaaagtggagccttatagttaggagggctacttgttctctcgggccattcatatgggctctggaccatgtcttgaattctttgcggcctcgcacttcaacccaactacccaattagagcaagtacaatagcagactatcagtcacctataaatatattttaaagagataaaagataagagagaagaacagcgagctatatatctgtagccagttgcagcacaacctccaagacataatgtgtgtatgataggtgggatcatgcattaattgtatagtaagcaactattacataatgtgtgtatgataggtgggatcatgcattaattgtatagtaagcaactattacataatgtgtgtatgataggtgggatcatgcattaattctatagtaagcaactattgtataaattagctattaaattggctatagatgatttggagctagcagttggctatactattaaacttgctcatggagagtaggaagagagaacatggagtgaatagtgatgctggcttcaaatagtttcaactttcaaaacacccattttacacagaatttatgtttgttcgggagatagcgtacaggtgagagttcgtaatatctttttcaagacatcatatggtatctgaatttgattgatcacataagaaaatcagctagagcggcacatattttctattattatatagttgtaattcactcaatattaattattaaaaatgagctttcatatataagtggtgtacacacgtaaaacgataaaaccattaacgcatgattacttgagttttaattattaactagtaaaaatatcaagttttaattattatatacttaaaaattattttatattttataacttttatatagaaagtttccgtacaaagcacattgtttagtagttaaaaaaaatgtggtaacaaaatctaaggtataatttacatattaggcttagttcggcagcctgtattaacacatcttcctcatgttccgcgtgcacgatttttaaattgttatttcaaaatctatatgaaagttatttaaaatatcatattaatcgattaatcaaactgacagggccgtttcatggcctttccaaaggctctggtgattggcagcttgcgttgaatcgaacttgtacgcagcactgatgtaatgcatactcaggatgatgagattaaaccatgctattgctaaggaggatgtttttgtatgtgtagctaaacaggatttcgtttaagtttgacacggtgtgttgtgtgtgcatttagaggcttcaatagcacaagaaatctgatcacaaggaaaagagatggattgatttgattcaaagaaaagtgaaatacatttttgaaaaaaagattcggttgcattcgctatactataagagggaaaataaaagtaaaatacccgaacatattagctagtagcccacgagttttaaactgttcctacaattccacagcacattacgagtccaaacaggcagtacagtgaaaactatggagtttgttatggtatacaaattgggaaaagaaagaagctcaaaggaactcggcaatatctcaaaccacacatcatttttagccagaaaatttgacatgactaccctcaaaaaaaaaactgaagaacatacaccagaatgcatgcactccagttcagcgtttattgaacccctactacacccaaaaatttaacccaagcgaggcactcaggattccatggcctcaccatcaagaatacatctaaagaaattccttcgatggaaagttatattaattcattttgctggagaatagtttagtagggtgttagccactggcttgaaaaacaatttggaacagatgaaagaatgcacccaattggcatgaaatattagttcattttgtacttctatctatgtcgagccatataaaacaagactacaagagagtacaaatgtggcacgattagacattacttgcacgatggggtcaaaagtttgtatgattagatttagacaactcttgtaatgtagggttcaaggttgattttgagctaggtccataaacaaaaacagctttaagaaccaccagaaagttcatcaggagtgcgaattgcatctcatcttcttgtgccgacttgctatcaaacctgctcgatgctgtttttcctttcattcaacatatattgcatttcattttgaaattccagaaaatgatatgaagattaagagtaaataagtaatctacacatacaattctgtacagtgttcaatattcatctcctttttgccacctaagacatgaagcannnnaagtacagaagtgtcaacgggcacattgggatcaagttcttagaaaaaaatgcttccaacgatcaagttagtataatcgagaagtcagttaatggataaggttaccagacatctaagtaggatggaactccattgctggctaagcgccagtctctttgatccattcgcacagcaaggagttcacttcatcaggaacttcatcatgtggagcatgacctgacacatttcagtatgagaagaaaaaaactaacatcagtaacccctaacccctgaagacgttcatgaatgagaacttgcgcacaggagagagagagagattcacctgcatctagctctctaatatggaccttgctgcaatgctccctaagcatggaaacaaatgacttggattttgtaagtggatctttcattcccttgtttccccaaaaaaagcacatgaaggtagtattagctatccgcatgttgcagtaactaaattaggtaccggtatgaatccacaccatttttttatatcagaaaatacctgaacaattaagatttttccaccaaaagaatcaaataaaaagttgagaggaatggaaagattgaaactgaatatgctctcaataacggttgctgcgccaggatcatatgactgaatttgcctgtcaaggaaaaagaattgcaggctatactgcatatatcaacggttaagtctatgataaatatactttgtgatctgaggatacagctcttattatctcatccacaagtggcttgtcaacccgttcagttctctgcacagaaatttttcggtattgcttagtaaccatgtattatttaaatattgaggaagcaataaccacatcatacacgtactgtaggatagtattccttaagaatgcctcctgctcttgacctcaagaagagcagaaggaggcgtgcctgcaaactggaaagccatgaagtccgtccttcctgtttgtatttttcttcagtagcattgagttaatttgtagcggaagt

SEQ ID NO: 39508 - DNA, 1201 bp, Oryza sativa
ttcctgcagccctcaaatgtaaaagtccaaactcaaaattaaaattatacaaaaatggaatgctgaatttatactggttccgtttttccaaacggatctcgaaaccgacaccaaacaaaaattcaccaaggtgtttaacacaactcggaacaggcgaaactgacgtgagagggggactcggactcaagataaagttggcgacaaaaggagatggcgccaaccggtcttcacgcgtggggagagtttggaaagtttggccttagatggaaactaaccaacctgattgatctagtctgcaaaacttcctccaaaaacagatctgttatcttttctctctcctcttcctcgcgcaagagaaacaagcacggccgaatacagacgacaaacccttgatgtaactcagcaactccaaaaccgaccgacaaaaacttctgaaaactagaaaaacgaaaccccgacaacaagatgattccgttttcctaggtcccgacgacaacaaaaacacggcgggggcgatgacagtggtatgaaacgtgaccagaactcgaaactctaaacgaactaaacgctaagaccagcaacacgactcgacaatgcaacacaaaactcaacaaagcaaaaactgataaaaacaatgcaatggcacaaaatggctaggtacaggatacaattttttttgtatggcaattttctggttatgggtagataaaactcaccgagcaacgaaagctctgataccacctgatgaaccctgagttcctctccccccttatctcttcccctcccctatataagccccactattcccactctttccctccatccccacctcctctcctcaactccacgccgccgcgccgtcgcatagagccgccgcgccgccgccacgaagccaccgcgccacgccgcgccttgcgccgacgtcgccaccgtcgccgtcgccaccgtcggtaagccgccgcccccccccccccctgcgtccatcgtcgtcgccgcccgggagagcaagaagccgagagagagagagggagaaaggagccgggagggagagaagagagggaaaaagaaagagaggagaagaaaaagggagagagagaggaaaaagagagagagagagaaaaagaaaagagagagagaaaggagaagaaaagaaaagagagagaaaggaaaagaaaagaaaagagagagagagaaaggagat

SEQ ID NO: 39509 - DNA, 6048 bp, Oryza sativa
tcaaatttgaatcattacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtaccaataaataaaaaaaatggatattgtacagtagcataattatctttaatatgtcttgtcactatagcaaccaaataaattagttataatcaatccttcaaattaatgggtgtaaaggaaaatattagtgccatttactagcctatgtccaaatataactaattccatgacttataaattatttacataaagtttagcctcatattttgtaactaaaatataaacacacatagatgaatctttaacttgtttaggagagtaatcacaaagctagttgtatttggaccacttaaaaaaaattagttgatacaatgtcatgtgaagtagaatatatatatatatagtcggttgatatccattagttaaccaaacagagccatcttaaaatcaacatgtattgtatagcttacagtaaacagaaactactcaaatatatgatccaataataagatattgttgcttacacatatactatacatcccattacagtggtacggtatagtattaatttgcatgttgcatatatgaaattaagagggagtgtatgacaaacatgtatattaaataaatactagttataaatcttgacctcatataattataattatagttcaactgtaaattaggattattcattataaaattatgtgatgggataatctgtaaccataatatgattaacctaaacaactctaacatacaaagcatggataattattaaccttttataatttgttgtgacaagtaaaatatgttcataattaaagtaaggctcccatcaataaaataaataatacaaatgattcactctaattatttgattgatcctaaatacatccgacaacaaaacctctagtatacgaccattttatttagatagatgcatgtgtagccataatccttccatagccattagctagactaaaccacaaattagccagatacgtatctcattcatactacattggctagctcctaaatagaccaccatgataacagaaagattaagagactttagcccttagcatgttggaacccattagcaagcgcgaataatatgagcaaccttaggttcaacctcaacaaatatattttgtttgtgcatatttgattgttgcttgaatattggtttttctcgcgtattatagactttgtgtatcggttagtcgtgaggcaacgtcagcaacttccagaaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcccacttgcgattatgccatgccttgattattgtttaccccttattccttcgtaaccatgtttacgtatgagtccctaatcaactatgacaaatgcttagaaatgctattttagaatcatgcatactcatatttatcaaatgctatatgcttgggcaattacctttgggaaggtaattgagatgcggcatgtggagacatgagcaccacattgccatgatattgatgacatgatttgcgaaaggagaaataaaactaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatctctgcatagatggttcacccctgagtgaggcaggtgcgctacggtgggacagtcgttgaggtagggccgagaggcgtgccctacatcggtgtcgctattggtaggactgccatgagtgtgtgagagagagaacttaacttgaaccataatttaatatgtgtgtgagacttttctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgataaattttatgctgatggagccacttcccgagaggagggaaggtggacatcctcagaaaaccatgacgattcaatggcgggaagctatccttgggatcacaatggatgatggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgctattcatatatcttctaggagagtgttgaagagaagcccttgtcggtacgcttgcgtatccaacaagatgatcggagtgcggtcttgttctaggtctcgttccccagtcgactgcctgtggcatgttaactgggcccttatattattttgtcttctgctgttgttctctaatagttgttggcctacctggccctaatgtaagtatttaactcttttagcctgaattcattcgtgatatgttgtgatccaactatgtatgtgtgtaccaactactgatccagggattggtacggataaacacagaagatttccgatttccaaaattgggggtctacatgtacctaactatttatagaggtgagaggacgaccaagagggtccaaaggtcgtgctccatcagattggggcgcaccccacatgggccccacatgggccagggtcccaaacaaagttacaagcccattggcccaatacaggtgacgcagcaccttgcggccaaacgagatagaatttcgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcataatgtgagcaatggtcgtatccatagtagccatggtcacatcatagtatatcgcttaagaactcagcctagctgcagtacaccatacatcagcggtgtaataaacatagtactccatccgttcgaaaatatacaacatatgactagatagtgcatcgtaacaggtgatgtctcattagtcctagatgctatattatctgaggagggagtagaaagaaagaaaacaagctccaatcgtttggtcattaaccgttggctctgtcaccgattaggatccatctaataaacatgtcgtgcttttagcttcttcaggcggtcgttcgatcgaactggaccgatcggcacgagggattcacaacacacgatcgtcgatcggtcggacgatcgtcagggagaagagaagaaacagcgggcggtgtggctcccgaggcatacgcactgcatctttcctttttgtccccctagctagaacgcgtttgcatgtgttggagcaagagtaaggataataatatagctcacttattactattagctaattttaaagtcaacatatataatagattagctataaggttggctataattttcttctcatctctctatctctcacttatatattaattgaatttgtcttggagtttgtgttaagctagctcttgcataagagctaacactcttaactttttactttttgttacatctctcctcctggtaagtttacagaacgacccgccggggagacggccggcgcggaagccgcctagctggccaaagcgacgcgcgcgatcgacagctaccgtatttgctgtctgccggtcgtctgccctgaattctgatcgatctgcaaggggaggaagtcgccgtcacatccgacatgtacacgacttttttttttgttattacggagtcctccctctctaaaaaaaactaatcctgaatttgaatttggtcatacactatatctaaatttaaactcataattagattttttttaccgaggaagtatcatcgtgtgaacgtttaaaatgagaaatttaagttaggaaggagtaaagaaacactccccaactcatcccctatgaggctgtgtgaccgttccataggaaaagtgatggagtttacgctgcccagtgtatggcggctgcaatgcaagatactagtactactacggtagtgtctgaatctccttaagataaatatgaggatggagattaagtattttatataaaatgatgtggtaataacgtgtaattaattgatttttaattattacaaacttaaaaaatggattaatctggtattttagaacaaccttgatatagaaaattttcacatgaaacgtagcgtttagctatttaaaaagcgtgccattttgatccaaaatttaatccaccatttcatgacattcgaatgaggcctacgagtatcatgacggtagattttccggagagctatgcacaggcacagcgcgatactccatctaccatgcgacagtgcaggtgttcaaaacggtgtagtactagttgtacgagaggcttggaagggaaaggaaacaagcgtcgcactcgatccgacgcccgagatcgatccctccctgtacaacccgatccgacgcccgagattgatccctgtaccaaaggctgatcgatgatcgatctgtcgtctccatccacaaaaaggcttcagtatttggtacagggatccacccacaaaagcgggcgacgtccgatgcatatgcatgtcaatccagccggagagaaagactactccgatgcctgactcgccagcggtgatgcacggaaacaacttgtttcaacggctcccatcggttggcctaatcagaaaaaaaaaagggctaaattttgaattttcaagcttaattttgatattgattttgagatatttttgatgtagtttctttttcaacattagcttttaagtcacaaagaacacatttataaaagttttacgtacaaaatcatttttatttcctaataaaccgttttggtttattaggaaataagccaaacgatgagaccaaacgttgctgctataatgctatgcactccagtttatcccagagctacgaacttgtatccaccccaaacggagcaccgcgccaccgccacaataccacgagaaatttggggttatactatcgcaaaagagtggtttagctggaatgctatcccttcaaactgattcactaaaatgcaatcctaaactgaaggtgttcaccaaaatgttattttcgctcttttgggtgaatataaatgtttttcattaattttaactttcccggaccaaaatacccctgatgtgggcccacctgtcatactctctccactctctctttctcctcttcctctctcgagggagcgccggtggtcgggaggcgagcagtggcccggcgtcgcgtcgctgtccctgtccccctccctgctcaccgccctccgctcgccctgcctggccacctccttcgctccgccgcgacacgccgctgccaccgtagacgtgcgatggcggccgtgaggaggacggcgagggcattgcggaggatcgatggtggcggcgacgctagcgcgatcgaggatggcgatggcgttggagag

SEQ ID NO: 39510 - DNA, 6291 bp, Oryza sativa
ccatttcccacatagccgccacatcggtgtcccgcgcacccgccgcctcccatcccacgccgcagccgccgcctgccgtgctcgcagagagggggagagagagagtgagagaggggaaggagagagagagtatatgacaggtgggccccacaatcttttaaaaaagaaagtactgactaggatgccacgcgtacgccacgtaggataaaaccgctttagattgagtcgagggggaggggggtaattcgtccggtattgaaagtttaaggtgaataatgtctggtttcaggttcggggggaaattcagtcgaccgtgatagttcgaggggtaagtgtttctttagtccttcctaactttgatttctcatttttcatgcacatgttcccatagtactaagcggtaagttttttagaaagtttctttaaaaaagtatattaatccatctttaaagtctttttagtattgctccgttttgtgtcaaagagaagcttaacgtaaaaatacttctgtaccacagtaccagaagtatcgtacagtaaaatctgagatttacgggatgaatgttgtagattttactataggctgtgtttagttcgatccaaagtttgaaatttggttaaaattggagacgatgtgactgaaatattatgtgcgtatgaaagatttgatgtgatagaaagctagaagtttaaaaaaaactttaaaactaaacaaggccataataaaagatgagattttactatactagtactactaagcaccatggttttgacatgcgtcaggacgcttcaggcgagaaaatgagttatgctagacgataaaagatggcaaatcaatagtcactggcctcacgaccaagccaaagatactccggtaacaagtgagagtaatagagtaggagtaataggatgcgatgtctattcattgtacgggtattattagagaaacgttcatctggatttgaatagtcactctttctaattatatgatattagtttattacctaatattcatgtctttttattggtcagtattgaaggaaaaagaaatgcctttcaaacatgaatttcccgaatttcccaccaaagttcaaatttcccgaacgtcccaagtttgtatacccccaagtactactactcccgaaacggagtatacatacattgcgtttatacggtgctcggcagtggcacagcatctgtcatgtcctgcaggagtagcgcacaggccattggcataggttcgaatgattagagatccagctcatttaatacccgagatttggctgtactctctccaccggagggcatggcccagcaactactcctacgcctgtacaccctgccactttcacttccaagagagggctgtttgctgctccccaggcacttgcttcttccatcatcatttgcatggctacctgcgttttggaaggaatctcataaatgcaaaaggtaaaataaaatccgtcttgcaaaaggtgatcaaattcgagcttgactgtttgtgtttggtgatcaaattcgtgccggtcgttgtggaggcaaacttcatttactacatttctgtagctagagaggatgactcgaagtactccagttcaggtgctggcattcgctcctcttttggcaatgttttcccagtccaggagtatccgtttttttttttttgacattgacattatggagtatccgtttttcatcagctacggacgtgtttagttcacgaaaataaaagttttgggtgtcacgtcagatgtttgaccggaggtcgaaagggatttttggacacgaatgaaaaaactaatttcataactcgctggaaaccgcgggacaaatcttgagtctaattaagccgttattagcatatgtgggttactgtagcactttatggctaatcatggactaaggggctgtttggtttccagtgacttattccaagtccctgtcacatcggatgtttggacactaatttggagtattaaacatatactaattacaaaacccattccataagcttggactaagtcgcgagacgaatcttttgagtctaattacgccatgattttgacaatgtgatgctacagtaaacttttgataattatggattaattaggcttaaaaaaatcgtctcgcggattagctttcatttatgaaattagtttttttattagtccatgtttaatactctaaattagcgtccaaacatccgatgtgacatgggataaaaagttttagtcccatctaaacaccccctaattaagctcaaaagattcgtctcgcgattttcatgtaaattgtgcaatcagtttttatttttatctatatttagtccttcatgcatgtgttcaaagaatcggtgtgatgtttttatgaaaaaattggaaactaaaccaggcctaccagtagtaaagtaaactgacctgatgttgtatttgaaataaaaagtctgtaaagaatttttgtaggattaccatcgttttgaaaaaaaatagggaaaatgatttacattctcggtctcttctgacaagctagcacacaactaaatcctttggtatatttaactctttggaacaaatggttggagatttcaaaattccattcgtatattttggagtaaagttagcataaaatcgtatttccttctggtcgatctcttccatgcaagttttgcattttccccatacgttcagtattgtcaatacgaagaatcattcgtgtgtattgaatcgcaggcccaaattgaattgaatctccagacccatttaaatagcaggaaccaaaaaaaagggggaatagaaaaatatataaaattctaacaaaaatacaagtgtaaaatagatgattgcaaaacgcggaaaaaaacataaatgaccgtttgattggatacatgaaaaacgcgagaatcatataagaaagatatactcaaaagaaatttcttcatagattgaagctcttgttaagtttgaaacctataacattgtccattcataggaattttaaacaatatgatacgattcaatccttggtttcaaagttattcatataaaaaattcttataaaattaaaatcctttagggcccctttgaatcaaaggaattatggaggaatttcgtaggattaaaatcctacaggatattttcctatgtagctctttgattcaaaggattgaagttttccaaatcctacaaaattcctatggaatggcttgttgcatataggttttggaggaaacttagcaagaggtccaacctcctggtaaaaatcctttgggtctatctttctcatccgattcctatgtttttcctgtggtccaatcaaacgatcattcttatgttgttcgtgtgttttgcaatcctctgttttacacttgcattcctatcagaatcctatatttttcctattcctctgttttttcattcctatgattcaaaggggcccttaaagttttttttttatgattttcatataaatcaaatgggactttaattaatcataggtttgaaattgaaagggccaaacaaaccatactgctgctacaactagcactcctaacctgacacgatagttttgggttccaaatgatcccttttaggctatccaatggaccagctgtttgcttctactactactccttgcttgacacgatttggagggagtagtgaccgtgtgtagccacgtgacatgtgcatgcccacggggtgttcggcgaaaggccagggccaaagcactagtactcctcctcttgtatataatggctttctccctcaacaatcgatctcacctctccccatccgaacccccaatttttcttggctagatttggcgcgagatgtcttgcctctctcgcctcaacgcctcggcggcgccatgggagccgccggtggcacgcgccatggccgtcgagcagtactgcccgccgccacagtccttgctcccgccgccgccgctgccgccggtcgccgttcccaccacctgcggttgcgccgcctgcctccagggctgcttcgttccggtgggggttcaagctgccttcccgcacgccgctgctgggtgcgcgccgccgccgccggtgatgccggtgatgatagtgtaccgcgtcgtgcagcctccgccgccggcagctcacgccacgcgctgccagatcacggagatcgaggacggcggcggcgtggagaccgcgaaagctgtggacggcgacgagccgcagccgttcatccgcacggtgcgcagcactcgtcgcagaaaggcggcggcgatccgccttcccaaggcttttcgagcggcgcttttgccgccaccgccgccgccatgcgcgttggggttcacagctactactacctccttgatgataaggaacatccccaataagttcctgtaagtttcaaccaaaatcttcctcgattctagccacgacccttctttaatctacttgtttttactcttagattaagaaaagatctaatctaatctcttctttttttttttttgcatcgaccaggaaggcgaggctgatggctatcctggaccagcactgcgccgacgagaacggcaagtgtcaccgccgcggcggcggcggcggccgcagcgtcgtgaagtctgaatacgacttcttctacgtacccatcgacttcaagttcgtatactactccaatctagggtttctttcctttcatcttgttcttcctgacctgacacggtggttgtgcgcttcttctttctataggactgggttcaacaaggggtacgccttcgtcaacatgacgacggcgaccgcggcgcggcggctccgcgcgttcctccaggaccaccgctgggacgccgccatgtccggcaaggtctgcgacgtcgtgcccgccgccatccaggtacgtacgcgcgctcgcgctctcgctcgccgcgccgcgcgcttgcttgcttgccgataggtgtttgatcttggccccctttcttggaaacctaccttcaggggctcgacgcgttcgtggcgcacttctcggcgtcgtgcttcccctgccgcaccaaggagttcctgccggtgtggttcgagccgccgcgcgacggcgagcagcagacgaaggcgcacgtggtcggccgcctcgtcgtgcgcccacgctagctggtcgtcgtcgtcggcgtcgtctccggcgacggcgtgggttgcgcatggtatctatcttgcattctatccctaccgattgtccaaatcgatcaatggatgcatggaaggatagaacgggagatagattcatatagagaggctggcttggcttggttgttcgtagtctttccttgttcgtttctactgtagtagtagcagatagaactactagttctgccgttgttgtgttgtaatcatatgtgtagtggctgttatgtttgagccgatcgataatccttcgttgttgtgtgttgttaacttaactctactagtactaagtaccgcgtcctccgatcaataatccgagtatttgctatggcaatgcccggttgatgtcctactaaccacaacgaaagttgtgctaaatggaatgtgcggcttaaactatgaaggatttggttttagataatttttggttatgtatttattttattttatttgcttctgaagtgcacagtggtttactactccattatatgcataacagaattgccttcccattaaagagcatagaattgcttatacagacttctaaaaacaattttgtcgatagtgcaggtgccaggtactactaatccagagttactagtactgtgtagggtatcagtagtacatcacagaattagtaatccagattgtaattgcttcgaagtactccctcactctaaaagaaccttggcttacggctatggccgtgtttagattccaaatttaacaagaaccatttacacagtttgcacgcaaattatgagatgaatcttgtaagctaattaccctatgatttgacaatatagggcatatttagatccatttgttccaaatggtaaaaagttctggtggcaaaagttttgacattgcaaaagtactagctggtgtttagatgcatgttaaagttttgccattctagcactaaagagaaagagggagtggttccaaagcactttttggcacaatttgctactatggactagcaaatgctaaatgccaaattgtcaacatttgctacttgtgtttagatccaaaatggcaaaaagtgccattttataaatggtaaaacttttgccattggaggatctaaacagggccataatgctacagtgaatcttttatataatgctacggggtgcaggaat

SEQ ID NO: 39511 - DNA, 2913 bp, Oryza sativa
atcgtgcgcgcgggctgtgtttcgcacatgtgtgttgaacccgtgtcacaaaataggaatgtcggtctttgaacacttcgcacgttcgaatcgatcgtccacgatatatttgcccggattttaaccaaatttcatgtgaaattcgacatgcgaattaaaattaaaatatccctctcctgtcccgtagctggcgtcttgtcgacgggtctctgtagctgacatgtggggccatggcgcgacaattcacgctcggtcatcatgccccttgccattaatgggatgtgaggccttggagaagaaaaggtgcgattattcaatctttctttctgcatgtccctccttctccttctccatcccctcccccggtggtgcagcgtgccatatcgtcagagagagacagtagccgcagtaggagggagttgttgccggagaagtgactgtgcattctgcagatcgtttctgcgaatcctcctatggttgggacgcgagagagacagagagatgctacaggatgaaggcatcagatcggttgggacgagagagagagcaaggacgatggacgagaccggcattaggaatgcatcgggaagtggagatgatccgcgcgcggttgcgccggggggattgatcgggtggtttgccaacacatctctctgtacgagctctgaccgcgtctactactagcctgtagtgctactagtagtaggagtatgcttggattgtgctgaatcctgtttgtcctcaaggctcaatcaaattaatgaccgtccttggcaatattttttaaaattattactcctacagtggtagtactacatgctgtggagtggtcaggtgaggggtgccgtccaggcgtaagcgtacgagcaacagttctcaacaggtgagagttgtggttcggaggcgagacgagctttgctctgtcaacaacatttgagttgttttgggattaaaatttgacctcttgctgtatacacagtctccctctcgatgggctgacgattgaaatttcaccaaatgcgtctaagatcctgtttagattagatgggactaaaactattactatctccttccttaaatatttgatgccattgacttttttaaatatgtttgaccgttcattttatttaaaaatttttgtgaaatgtgtaaaactatatgtatacataaaagtatatttaacaataaatcaaatgataggaaaagaattaataattacttaaattttttgaataagacgaatggtcaaatatttttaaaaaagtcaacggcgtcaaacattttgggatggagggagtacatcggatgtttgatactaattataaatattaaacatagactattaataaaacgcattttataaccctggactaattcacgagataaatctattgaacctaattaattcataattagtctatgtgatgctacaataaatatgcgctaattatggattaattagacttaaaaaatttgtcacgcgaattagctctcatttatgtaattagttttataagtagtatgtcgatgtttgatgtcgtgattccggtatttgcatagtatggggattgttggtactaaggtatatgcgagactaaggtaaaagagacggaggcgaggaattttatacaggttcgggcccctgaattgtcaggtaataaccctacatcctgttggccgaagccgatattgctcttattcaccataatcacaccagtacaatatttggggtagcctatctaactgttgtcgacatggcggtctgaagctctgactcgtagtcgacaacatggtagtcttcctcctcgagttcgtgcccggcgtcttgtcttgacgtatgttttcttgtatgttgatcttatgtcttgatctattgttccgtgtatgttgattgtagtgggtgtctcccctctcctcctagggggtcttgtatttatacccataggtgtccccttgtccaagtagaactagggaaaccaatatggatacaatccgagtagttcttgtcgtttccatgtagaactctggttatttttccttatccggaactcctcctatatccgcaggttgtttccgtataggacatggtatgtggtgggtcctgccgagatttagtcgactactattaggtatgtggtatccataaccctaacagtagtctccgacttcaatgcaaatgaacgaattcatattctcagccgcgcacagactttggagtaactgttatcgagctcatgtgactattctcggtgagttcagagataacgttaggcttcctttatcagcctcgtgcgggcacctaaagggtttgtctgagtcaatctccgacgtcaactaagaaagtacagagcatacgactaagtctcccatcttgttgtaatcgagaatttggattgaaatcgagaatttggattgaagtcaagaaattttatctcagcgggtacaccatctcttcattccgtattccttgtcgagatccatcgaccgtgagcctgcgacgaagccttgtcaatatttgtcgtactcgccttagtcgatcttggtgtgtagaaccatagagacatggagtcttcgttaatgtcgaatagaattttcctgaaatcaatactcagaaaataatattagatagaaatagcccccaagcgaacgctcaaagggtgacatgttataatatgtatggaaaactgaaaatgaattaaatttacagaccaatgttttgtatatgagcgtctactcttttaccgacttcgatcagtcagtttgttgaattatacactctccctagcccccagccttgtcatcggagaatcgttctcgggagataaggctcttggacctttgacctgcctcggttgaacaagcactgatcctagaccccagccgtgaagttggaaaacccaatttccgattaca

SEQ ID NO: 39512 - DNA, 812 bp, Oryza sativa
acataataaatcatagatctgacaatattgtatagattggaaaaatagatatgataaattgtatataaaatattgcgtactttgtagatacatgccggatgtatgtacgaaattattagactaatttaaaaaattaatcttaaatacctcgttttgggtgtttgatgattattgcttgtggacagctacctggtaactttccatatgcatgtattggtcctattccgcgagacgtgcgtacagcgtacgcgtcatgcatgtcggagtactgtacgaaatccgatgcatgtcctcagctctacgtggcagagtccaaatcaagttgagcttgaggcttctcatgcatgtcggttgttgtctctccatggcaacgcacggtgtgcccggacagaggacctcggccatggcacaaagaaaaatggaccaatcaggaagctgattagtgtaattaattaggatgagattaaatcaaatacaaagagttggaacgacaaacccgatatcgtgttataggacgacgttctggctggtgagagtctccgtagttgaccggaccaggcgaagttttcgtgatcaacaatagcgaacagatatctcccgcaacgacgtctcgaggcttgagcgatcttgatggatcaaattgctgatgatgatggttccgatctcgtcgggagacgtactctggtcgggttggatctccccggtccgaagtcgtcgagtagctcgttggcggagaatccatctcttaaactcatctcgtcgaaatcctgaagcactaaaattcccctacctggcgtgccactgtcgacgtt

SEQ ID NO: 39513 - DNA, 1901 bp, Oryza sativa
ttgcagctgtacagcaagtgtttgccaaggcatcgatacatccaacctccattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgctactaaccatagcaggattgcgtaagggaatacgagaacatcgactactacacctttgacgagatatgacgacttctccacgtgatgcatatgaggtacatgactataatttttaacaagttgcatctaagttacccttctatgatgagaagtatgattctgttgcatacattgattgggagctagcagtagacaatgaatttgatatatatgatttttctgatgctcaaatgattaaggctgctagtaataagtttacctcttctgctttattttggtggacttatgttagtaataaacctgaaacttgggatgaattgaaaaccatgatgagaaaacgctttgtgacatcttattacaaatgtactcttcgggagaaattagaacatctgaaacaagctgacagaactgttagggattacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctctttctgaatccccaatatacttatgtaatgatgatgtgcaaacattggaggagcaatcttttgtctcccctgttactaacgttttgcaggtagatcagcacatcaaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtctacttttcatgctatagtagagcaaccattagtggaatcaattgctgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaataccttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttccggataaaatatgcaagctagagagacatgttactgccaatcatattgtctcgagtttgtcttgttttgattgcaagaaacatgttgttttcaatggactgcgcgaagagcacaatatggaaaaactgaggacggttttccgtgaagaaggggaggatgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagttctccttccaacggatccagcctcatctcggaatt

SEQ ID NO: 39514 - DNA, 2225 bp, Oryza sativa
cgagcgtgtcggctagaccatccgtctgcttgttcttcggaaccccaacttatcatttgtattaagttcctatttgcaatatcagattgcttttatcttgttcttgcttgtttcttcgatttgcttgcaggaatagggttgatctgcaccggccagatcaacaacccacgcagaggtgtattgatcgctaaggcgcaacacaacgtctcgtacggttgtagtcggatcgtcaacgtttttcccaaatcgtagttatcacaactcaccgaaagatcgggccaacaacagccttgagtgctgagaggaacttagggttcatcatactactaccattttatctctgttcccaacacatctctctcgcattccatacgcacgttttttaaattactaaacggtgcggtttttttaaaaaaattatatacaaaagttgtttaaaaaaattatattgatccatttttgaaaaaaaaggtaatacttaattaaaaaaaggtaatacttaattaatcatgcgctaatgaaccactccgtttttcgtgcgtagcagctatgttcccaactcttacaaacgaacacagccttgatacaacctctgcagccgaacaggcccaatgttttcgtgacaaacataagcaatcgctttgttgtaattgaaggagtgatttgaacagccgatggatctattccagatttccaggcataaccggttgaattcatgcccgacgattattggagtcggtagagaggaaggtcaagaaacctgatgtgctatgcttgtatcctggggcgcgcagccttcacccggccggtaaaagaaaaaatgttgcctagatcttcttgggtacaatatgcatgtcaataaattttgttagcttattcccatgaatgaactatcttgcttttctaccaagtactctatttccatttgttttaaatgcaatttctctctaccttgccaatccatccgtgctaaattaatggatcttgaatcaaatgcatcttaaatcgaaaagagtctagccagctctgttagtatcttttgtaccctttgaaaaagccacaaaatgttgtttccagcaaaacgtcaggaataaaaaattcacaaagccaatctttcctgggtgtagacttgggcctgcctataattctgaacccaacaagttgaaattgtgtgctccagtaatgggccggaatatgcagtccaataacgtccatccaaccacaagtctaagacaaatggcctttgtaaaatcagatgggccgtcaagcccatcttgtttgcaattcataccggaccatgtctttcttctctgcagcctcagcctctgctttctctcatgtcgttacacaccccaaccaactgaagctttgtccatatgagaaagccacctttcttagcttgatcactagcatgatcatgatcaatgtggtcatgatcgaactgtgaaagtcactacactacactaccaggatcctttgctattgctgatactactactgttcattttttttcccctcgattgcatgcacatgcttgcaactgaaggagaggtgagagagctacagggcataagcaagcttgggttaggtcagtgtctcagtgagtcagtcagatgatgcaatcatatgcaaggggagggagaggcaaaagcttggaataatcgatcatagggcgacaccatgagtagtatatttatccccttctcttcgctttcctttagctccaagcttttgtaccaaggctgtttggcacttactctccaggcgtatctgctccacatcatgatcatccctgatgtcacaactcaggccatcagaacatggtgccatgattctttcctatctagcttggagaacatggtcaatgtgtggatcatttcgtaatcctgtaattatccaagagctgaattaacccacaaattaagtacaacagcctgaactctgaagataggaagaaagaaagaacatgctattgctatcagatataggtttgattcagatggaagaagtggcaacgtagaaagagtagttgcatgggattaaagggtaaggaggattatattccagctatatgtacagagcaaaaggcccatcgaataaattcttcttgtacgatttggcctgaggaaagggatcgatgtgatcgaaagttaactcaatgcaggagcttgccggctccatcctagctaacaactgacagaaacaatagccaggacaggtccatc

SEQ ID NO: 39515 - DNA, 1267 bp, Oryza sativa
aatgtgcaattgctgtggtttatgccatgatcagacattctaaatgctgcaagaattcatcatgtgtgcatgcattggctgggccctttctgcattggaggatcatgagagttcatctgatcattagcatcttttccttccatccaaaggaattaccaccagctagtagtgtccatgttgatgttcgtctgatccgtgacgtgtgaggcatggcaggcacaagaagcagccattaattattgttcatccatcaatctcgcttcttgcagagcttaattgggccgtttgccgtcgctggaccaggctaggtatagcagcaagctgtctgaatttttttccccatgtctctgaatctatacgtccgtagttagctagggctagacggtgttagccatgtggactctcaccaaacttctgtactactgcttgcaaagagatctggtaggatcgagttgaaacatgaacattgttttgaaactgtgtggcgcaagtactatttgcaacagttcagaaaagttcagacatgcagtgtcaactgttaagctcctaaactccaagtacaatacactacgtacatggctcggcttagctcgaccaaggtcgttaatgttagactacaatgttttctgtattctcgattctttatatacccactcccgatactgattctataagtcggtttaagttaggtacaattggttccgtgccttgggtaatcgaatctattgcgttgcgtctatttcgccttcagttaatactaactttctttgtgtcagagtccatgctgttttagaagctgtgtgagactgtgattatcttgggcaagtgagatagctcatgcacagtgattcccacaagctggatcaagatcagggctaacggttctgaagaatttggcattttttgcagtggatgagcagcacgtgacccgctcatctctacctcgcgcgcgcgcgccaacgccaacaactcgatgcacgtacttcatgggaccattgcctcctctctctcgtcttccccactctaaggattccccatgaagagccctacaactcttagcctgcaccatccatccatgagacaagttttttctttctctctctctctctctctctcctcccttttttccttgtgattttcatttcacagttatcatgagagcaagaacattaacggcacagaggggagagagagagatgggtggggaacagtagtgaacactatggctagggcagaaaaggagggtagtacactgggctgcaggaat

SEQ ID NO: 39516 - DNA, 871 bp, Oryza sativa
taggtagtccaacatataggattaattaacatggaatgcaatgtcctaatcacatggaatttatagggacaattcaatttcctcaagaatattgaaacaaacccatgttttatgggcaggccttaggacacctttcgaatttgtagaagttctaatcattcgaagttcctattcaaaataatcctagctcatcttatagtggcacacaacaaacgactagagaagtatgaattaaatgagtggcagctgcagtttaaaccttgttcggggagcttctgtcagctatattctaaatctccaactcttccagatagtctagattctcataagctagcagactatcgagctactcttgcataatagtcaaccacgtgtaaatatttccaagagtaaaaaacaattgcgaaaaagagaaaaactgagtgggatcaaccattatgaactgagaattactctatcagtaacactttttaggcatagagtatccagggtatacaaaaccatgcggttatcgtggttatcatgtacggtaactttctcaatttttaaaaaccatagtataactcgtggtaaccgtgataaccatagggaaccatagtttggtgaacgctgagtgtatcctctcctatccattcatattcgactggccggtcaagagatcaacctagaggcagctagctagagttggtgtacacattgtacagtggtagacttggcatgccctaattatgggcacacacacattgtggttggtgccttctcacaagttttgcatgttacgatcaatctaatctctgcagccggccgcaagcagtggtccattgggatcgggagcgagccgtgatcggtgagtgttaaatgaactgagacg

SEQ ID NO: 39517 - DNA, 1024 bp, Oryza sativa
taaaaacttaaaatcccttatattatgggacagagggtgtagtactttctccacctactttcgatagtcatatttcatcttggcacacagatcaaggataagtaattttacttatcatccatttaaacatgctactagtcattccttgtaaacatgcgattcattaatatttacatttctcgattctcatgtagccaatcttacgtggaagaatagagtcatgcattaaatccgagaagtcgttaaaatgataatttgttagattgaaatatgcctatcgaaaataaattttacagatttgaaaatatgactatcaaaagtagatggagggagtaatattttcaaccaagacaaatttattataaaaagatatttaattattgatttgatgaaactaatttagtattataaatattactatatttgatatataaacttagtcaaacttaaaatagtttgattttgactaaagttaaaacgtcaaataacgtgaaaaagagggagtattctactgttcggtgatcgtatttgcacacgaagcggcaagtatgtaaaatgcagaatctgaatttaactatcggcaacacgtgacactacggggatcaccgccgtcgaaattggggcgaggagtccaggaggaggtagtggcggcgagatcgccggatcaactgatcacgagatggagatggtgagcacactggtcatgattcgattcctcatgcttgattgataatgataccttaaacctagctttgatctttaccagttcgttggcctgacggtttgcatcattcttatttttggacaattaacagaaaaggtaacccaaaaacagtactaaattgcccattcgctcaaggtttctgggaggcaataggtttaagccctcgaattcaacatgtcagtgatatggccaatctgaaacctgatgggaatctgccccaatttcattacaaggtgttctatcttctatgtttctggtgcttgtggaatcatcggcatgatgttgttttcaggaacatgt

SEQ ID NO: 39518 - DNA, 5789 bp, Oryza sativa
ttccctttgtttactgggtgagcctgcatttcatcatttcacttcatgagttgacgagctcagaaaaaaaaaataatcggccgactttctcaagatcttttgttggacaatcgaattaagccatttgatagaacaacaaaatataagaatgcagtttgaattgatcctctcatactgcagggctgctgccctgttccaaaaaaataataaaaaaaaagcttaagtctatctctgacctggtcgctacggttgtgcaatgtaagtctagtatgctgatgagcaagaatgtgattacctcaccttatgttgtaaaggctggtgcctggagtcctcaaaaatagctactttctgaggaaaattaggtaattttctaaataatctctatgaacatataagaaatgtcaattggaacttgtagggtgcctctggaaataccttttgtagttttgtgacaggtttggttctatgttggactagtggctagcactgtgatttactgattttgctcttggtgaggtaaaagtttaaaactggtataccctactatgcagaaatcgtcttcatacttttcaataggaaagggatacatctctttgccttttagagatgaacacagaagaaatccaaacaatatactgaatctgtcttcctattggaatgctgaattggtccctttactttatctatcattcttttttgaaaagacgcataagaatttgtgatctgcagttgtcttgtctagttcaaaatctctctgaatccattgtcatggaccacctcctgtctattagttcttccatagctacagtgtattccgtataacctttatatatcttttcaagtcagagactgaccgtatacgtatcctttgaaatcttcagtcttcaatctgtgtatagaatatacatttgtatgaaattaaattccattccgtgcacagctgccgttggtttttttaatttgtccttaataaaatggcccttctagataccacatcacatttgcacagcagggagggagtgaaatctccaaagtgagccaagcacgaggaggacaattttgtacgcgagcgaagcagacaagaactcaaacaagcaatcaaaggtagcatttcttctcaagcttccttcacctttggttcgtcttccaaatccacatcctgatcgatcgatcgaatttatcttcttccatcgtacttatttcagattattcttcatccgcatactgtcagcttggcccgcaggatccatcgattgctgtgaagaaatgatcaaccggtgcttctgctgcgtcaccggcggcgactctgatccggagccggctgccaccagtagtcgtcggaggtacgtattactgcagtaccatgcatgtagaagccatcagaattagttcttgatactttgatagcatcgatcggttgaggtgatcattcggtgtgatgtgttgtttgccatcggagagagagttcttgatagcaccgatcgatcggctgaggtgatcatttggtgtgacttgttaattaatttgggatggtaggacgaatccggcgagggcgtccaagaaccggacgagcgtggattacccatgggaaacgtacacgctcaaggagctcctgcaagcgaccggcaacttcagcgagagcaacaagctcggcgagggcggcttcggcaccgtctactggggacgcacctccaaaggcgtcgaggtgggttggatcatcgccgccgacgcgggcaggttgatggccgcggtgttcttttctttttttaacgactcgcactaggtgtgtgacggccgaggtgtgtgttcatggattgaggcgaattgatcgatagttctatcttgttcagattgcggtgaagcggctgaaggcgatgacggccaaggcggagatggagttcgccgtggaggtggagatcctcggccgcgtccgccacaggaacctgctgagcctccgcggcttctacgccggcggcgacgagcgcctcatcgtctatgactacatgcccaaccacagcctcctcacccacctgcaccctcaccgcggcaccccctcctcccaccaccacgtccccctcgagtggccccgccgcgtcgccatcgccgtcggcgccgccgaaggcctctcgtgagtcgtccacggccggcgcgccatgatcgagcatcaccgaggttgattgattaacctactatccattggcattgcaggtacttgcaccatgaggcgagcccgcacatcatccaccgcgacatcaaggcgagcaacgtgctgctcgacgcggagttcgtgcccaaggtggccgacttcgggttcgcgaagctgatcccggacggcgtgtcgcacctgacgacgcgggtgaaggggacgctcgggtacctggcgccggagtacgccatgtgggggaaggtctccgagagctgcgacgtctacagcttcggcgtcctcctgctggagctcgtcagcgcgcgccgcccgctggagaagctccccggcggcgtcaagcgcgagatcgtgcagtgggcggcgccgctggtggagcgccgcaggtgggagcgcctcgccgacccaaggctcgccgggcgcttcgacgccgcgcagctccgcgccgtggtggagacggccatgctgtgcacgcagagcagcgccgagagccgcccggcgatggccgaggtggtcgacatgctcaggttcagcggcggcgagaggcgcaccaaggagatcgtccccgtggcggcgacggtggccggcagcagcgacgagatcacgatgacgaccgaccaggacgacgtcaccgccggcagcagcgagccgctggacaggaggaactggaaattgacgaggttgaggtgatctgattgattgatcgaggtaacaccaactgggactaaagatcatttagggccgatagagttttaaaccgagaaaaaaatcatctatagtcccggtttctattcaaaccggaaatattgtggtttttagccaaccaagcaaagatggtttctccaataatgcataagcaaacatattattgcatgcgattaagacatacaaattgttggtatagctagcattttgtttgtgttaatttatacttgattagtgtagtaagcaattgattaatggtggagtcgggagggagaaatcaagtgagttttaattaatgttctaggcctgcaaagttttgtttgattgcaagatatgtttttcggtatttctcttgactttcattgttcgaaagatgcctgggctagcgttgttgtcactcctctattccgaatacctaggccgagtttattttcaaaatatttcttcaaacttctaacttttttatcacattaaaacttttctacacacaaacttccaacttttccgtcatatcgttctaattttaaacaaacttttaattttagcgtgaactaaacacacccttatttccggttttaaacgggctagatgaactttgaccgttactttttcccaccaacgtcaaattgaatatgttgaaatgtatggtgttatattaaagcacattcggtttattaaatccgattgtatacaactctattatctaataatattttaaaatattattggtcaaattcttaacaactcaaagttaaaactgataattattttaaaattgaaggagtattaatttgttatgtaattgttcagctaagatgtttattaatcgtctgtcccgtttaagttacaagaatttttagagaaaataaaccatttacttgaaaatgttcgattctgttaaattaaaattacaaagtgacaattgaatattacaagcgaaataaacgttaaacaattacaaggaggtaattaatccttgagctaaaaaaatacaatgggaaacgggcttctacggttacatcctcacacacaactcaactaggatataaatcttagttctctgaacacaccattttctcctttgaaatcatttttcttcaaaggagttgttggtagtaaggttgagtttaaatcaacttcctggttgggctattaccttgttttccataaccatgcttctcgatctactaaagatacttcattcgttgtgcaattacctttttttttatgtttcataatatagggtaagcatgcaactagcacctcctcatctaaattcgttttttagtccttcttcctcaagatttctaatatcattgggtgcatgcattatatgatccaaatatgaagatgataaaattattttttggtatttgtgttagtggtaattgtgccttatattttagaatagattttttaaaaaaaatattacagaaatttcttttaaaaaatcaaataaatctattttaaattttgtaatagttacttcattcatccaaatatatagcactatatgactagatggaatatatccttgtaataggatgtgtcctatccagtcataggttgctatatattgggacggcgtgagtaatactcaattaaccgtgcgttaattgttgttcccgttttgcctgttgcgaaaaaatattgtaattcagctatatcgaacaaaggccttaaggatgagtacatagaataataagatagtaaagccccatagggctccatttttgtctttcttttttgctccttggtagttgtgccatgtagtttgcaggtgcggaacctcctcgattgggtgacatgatttttttttgtctggtttcccacactggttgtgtcggtctcgccttgcatgtgcgccatgcacaccctgatcattttgtttctcgagtaaatgacgcatggtggtgtttatgaaaaaaaaactcattgtgtttgaacggaatagcggtgcacgtcctcccaccgactgacacccgttgcgtcttatacggaaaacccctcatctttctcagaaatacaacactgagaagggaaaattctgcttctagaggttgctctataaacataaaaaacacaagggtttttccgaaaaacaaccgcatttatcccctcttcttctccccacggcacgagagcgccgccatccgtcccctacggcatgggcgccgcgtgcattggagccaacgtcggcgctctccctacccccccccccccccctctccgccttccggcaattgggcctacggcagcggcggacctggcggcgagcgccagccgaacacaggcacccccgccgcacaggcaccggcaccatggcaacctttaccccacgccgcacggagtcggcggcagcagtgtggtttcggcgcgaaggagctagtagtactcaaaaagccacgcacggatatggaaaagagcataagagctcgtgtagtgtttatactgcaattttggacctatcactgaatgttattagcccgtgggctttttcacatcaagacataatacggcccattagcagtttagcactcgtttatatcattttgcacttactgactgttgcaaaagcccgcaaagatctaatcatttttcacttaaccaacggaacaggtgataagctttcttatttatatcatcatatatactactcttactcctatactggtactactatatcgatcgactgcatgctactacacatacgcaagcgtgttaaagatagagctcgtcatcaacaaacagtgatacactgcactgtaccggttctcagtacttaattagtccaaaaaggcttgaaaaagagcacactaaaccttttgtagttaggataattaaaactggctgggtggcccgcgcaattatgcggctagcaccgatataaaattatctattttttaatatgggctgcaggaat

SEQ ID NO: 39519 - DNA, 12824 bp, Oryza sativa
ttcctgcagccctcctaatattttgtcacccctcatttatttgcttcctcgatctaccactacttctatttgttctccctaaaacctctaaaaattagaccttatagtttttagagtttattgtctcgtttgggttttgtttttataatttttagaagtctcgtcaaatgcagccaccatactactctacggtcaatccactacctcttctctttattttcattgggatttaaaaatcaaacgtaattaccatttaggtttttttttactttctagaagttccaccaaactgtcagggactttaccactgtactcatgtacagctcacccgctgccccctctttattgtctccgagattttaaaattcaaacatgattatcattggggtttgtttttatttttactttttagaaatcccgccaaccgtcgtaaccatgctgcttaatgacacgtccatcgtccctccttttaatcatcattgggattctatttggggttttgtttatagtttttagatattccatcaaccgccaccactttaatcctttacatacatgttgattatcctatatttgttgtcatttgtcatctttttataatttttagaagttatgtcaaaccctgtcaccatacttctcttcggtctgtccactacctcttctctttattgtcattaggattttaaaaatcgaacatatttattattttggttcatattttagtttctataagtcccgccaaccgccatgactgggctgcttaacggcccatccgtcgtctctccttttaatcgtcattgggattctatttgaggttttgttattagtttttagatgtcctatcaaccgccaccattctacttctttataaacctgttgcttctcctctttattgttatttgtcatcatttgtgttctagatggagttttttagaagtccatatttttcattccgatatttttatttataaattatatttctacttgaactcttataattatttttatatttacagaatttattattttgttattacaaattttagttaatctcgtcatatgttctagatggtctcttatttcaatagtttttactttttatgtcgaatttaagttatttataaactgtattcctagttgaactattatttttctttttctatttttggaatttattttaatttttatttagaattttagttaatatcgtattatgtcttatatgaattatttttttaatgtttttttattttcaattttatagttgtttcatcctactcgaactatcttttttatttatccaatttcagattttattttatttttattccgaattttagttaatctcgtattggattcttatatggactcttcatttaatattccttatttttaattccgaattccagttatttctagattttattcctatatggactcttctttttccaatttctgattttattttatttttattctgaattttaattaatcgcgtattggattcttatacgaactcttctttcaatattgcttatttgtaattccgaatttcagctatttttaaattatatttctacttggactcttattttctttttctccgattaatgtgggaatttctagcccccacagcgaacgtggtgctcgtcagcaacaatacagtgatacactgcacatgtaccggttctcagtacttaattagtccaaaaaggcttgaaaaagagcacactaaaccttttgtagctaggataattaagatgctatactatacccaaacaacaataataggaggcaggcagcgagagatcgatcgatcgagacgacgtcacggcaaatgtgtgcgacaggttcccgtcgtgatcaccgaattgggacccacatcgcaagttataataattaagatatgagactaaaccggccggccgactcactcgatcaaccgataatatgatcatctctctcgatcgctttttacgtgctatactttcggtgtcaacgattggagatatcgattcctccgtcgcgtctctgtcaatcgtagtactactgtgtactagtagtagctcttatagcaactagccgtaattgattttttttggccctgtttagtttaaaaaactttttaaaaaacatcacatcgaatctttagatatatgtatgaagtattaaatatagataaaaagaaaaactaattatacagtttacatgtaaatcgcgagacgaatcttttgaatctaattagtccatgattagccataagtactacagtaacccacatatactaatgattgcttaattaggttcaaaagattcgtctcgcggtttccagacgagttatgaaattagtttttttttattcgtgtgcgaaaactccttcagacattcagtcaaacgtttgacgtgacacctataaattttcatttcaccaactaataaacaggccttgttgatggtgtgcaaatactactatctgtctcgtctcgatcttgatttgtttctgctgtctctgtggcttgacttgctttctcggaagtaggcaggatacggccggctgctggagtggccacgatcgattcgttaatgcactcgttcttttctactgtagctactaccttcatcataaaatataatacctccatttcaaaatataaaaaactacgaatggtatatttccatattcgtaatattagaaattatctgattttatattcttatatttttgagacgaagtgagtagttaagatatagtagtagattttatctcgatttcgttagcgcgtttttaagctagcaagcagcattttttataaaaaaaattctatgcagtactatattaaataaatttatttttaagtttataataattaaatcttaattaatggtttttagttttacatgccttgattttatattcatcttaatttatcttaaacaccacctaaatggccaaaacgcggagctctaggttaattagcctgatgactgagttataatggatgagagcaagagaaatctctctgccgattgacgcaactgctgtggaccaagtagagtttgttgcctgcatctgcgtgttccttgtgcaggatatgtgttgtcttgtaaagtttctgtcatgcatgaagcgtcatgtcagggatggattgtgtctcccaggccggccccggcccagctcagctaacaagggtttcgcaacagacgagtactaattaatctgatccacgcatgagcacggtaaacgtggcaagctatataccacagatacttcgtctaattggtttctcgaccaactagcggattttctccccgctttgtttttaaaacttcaaaattatgttgatattcagctctaattagcttatgttttcacaaatatcaaaatcgtctagtgcaagtatatgtttatctcttcttaattctccagttaatttggttaatgttttcgccccctcttattttctacctctcttgtagcacataaatagagagatttcttttcttcaaaacaagattgattgtattgaatatgattaaaaacaacctaatattacattatagacaaaagtatatatagtatgcatgcactatattctcggagagtactcgtgaactatgctagctatatgcacacacagcaagaggaacactcgaataactaatgatcattcataccacttcagtggaaacaagaaagtgcatacggaaaagggctaacaaattaaagtagagagacgcacgtaaccaacaaacagtgttatttcttgtacaagcaaaaataacggtacgagaagtagtatatttcttgtacatggcatgcaggcgtacgtgtgcacgtacgtcctcccaatctcagttcgttgttcgagcagctggtagctttttccttcccagctttccgatgaatggaatggaatgggaatggaattgtgtgtggcgacaacgttgttgtttgatgcagagagatcccctcctcctccgtggagacatggccatgttattgttatggaaccctacccatgtactactagcagcattagtactgtttccgctttataaaaaggacacacgctgctagggccaaaaaatcaattccctctctacactatacgcgcagtgcacctacgctaaaaccactgttcacgtgcaatgcaaagcgtctcgcatcggcatcgcatcgctttttcccgcgcgcggcgccgcacgtacggcacgtgaaaaacagcggcacgcagcagcagcagtcgtcgtcgttacagttgcaggaggagtagtagtacgtgtccgcgtcgcggtggcgtgtcgtggtggacgtcgcgcgggacggcggcgtccgttgctttcaccgtaaatccgggcacacgtcccgacggctgctggtggtggtgttgctgcactgcagccgcggccgcgcacgccgcacgtacgtacgcactgtgcgcgcgacgacgcacgtatgttgggcccgtgagagcgagcgaagccgagaggccgagaggccgagaggagatcagccgcgacgagggcgacggcgcgcgctgcgtctccgtgtccgcggggcgcgcgcatcccggcatggccgcggacgacgggacgtggggggcgagggagaggagggcccacagacaggaagagaccggggggacgtggcacagcgggggaggcaagggaagcgggtcaactcggctcgcgcgggtacgtggagtacaggggcaggcgcagcagcgggcgcacggctcgaggagcacacacagcagcagcagcaggcagaggcagcggcaggcaggcttcgcttcattattggggcccggactttctcggcaggcaggcactgcagcggcgcccttcggatcctgttcccaactttttctgcgtcgatctcttccccctcctccccctccttcaatgcactgccgctgcatgcctttgcctttgcccttgctggtcctggaaaagaacaactctctcttctctctgtaaaaaaaaaaaacccacacactcttgttgccttgcaccaccacgtccctcccactacgtacatgacgctctccacagtgcttgcctcccgttacggtaacacggtactagtaacacgctgccttgccacaattcaccgaacaaaccggaacttcattgtggtaacattttttttgtgtgtgtgtatggagtagtatgggtgtaaaagccctgagcagtctgggggctctgcatgcactgcaccggccttcgcctactccggtctctgactcgagaatgaagtttggtctggttctggttcagatcggagacgatagagtaggaaataaataatggagttcccctctctgacgacggacgtaacgtactacgtgcatgctcaggccggcgaaaccttcaatgccaccatcgatcaaacgatcaacgcttgtcgtttcgatgagtgtgtgcgcagtgtacgtcgtgccgatcctgttctcgatcgggatccccattaaacgatcccatgggcgatcggtgctacagtgatccggggtccagcacagtgttcagaaaaccggtcaggatcggcacgcgcagtgaatggctcagtggcccccctctttatacgctactgctactccaagcattttgctaaaatggcaggggggcttgaatctcctcccatctccctccatcctgctgctgcatgccaacatccgggccaatctcggatctctacagaaacaaccgcagctttggtggggaatgagggtgaaattcgaccatcctgcatgtgtgctagatctcacaaggttagctgccaagtgttctcaaactgcggttgtcaaatgtcaaactacaagaaactaaattagccctgacaactaattgattagtactatatgagatattttcagttgctaatcgtgagtgtcaagtggttgattagttgatgaggttctttcggttgcttttcatgattggtttgattgtagattttcaactactgtattcgtcccaaaataaagatttttccctcttatactattgcatggataaataactcttatatttgatatacgtgtaatataatcaaattcatattatcgatttaatgggattaagttagaaatgcattcgtaaatcgaatgacttagcaagatggctcactatgaaaaagccaaagtggttttattcataattagcttattgagttgatatcattatacaagtgagtgaacgtactaacaaatctagctataggaaaaaaacattatgttaagcagaaaaacatatcttactaccgatataaaaatagaagttgatattagtattagatttgaaaaattaaataataaataaataccccatgaaaagtgtgcgaagggatacatgatgaagctccgggcctgtttagcacagctccagcaccaactccacctcttttagagctggagctcagccaaacagtttcagtttcaccaaaaatgggagcgaaactgggtgcagctctatcacaaaatgaactagagaggtggtgctgggtttaggcagatccacaactatatccactgtagatccaactccttgagctaaatttggagttggagctctaccaaaaagacctttcataagggcaagtacaataacaataaatcaccgtctaatactcccccttcccaaattgatcatcatatatatttatgcaccaagaccaaggataatttaaattgtatcaatcgagacaccatgcacacattctcccacaaggcatgcatcaattaaaaacaccatgccaattacaccttagcatgcacactttctccaatgttgcattagttgtattctgatgaaatctgtgtccatgtggttatatgatgatcaatttgaaaaattttgaattccattatatcatgatcaatttaagaaggagggagcagtaagcttacattggattttatacctagctggcggagagagagtactatgagagagatacgtcattggtccaatgctcctatcgttggcttagcgccttcatatatatcgacggttccgtcgactgaaaaagaaattagtgtgaatgggtttggctgattggcttggatgaaagagaaaagcgggaaagtggtgagagaaaaaataattaagcgatgatgatataaatgttgcgctagatgtgaagagacaagcattgtacttatcatatgttaagttgtttctaaatgacgtgtacatggattatagtaagcagtcggctcctctattgcccttgccctaagatatgtattcatggtgcaccggtggaaggttttattgttttgtatactgaagatcaccattggtgataggtcataaccccaaatgatgacttgaatctatctttctaggcattcaaccaaacagtgagacataaagataacccatttgtttaataaacaagcaaccaactagcgtgaaaataatcctaacatatacttaaatttagattttatggagcgtaacaaatcgatgttgataaaaattagtggcaccgatttaaaaataacgatcagtaataaaactacattttgacttatgatatatattactgcgtggtaagaattctatgattatatatctatataatatttcactccaatgtctcacggtggttttttcaccgtagagtagccccaacgaggatggtcctgtagtgtgtacccagcgtatgtgcccccatgggaaaatgacagagtgccactccggcgtgtagtttgcggtcaccactcaccaactgctgtcactcgcacgtccagtacagtacactgctagctagttgcccttaattatctccctgtcacgggggcatgcaatcaatcagctgcttaattaaaggcagatgatcgaaacacagctgagagaccctttaattgggccccccctttccgttaaagaaaataaaaagcagcagaaaactgccttgtcaacgatccacagacagacagacacacacacagagcacagaacctgtcttaacagtatctatatatgctaaataatccggttgatttgtcccactgaaacgtgcatatatacgatagatacgatacctcccggtctattccttctcccctgcaaaccggggtttggactggaccactcgatcgccactgcactgtcaatcgatccatcacaccactgtttcctgctaattaatccaatcgaccccaacacgacatggatttcagctacgtcacgcgtaatatatccccactcctgcattggcttggtatctcactatatatatctcctttaattcgcacgattaaccgagacgtgatgtgatgaccgagtacaataagtgggtgttttgcacggtggatgacggtgaaatcgagcgttttgggtgggggaaacatcagaaaacccgcgcgaaacagggggagatggggggagccgcgcgcggatgaccgtggagtaaagaaaagagcaagctcccgtgttctccggtgtttgactgctactcaggccggcgcgcgccgctccgtgccgcgtcgtcgcacacgaacgatccggcggtgtcggtgacaacgattcgagatgaattgacatgttgagactgaaccagacacactgtcaactaaacaaatcttcttcttcctttccaggatcttttctgcgatcgaagacgcgtatacgtatgggcgtggctagcttggctggctttgaatattactacgcactgactatggcgttggaagggaggcatggaataactgaattctggagcacgccaacatatgctctctcgctgcatgcatacggcgcgggcaattaactccaccccggggtcgcatgctgcatgcagctagtagcagtgcagtacagtacagtacagtacattccaaccagctaactgtattcagaacgagagagagagagagagagaggggtgaggcagccggcaactgtaccctgccttttcccctcgactctctttctctctctcgcagcagcagcagcagccgcgttgccgtgtgcgcgtgttggtggctggctacctctccaactcacgcgcacacacacacatctcttttcctctcggtgcgatacgaagcgagagcgagagagagagagagaggaggcaaaggcaataaatggaagcttaggtgagcgcaggctccatggcggcgtggcagggcctctctgtcgcctcaccgtcttaactcgcggcagcgcagcgagctgagctgagctgatccggccgccgcggattaactcctcctggccgcgcgtgctagctactagctagtggtctacacgatcgagagagaggtttcggtttcttgatcggttcttgatctgctgctgctgcttcgtggtcgtcgtcttcttcttcttcttcttcttcttcttcttcttccctagccgggggtacgtacggccgcctatggatttgggcgcatggcggggttccctctaggcggaggaagccacagccgagacaacccggcgccgcccgcccgccggtgcaccccgccgacgccgcctcgttcctgtacgccacgaggggcgggagcttccagctatggcagcagcaggagcagcagccgttctacgcctccaacatcatccgcttcgccgatgacgcgcccccggcgccgtcgttggcgggggcgtcgtcctcgtcctcgtcgcgcgggatgcggtcgagcggcggcgggggcggtggcggcggcggcggcatcagctgccaggactgcggcaaccaggccaagaaggactgcacccacatgcgctgccgcacctgctgcaagagccggggcttcgcctgcgccacccacgtcaagtccacctgggtccccgccgccaagcgccgcgagcgccagcagcagctcgccgcgctcgccgcctccgccgccgccaccgccggcggcgccggcccatctcgcgaccccaccaaacgcccccgcgcgcgtccctccgccaccaccccgacgacctcctcaggtatatactagagcttagcttagccatggcgcgcgcgctgtatctaaccgcgttgatcgatctgctgggtgtgcaggagatcagcagatggtgacggtggcggagaggttcccgcgggaggtgagctcggaggcggtgttccggtgcgtgcggctggggccggtcgaccaggccgaggcggaggtcgcgtaccagacggccgtcagcatcggcggccacgtgttcaagggcatcctgcacgacgtcggccccgaagccctggcggtcgccggcggcggcggcgccagcgagtaccacttccgcctcaccggcgacgggtcctcgccgagcaccgccgcggccggcgaggcaggctccggcggcggcggcaacatcatcgtgtcatcggctgtggtgatggacccgtacccgacgcccgggccctacggcgcgttccccgccggcacgccattcttccacggccacccgcggccgtgaccggcgcccactccggtcgccggccggccgtccggccaacgtcgccgccatgctgtaacgccactacaatctctcactcgctgcaactgtcaattgctttggtcgatctcgatctcttgagaattcttagcttctgatctccctttgatatctcgttgcataaattgatgtgtcttcttctagagcctagcttagcttaaattaggcaggcgaaccctttagactcttgtttgcttctcttcttgggagccatttgatatgagcaattaatacactcgtttcctagcaagaatgattggaagcttcccaacagttaggagcttgggggaaagcaccctctctctttagcttaagcttagcttgatgatttccaccgtgcactgttcatcttcttccatcattcctgctgcttgattgaattgatactagtaattcttggtattggtgtactatactccatgtagaataaggctaataaggtttctttgcttttactactccatgttgtactccatgtagtatgtgagtactaacaccatgaagtatatgtgagatgtgagtactactagcttccataaggttgacaccttcgctttactatagcatgcacctttgctctcttgaaaagctgagccctagaaacctagttggctttaattggtagctcgtggatcctagatatcgcatcgtcttaagttaattggggtgtttgcgtttgtttatgcctgtgattatattactactagctagttgtagatgagagagagagagagagagagagagattcagtcatcgtatgctcatgggagagagagacaaagtgagtgagtgagagaggagacaaacgaaaggagcaaatgatcatctatctggtcgggagccgtgaccgatcgagccatgcgccgatcccttgcttgatttcgtgatgggttttttattgtttccgagttttacaattgcaaggggggtgagatgatgactcgcacattctcgtgttcttcatccgatcgatctctgacatatgaacattgtctcgttgatcccatcacatcaggcagcgaatatatatttgtttggccttttgtccatcatcctaggttgctagcgtacattgcctgggtttggtaactattgttgcacagggaattaacctattcaggcatgactttttttacactactttagcaaggaatgtactgctcttctgtttttaacaagaaataatattcaatttcatgcttcatctcacaatgccgataattaatgtctactttcaaaaaacaatatatatagttgaggtggtaaaatactacccggttattctattgtttgtggtcaaataaatcacataatataacttgtataaatttttaatgggcttccagcttgtttgtttttgtacatgtgatgttattggtttttcctgaagtatatgtaggaatccataacaaagctttgcaaaattttagaaatatcacatggtaaatatatatgacatgtttaggtaatatatgtaaacttttcttctactgcctattaatcatcttcatttatgttttctttttgcaatcagtggtggtgacatgatatttaatagtaatgtgtttgattctgtattgttagctagtactgaatggttatttatagcttgtcatactgaatatatatcatcacttcgcaaagcacattgtacatgtatttatgtggcaaagatacacaagtagttaagctcattcactgaaacactagtaaaaataaaaacttactactagttttttttgaaaccgtaaaacttactactagtggtgctcgtctagattcatagtcagattttttatttttttggacggagagtgtaaggtgtagacttcatttcggctcacattaagtctcctgtacgttattagactaatctggttagtagtgtatatatatacatatatatgttcgattcatgtgtagtatgtctaaaaaacacatgatcagagtaatctgattagtagtagtagttctcctttgcgtttatgctgtaattcatccaaaaattaatggcccatatatctagaatatataatacctatttgccagctatatatatatatatgcaattttaaagctcatttgtcaaatacaatatgctgactatattgattttttatgtcttcgacagttgccggttgcttacaccagtactagtatatgttcccattgcatcattttacggcggtgtatctgttagtccatttgagattcttgcgtgctccacaaagaaagcaacctgggctgtcattctaatccgcttctagctttatgctactgtgtcaatgagaagattctgccaaacagaaatgattgcatgcattttcatatatagtatattattcgttctcgacgct

SEQ ID NO: 39520 - DNA, 1351 bp, Oryza sativa
tattcacccaaaagagcgaaaatagcattttggtgaacactttccagtttagaatagcattttagtaaatcactttgaagcgatagcattatagcgaaaccacttttgcgattgtataatcctaattttctccaacaccactgacgagtacgtgtgcgattctacagtagtcagtatgtgccgctgcagtagcaacctgctacatgaccatagctgccgcagcatttttaagattgaaggggaattgttgcggagctagatgcgggacctgtgtcagcccaccactgcacatttgttcgtttgttcatcattccacctgcttcttccgtctcaaattacttatcttttaaggttatttggtatattctggttttaaacaaaagactacaatacccttataaagtgatttatgaatgaggatagatgggtggttgaggagtagaattgggagaaatttaaataagatatgattgacgggataagtagtagtacttggtagtgataagtacggagtagcattgaagaacaaaatttaaatgatagaaagataactaatttgggaaggagggagtagtaaaataaaatgggaaaattacgaattacccccctcccgccgaacccgaaaaccagacatgattcaccctaaactttcaataccggacggattacccccctcgacccaatccatagcagttttgtcctacgtgatgtacgcgtggcatcccagtcaacattttctttttttaaaagatggtggggcccacccatatactctctctctccttcccctctctcactctttctctctctctctcggagagcacggcacgcgtcggcgtgggatgggaagcagcgcagcggcatcgtgggatgcagaggcagcggtggctgcggcgtgggatgcggcggcggtgacggcggcgcgggacatcgaggcggcgtggcggtagcgtgggacgcgagttgccccacgcgagcaccgtcacgcccagcatgccagccgccacgccggccgccacgccgatggagaccagcagggagacgagctcgcgcgtgagcacgtacgaccagagcaccgggaggcaggacgagcggctcatgggtggggagtcggcgtccgtggtggccgcggcggcggcggcggtgaggaggactggagggtggttgctgtggtgaggcgcggtgatggcggcgaggaggagtggggagaggagcgcggaggccaccgcggtgcgcttcgaccaccggtgcgccgtgatgtccgagatggtgaggcggcgcgggaggtagagcagcgagtggagaggtcgacgaggcggtgcgcgaacattcttggcacggaggtgggctt

SEQ ID NO: 39521 - DNA, 10163 bp, Oryza sativa
ttcctgcagcccttttcgtcaaatttcggtcaaattaatttgttgttaaaaatttgaatccttgaaaacattccaaaattttactcggaatctgccttcgttctacgtcaaaacctaaaaattttacggttttcaatcagttacagatttttttttataaaaaaagaacctgaaccctgactgttactcgatcgtattggataaaggaggtggcagcgatataatgcatgcataaatgtgagttttttcactgaaaactacgggtactttgcagctcacccaccgtggaatcggggtaggcatacacaccacatacgacatccgtaatacgagcgagcgaggcttgcaactgcatgcaaatctcaaatccgcaacaacacaacacaacacaacacacgcgccgtgaccgtgaccgcgttgagcgcgcatgttaaccggaagcggccacgcggccggtgaatcaatcaatcgcgcgcccgtggccgtgggagctgaacctgatcgagcacgtataccgcacgcgaaacgtggatcggatcgcgacatgcccccggccggcggccgcgggcagcgtgcgggccaggcaggcgatcgcgagagagggcaaaccgtgccttctaagcatcacggaaatgaagcccacacgccggtgcatccacgtcgcctagctaaatttggcccggtgtcctctccagtttcctgacgacgactgcatcctggaactggaagtagtagtagtaaataaaatactcaaaattcaccggaattcacctccggattactactaaaatgcatctcaacccaagaaatcatctctatgtattaaaaaggaaaaaaaatacgaattacccttttaaactatagcggtcgatcgaattatccccctaaactcgaaaaccagacatcgttccccctaaactatgtataccggacgaataaccccccctgagcactgttttggatggtttttgacttgtgtctgcatacgtggccgccaacgtgacatccagtcagcaaaataaaaataaaaaaaatcttaggacccatatgtcatctctttcctccaccaatccctctcaaatcccatccccctggcccctgcctccctgcttgctctctctctctgcgtctatggctggaggaggagacggtggccgacggcggagacggatcgacgcgcagacatcggtgcacaaaccatcaccgaaggtggctgccgtgcttgtccaccacccccatcggcgacgttggcgagcctccgcgggagcatgaggcagagatgggggacaagcacgatgtccggtggaagcaaaggtggggcgcgtcgtacggtcacccgagctcgatggtaatgggggactcgcgccttgccagccggccaccaccacagcaagggtagagaggagagagatggcgcgtcgccgtgcgccggccggctgccgccgctcgctgcagcaggtgagggaggaggaggaagagaggggatggggattgagagagtagagagagattgagacgttagaggtgaaagagagagcggagagtcttacaggtggggcccacactgttttttaaaaaaaaaatgctgatcggactgccacgtagtactgaaaccaccccggattgagccgggggttatttacccggtttgtatagttaagggtgtaaaatatctgatattcgagtttagggggtaattcgatcgtccataatagtttaggggtaattcgtaaccgtggattatttaccggacggaattcacctctagattatttacggccgggctgcaaattctcgctcggagttgcatgaacgtctccgcctctgacgaatctgcactttctgcagccttccgccggcagctagcccgcctggcgtatcggagcagaatttttacagattttttgagacattgtggcgttttgaaacagttataactgcagtatatgtgattcacgttgggcctcaagattttcaattttcctttttaataagattgggtccccagattgaaggtatatatgatcatttcatatgggggttcttaagctgacccatcgatatacgattttgtctagcttatgtagattcttaaaagctcgttaccagctagctgtttctcatagcgttaaccttcacaaacatggcatacatatcgaaaacagaagcaaagaaacggatcgatgaagctttggcgctctcgttcatcctgtttggtcacgtgggctgtgggaacgggtgaggctagaacatgataaccacgagccaagtctcccattttcgtcttccaactatatgtcgcatggccgtatttgccaaacgtgacgaatgctccttcttcagttagaccgagaaaaattaagctagattccataactagcatcgatcgcttatgtgagtgtgtcagctgccttgcacgagctgatcagctcgcacgcatcgcggaggattcagtcaaaaatatgatcactcgcgcatatatacatgcatttcagaaagcacggatgcgcctagctcgcaagcaacagcgccgtgcagtagccttacaccatgtaattacacttggaatctagttctaccatgtaattacacttggaatctagttctataaaaaaaagaagttggaatcgtgtttggaacgatcactctgaagtttgatccactcagatcccccggaaaaaaaaatatctccatcatttgctttgtcaacgagttacttgaaatgttgagtacactgcgcggtgcaacgtacgtaacgcaaaattacaatcccaattaagcagacgcagtccccatatattgcatggtcaaaaccaaatgaagtccaagtctccactagattaattcgggccaatattaagtatcctgctgtatgtctttcggtagaaactctgcaaattacgatcaatatttagcccgtttcaagaggaaaatagttacagataagtaggtgtgtggtacgtatacgtatatatgtgtttagttcacatcgaaattggaagtttggttaaaattgaaacgacgtgacaaaaaaagttaaaagtttatatacgtaggaaagttttgatatgatgaaaaagttgaaagtttgaagaaaaaatatttggaactaacaaggccgtaaccgaatgtcaaatttgcatcaaaccacgctcctgtagcagagacgccacgtgcagcacggccaagcgttccattcctcccgtttccacccacgcgcgaacgccacaatttcccccgttttcctgggcgtttttccaccaccaccaccaccgccgcgagacgacacgagaggagggcgcggcgacgacgcgagcttccccgcgcgcgcacacaaccgcgacgtttcccgacccctcactccaccccccaccggaccacgcgtgcacaccaacactaatacaacactcttcttctcacttaacccgctctctcttataatcaccaacctgcagcgagctgaactgactgagaagccaatccgcgaagctaccaaaccgagccaaaattttgatcgatcgatcggccggccggtgtctttgttgaggcgtgcaaggctcgtgctttcgccgagagggattaattagccgcgcctccagcatctccggcctccatagagatcccagcttataattaaagctgtcaagagtcgttttggttgttaggcttaaagttaactactgctggctagctaggactaagagatccgagggagcagacatggctgctgctacttcgaccatgtccctgcttcctcccatcacccagcagcagcggtggcacgccgccgactccctcgtcgtcctcgcctcccgctgccacaactctcgccgccgccgccgctgccgctacgtcgtgccggtacgtacatgcaccatcctctttcttctccggtgaatcaatggttggagaagaagaatccgaatgaaatgtaaattaaatatgtatgtggatgtggtggtgcagagggcgaggctgttcgggccggcgatcttcgaggcgtcgaagctgaaggtgctgttcctgggggtggacgaggagaagcaccagcacccggggaagctgccgcggacgtacacgctgacgcacagcgacgtgacggcgaggctgacgctggcggtgtcgcacaccatcaaccgggcgcagctgcaggggtggtacaacaagctgcagcgggacgaggtggtggcggagtggaagaaggtgcagggccacatgtcgctgcacgtccactgccacatctccggcggccacgtcctcctcgacctcatcgccggcctccgctactacatcttccgcaaggagctccccgtggtacgtacgtggcccctttcctcgtcgctcgctttactgatgctctcttcttctttcagacttggagaccacaagcttttttccttttttttttcccctttgctcttttcatttttgcaatcaagacgtactctgtgtcaatgtccctgagataattgatgggatccaataattcttgtctgctaaagcaggcaaatcccttgactttctagatctgattttagacactgttattagtggcaccaaaaactgatctccaacaagtaggggaaacaattttaatctctcagattggcatccatccatctgttacatatcaattaaatcgttataaaaaaaattaaaatatttgataatatagattcacatataatatgtaagtttaaattcgacttttataagttgtaataaatataaccaatcaaactctaattagtttactatgttcactgttaaatttgttacttttattataacttgtataagtcaaatgtcaaatttaaacttatatgtttgtggtgcaatatattatatgttaatctattttatcaactttttaagaatattatatactagtgaaattaatcaactgtgttcaaagttgcatgcccacttgacacgtgccaaacacgacttggaagttcagatgtgagaataaaaatcgaaatttttgaacagcttcctgaaattgattaattcgagcctaatcgcttgctttggttgaccgttgactcggcgcgtgttcggccaggttctgaaggcgttcgtccacggcgacggcaacctgttcagccggcacccggagctggaggaggccacggtgtgggtctacttccactccaacctcccacgcttcaaccgcgtcgagtgctggggcccgctccgcgacgccggagcgccgcccgaggaagacgacgccgtcgccgccgcggcggccgaggaggcggcggcggagcagatgcccgcggccggcgagtggccgcggcggtgcccggggcagtgcgactgctgcttcccgccatacagcctcatcccctggccgcaccagcacgacgtcgccgccgccgacggccagccgcagcagtgacggcggcgccgccgcgattcgtagattagcgaattcgtttggttgccatggtacacctacacgcatgcaatgtcgccaaatgacgctgcgtgctttgcgttaaattctttaattattcgtagtggcatttagctcagctcagctcagctctgcaattagcacatatttgattagctttagggaatgagtgtggtgagcttgtaaatagaagaacactagtagatggcaagcaaatggaaacgatcgatgatgcagtagatgttactgcaaaaatggcaattattagatgaagtcgacacacaaagacagatctcgtttcatttgtacattctacagtctacgtcgatgaggacatgactggatttgtatagcaaattagtactagcagctaataagtgtggattaattatgaaacacgattgtttaattatgcgcttggcgagtcatgcgattctttttcctgaaaaaaccgaacgaaccatggtgttcatgtcgcgatcagaattcagaacatgtcaagatagctctcgaatcttgccagactctgcaggagacgtacatgaggagaactgaactgaagaagtcgttgcaaggttggtaatctggcatgggtaaaaaatacgtgtgctctgaagcaaatacgtcaacggtagctttcaggcttgcgtgccggcttaattttgatgaagctgatcgatcgatcaccgcatgagttgatggattgaggtggtgtttgtatcagaaacttaactttagtctttttatttagacactaatttaaagtattaaatatagactacttacaaaactaattcaataaatgaaagctaatttatgagacaaattttttaaacctaattaatctataattagagaatgtttactgtagcatcacataggctaatcatggattaattatgctcaatagattcgtctcgtgaattagtccaagattatggatgggttttattaatagtctacatttaatatttataattagtgtccaaacatccgatgtgatatggaattaaaagtttaagttccatctaaatagggcctgaatgaaatggtttgagagataactttcggttttaattgcgtcattgctggaatctgcaactttgtctgcaaccgtgatgtggtgtatgatttctatggtgtgcttgatgatgcgtgtaactcttgcggtcttgcctctttctagtactgctataaaatgactcttatgctctctgtttttttccatcttttttctgaaagtaacctatggtggctctgtggtttcacatttaactagctttgttatacaccaaaaatatcgattgaccgagatagatatgcttggtacttctttataaagtgtttttgaatttaaattagtttcatgcttaagaatcattttaggtgaatttttacttgtcctcttaggaatcactaaaaaagaacccgggcaataacaaataactaagaacaactctaaaaactaactcgaaaattagaacctaaaatccaaagtggattataacactatatggagtcctcaagtttgatgcttatcacatacagctgattatcattaaactcctaacttctttttaaccaaaagtttatgatttgatcaactacgcggatgcatgatccaaacgaaaggtatgctcatcacggtccagataggcctcaaaattgcagcccacccagaataagtcactttctatcgagtttaaatcacatccctataccgcaatacaagaaatctcatcctcaacatgcaaaaccggtttaaattatgtatttgggctatatggatgatcggttttgctgacgtgacaagttgacctaatacattcatgctgactagcgtttacgtggcaaaaaagaaagaaacaaaacaaaagtggaacccacgtatcatcctccctcttctctcttcctcgtccatcatctccattttgttctctgtctcttccccttggtcctgtcgagcccgacccatcatccacacgcgccattgtttgttgccgaaaattgaaaaggaaaagaaggagaaaaaaagccgatatattgacagcaattaagagtattcatagtgtcacacactaaaaatatgctactcctgtacactgtggtagtgccacacagtcgctgaactccgatcagttcacgcaaagtcgccatgggttcgcacggcgacagcaccggcggcgtgtgtgaatgtgtcacggctgcgacgcaggcggcttcggcgagtgcgacggcggcgtgacggcctacctcgcccacaaatgggccgaaattcgcggcctattccaaacgaggccgtagacaatgcaggcccaaatagcccagcaccgactgcttcggctgctttcccctccttcccgttccaggcttcccctcctcccctctcaccacgccactcccctcctaccccactctcgtctcggagaaggcaacgtcgccctcgccgccgcggcggccggatccggcggatggcgaactcgaagcggctcccgtactccacggccggcggcggcgggggaggaggaggaggaggggggaggcgcggcggcgcctccggctccggcgtggtggcgccgctggtggtcctcgtgttcctcttcgtgctcgcgccgtcgatcttcttcgtcgcgcgcaatgggggccacgtccacgtcgcctcaggttccggtttgcaccccccctctcccccccccctgatgtagcatctagattttattattatttttttggtggggtggggactgggagtgatgtcttcaggtttggtaaatttcccagcgttggtctcatggatattgccggaatggaatccgagtagattttagtggtactgttgttaaatgcaattgatgagttgtatttacagggtatggtatgattttggatgagaactctgtatatagataattggatcatgatgctttgttttggaaacgcaaataatcaatctcactttggagaaatcatgagtttacagcagacaattgaagttgtgcttcaagtgattttggaaatcattttcccctctcttgtagtgtcacttgtgccattgcgaggttagaatgttagatgtgtgacattgtgcggaaagccccagctattaagaagctagggcgcacaagtgaattgtgggtgtaattctagtgccaaaagcccataaacaagaaaactgcatttataagaactgtaggaacattgtcaatgttttgtagtatttgaatactgctatactgatttgaaatatgtaagtgatgttgtattctgtttacctgcagatcccaaggatagggaaggtaatcaggtatttatcttttctgggagctagtcaattggtttactagcctaaattttgaggatccatctcactttaaagcttgcttgcaggaaacagattggcaaaaacaactggcaacaaacaacctgaaatctattttgtccaaggaggtcagaattgtcttgcgacttagtaatataatttcttatctttattttttggtttcatggaaatgtacaagggtacataacaacatgctcatctttgctatgctactaatttcgaaatgtcatgatctctgatttgtccttgcaactgattgccctttctctaaataccatgctactctctattgttccaagtagatttgcatgctgtgtcctctatctgctctgtaattctgttgcgaacattttgatttttcaattaccatctactgttatttgcataggaaactgtcatcttgttcagaagtatcctcgatttttctgtgcttttagtcttatgcataccttttggtctccagatgatcgatgctttagcttctagtcaacaagaagcaggcactttgagtgttgattttttcagaaaacgtgcatctccctcttggaaaactgatgatctagtcaatgacctgagcaatgctagtttggatgttgatgacaaggttaaatctgaaaacagttctgcagaacatgagttatcactgacagataaaacacccaaggatgatactggtataaaaataaccatgactttttttgaaaagcacatttcacacaatccgattaggtactcaagaaaatatacttcttttctgtgcagctgaacatcaagtcgatgcacctgcaaaaaatgctcgaagggtaagcatgctggtcttcttgtatgtacattgatacattgttgtttgtttctatcgatatccatttcttatgacctaatacttcccttgatatgttttggtcgctaaagaaactaagggagaaaaggcgtgaaaagagggcaatggatttggtaaggaaagatgatgaagcacgtgttaagctggagaatgctgctattgaacgatcaaaggctgtagattctgctgtccttgggaaatacagcatttggagaaaagagaatgagaatgagaactcagattcaacagttagattgatgagagaccagattatcatggcacgtgtttattctgtgcttgctaaatcaaagaacaagaatgatctttatcaagagctgcaaaccaggatcaaggaaagccagagggctgttggagaggctactgctgattctgaccttcatcataggtgttatatctgtgatctgatatcttatctattttcacttcatatctgatatcttatcttgttctccatcgtgacaaataatgtactttgcagtgcacctgagaaagtcagagtaatgggtcaacttctatccaaggctagagaagatgtgtatgat

SEQ ID NO: 39522 - DNA, 1869 bp, Oryza sativa
catggtgagactactactttcattattggatcacattgatttagagaagaaactgtaatgcaacatgatttagtctaacattattcttgctatttttcttctaacagaatgaagaccgggttctttggaagcttgggacgcttccacctggcctcttaaccttctacaagttgacgcatccccttgacaagtcgtggcatgtccttggattaggatacaacccaagcattgatcgctcagagatagataatgctgctgttgttcattacaacggtaacatgaagccatggctggagttagcaatgaccaagtacagaccatattggacaaggtatataaagtatgatcacccttacatccgtggatgcaacttggcggagtagatatgatgtaaaaagctgacggagaagatcacccagcctgatcagaggtgcttctattaagtggagtaaatacacggccggtgtcagttgttctgaaaaaaataaaatgcgttaacggtagctttcaggcttgcctgccggcttaattttgatgaacctgtcactggaactttctctccagctgatcgatcgatcaccgcatgagttgatggatcgaatggatggttgagagataattttcggttttaattgcgtcattgctggaatctgcaactttgtctgcaaccgtgatgtggggcgtcttttttctatggtgtgcttgggccctgtttttaagtccctatcacattggatgtttggacactaattataaatattaaacgtagactattaataaaaactcatcaataattttggactaattcacgagacgaatatattgagcctaattaatccatgattagcttatgtgatgctacagtaaacattctctaattatcaattaattaggtttaaaaaatttgtctcgcgaattagctttcatttattgaattagttttgtaagtagtctatattttatactctaaattagtgtctaaatataggactaaagtccctgatccaaacaccaccttgatgcgtgtaactcttgcttctttctactgctataaaacgactcttatgctctctgttttttccccttttgttttttctgaaagtaacctatgctatctctctagttgaaacttaactggcttgatatggaccaacatattgagtggccgagatggatctgcttggtactcctttagatttaaagcgttttttgaattcaaagtttgatttttgtaatttggggtagatttttttgattgcctgaaaatcattaaaagagatccaggcaataaaagtaatgaaaaccagccctaaaactaatcggagaaccactcactacatgtactcatctcgtccgatccattactccctatatttttaaatatgtaataatgctattaatttttagacatgatgttgagcaattcattttatttaaagatttattgcaataattgttaaagtacctttaatgataaaacatatcaaatacaaaataaatgttacctcctttgtttcatgctataagacgttttggcctctcgaccccacatctagattaactaacatctatatgaatttagacacgtatatgatgcacatatatggatccatgcataaatctattcgaaacccaaaatgtcttataatatgaaacaaaagaagtacttgcatagtattctaaataagacaaattgtgaaacattatatccaaaaattaaaaggtcaaggcgtcatatatttcaaaatggaggtcctatactattaaattcctaaactctaaggttaccaaagattttatgaactggttgacaaaataaaggatttatttggcagaactctagctcccaattttacgttggatttgaag

SEQ ID NO: 39523 - DNA, 2673 bp, Oryza sativa
caaggcagaagcctagatggttttcaaaaaggcccaaatagcccaccatcggttgcctcacatcttcgggtgctttccccttcctttccaggcttcccctcaccacgccactccccccaccccactctcggcggaggaggcggagagggaagcgcgccgcgcgcgacgtacgtgcactctccggcgaggtggacccccgcggatcctacccttcgctggagatggcgaactcgaagcggctcccgtactccacggccggcggcggcggaggagggaggcgcggcgtggtggcgccgctggtggtcgtcgtgttcctcttcgttctcgcgccgtcgatcttcttcgtcgcgtgcaatgggggccacgtcggctcaggttccggtttgcatccccctcccccctcctgatgcgcggcgctgtcggttgttaatcgcatcctccgtcgcgaatgtagcatctagattgtttttttttttttaaggtgggggtggggactggggagtgatgtgttcaggtttggttagtttcccagcgttggtctgagggatattactcggaatggaatccgagtagatgtcagtggtttaggtactattgttaaattcaattgatgagttgtattagtaggcttggttatgattttggatagaaaacgtagataattggatcatgatgctctgttttggaaacaaaaaattaatccatcgcactttggaggaatcatgagtttacagcagacagttgaagttgtgattcaagtgattttggaaaccattttcctatctattgtagtgtcacttgtgcctttgctaggttagatgtgtgacattgtggggaaagccctagctattaagaatctagggtgcacaagtgaattgtggatgtaattgtagtgccaaaagcctataaacaagaaaactacatttattagaactgtaggaacattgtcaatgttttgtagtatttgaatactgttatactgatttgaaatagataagtgatgttgtagtttgtttacctgcagatcccatggatatggaaggtactcaggtatttttccattctgggagctagttaattgcttagcctaaattttgaggatccatctcacattaaagctttcttgcaggaaacagaatggcaaaaacagctgccaacgaacaacctgaaatctattttgtccaaggaggtcagaattgtctcgcgacttagtaatataatttcttatctttcttttttggtttcatggaaatgtacaagggtacataacaacgtgctcatctttgctatgctactaatttcgcaacgtcatcctctctgatttgtccttgcaactgattgccttttctctaaataccatgctactctctgttgttccaagtagatttgcatgctgtgtcccctatctgctctgtaattctgttgcggacattttgatttttcaattaccatctactgttatttgcataagaaactgtcttcttgttcagaagtatcctcaatttttctgttcttttagtcttatacatgccttctggtctccagatgtttgatgctttagcttctagtcaacaagaagcaggtgctttgagtgttgattttttcataaaacgtgcatctccctcttggaaaactgatgatctagtcaatgacctgagcaatgcgagtttggatattgatgacaaggttaaatctgcaaacagctctacagataaaacactcaaggatgatactggtacaaaaataaccatgcttttttttaaaaaaaagcacattttaaatttttacatcgtctgattaggtatgcaagaaaataaacttcttgtctgtgcagatgaacatcaagtcgacacggctgcaaaaaatgttcgaagggtaagaatgctgatcttcttgtatgtacattgatgcattgttatttgtttctatcgtatgcattatgacatcattcatcccttgatactgtttggtcactaaagaaactaagggagaaaaggcgtgaaaagagggcaatggatttgtaaggaaagatgatgaagcacgtgttaagctggagaatgctgctattgatcgatcaaagattctgctgtccttgggaaatacagcatttggagaaaggagaatgagaatgagaactcagatttgacagttagattgatgagagaccagattattatggcacgtgtttattctgtgcttgctaaatcaaagaacaagaatgatctttatcaagagctgcaaaccaggatcaaggaaagccagcgggctgttggagaggctactgctgattctgaccttcatcataggtttgtgcctattttcacgtcatatttttatatctcatcttgttctctatcatgacaaataatgtactttgcagtgcacctgagaaagtcagagtaatgggtcaacttctatccaaggctagagaagatgtgtatgattgcaaggcggttactcagagacttagagctatgcttcagtcagcagatgaacaagtcaggagcttgaagaagcagagtacatttcttagccagttggctgcgaagacaattccaaacagcattcattgtttgtcgatgcgcttaacaatagattactatctcctcccgttggagaaaaggaagttcccgaggagcgagaacttggaaaatccagagctctaccactatg

SEQ ID NO: 39524 - DNA, 1510 bp, Oryza sativa
agattattgctatattcggttgaggaaattgatctactaaaggaagcttatctagaagagaccgagttcaaagagaatgcggcatggcaaatatatctattaattaggaatagtttgttagtttccttttatctttaggaaagtgtgtttagtgtcctatcaggactttatgttttccttttatctttaggaaagcttctttcttgtccgacaaggacttgtatcaacccatgggtataaatatgtatacccggggtctatgtaatttatcgctacgatcaatacaattcggcgcatcgccaccctttttacttctacttttgtttttacgttccggcggaacttggcacccgacgcggggctgcttcgttttcgatctctggcgaagggataagtccaatgttccgtcggtccaggcaattgtatcgtctacgtcggcgtcgttcaaggctacatcagtacatttgacctcttggattgctctggtttggatgatatatttgcctacctatttatcatatgtctctgttaatctagtcttagcatatcaatttagcaatatcggctgcttctcgttttagggtttctgccggtatcggctaaatcgcgttgctagattagattagcttagacatctaccaccctgaaaactcagtcaacggcttgattgtatagatattatgtttcttttcatacttagtgctgcatcagttaagtttgatctactaagtcgagcttagaaccataatctctagcctgcttcttgattgccaataagggtttcatcggggtttcagccgatgagttatctggacgttgcatcggctcataaggattgcatatacatataagttcgatttagccgatgacaacaaaggtttcactgtttaatctaaacatgtggatttcatgacatcggacctccaaccgatgtgtgctttaaccttcagatcgatgcttatttatcatatcattgctagccaattggtttatactggattatattgttattttattatatcatcatcagccgattgcctttatatcattatctacattggacataaagccaattgcttaaaccctatcgctatcggctggtatcggcatcggctattatcggctatcggctggaactactccgtcggcttgtcagccgatcggttgttttgatctactatttgcatatcttgtcagttgcaggatcaaactgactggcacgcccgcatctcaccaacctttggacctgcactggagcaaagcagatctcccaggccagtgtgttcgattttttcatcaacacaaattggcacgcctggtgagaccacgaattttatatccacatgtctgaagaagaagtcaatgccaagatcatggtcacggtggagaatttaatgaggaacaacaatatcggctcagggggcaagcgcatcagttccagcatggtggagcacatcagtatcggctcatgaaagccgattgcaagaaccaaagcaagatcggttttgga

SEQ ID NO: 39525 - DNA, 25922 bp, Oryza sativa
  unsure (1)..(25922): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcagacaagggatgagacgatcccagaagcctgggaacatctgcaagaatacgtggccgcatgtcctcaccatggaatggacgactggctcattctgcagagtttctataatggacttactccctcatcccgggatcacctgaacgctgctactgggggtgccttcttctcaaaaccagttagaggggccattgatcttatttagaagatggtatcaaatatggatgttggtaattcttaacgtcattactagaaatataattcccagcaatggcgcagaaatactcctggtatattgtggtcacatatttcatccgcaagcgcactgatataccattgtagcatttcacctgagagtattccaagggtatcgtatttgtttaatcccgtgggaagattataatagagagaatcatagtaataatttatatgttacttgcaataaccaaagtctaagcaggggttaatattcaaagggtagagtgacacacaagcataagactactcactatcatattaaattatctgagctaagtggaaagaaaatagaaaagaatctatttctatacttctaagggtatcgtatttgtttaatcccgtgggaagattataatagagagaatcgtagtaataatttatatgttacttgcaataaccaaagtctaagcaggggttaatattcaaagggtagagtgacacacaagcataagactactcactatcaaattaaattatttgagctaagtggaaagaaaatagaaaataatctatttctatacttctagtatacatattatacatacatcctagcaataagattaactagctaatatcctctttctcatgccctcctggtactttgagaagccgcccctaactgccgagtttcttacgatagctcgtcatgactatacaaccggagctaaatacggaggaataccctccccaggaaattaactaaggattatatacatgcgcggacgaatacccgtactgagctgtcaccatcagcagcccacctctcttccacagcatataaacccaaataatgatacccagtaattagggatgaaaacggttggaaatggtcggaaacggtacattattttattatttttttcgaaaacgaacggaaacggtcgggaaatttccatatttatgaattcatctatttattgtcaacttcaatgccacactgacagaaattaaaaaaaacttaaatttgaaaacggtaacatcggtaaaaatattattattatattagttttgcggaaacggtatctgtacggtcgggaaatttccgtaccgttttcacccctaccagtaatctagacaccacgcctaaattactagatactactctaatatcctcatcatgacttagagtaattgcataagcaaacattatacctgtaccattgcatctcctggataagctagcagtttaatcaacataactcatatataaagtaaaattggtattcatatactcggaaagtattataataccagagttggatacagaagaatattctaaataaagtacaagtcttacataagaacaaaggagagctactagagccatacccgaactcttccgaagacttctggactcagacttctattctattcctactccactagcttgagaatactaaactaagcttgagagagtatgaaagagcttgcttgaggtgtgtggagaaagtgagaagaggagctccttaaataggctgccaatgacggttgtggcaattggaatggtcagaattgcccaatttttattcaacttttattccggaagttttcaaatgagtcacatttcttactgagtcaaaaaattagactaaaatatatgactaaacatactcaagatcaagatcgtgcaaagtgtgtgtgtgatatatggtggaaatgaaatctgaaaaataaagaaaatgcttctcctttgtgcttacttccttctcccaaaatccttctttttcaaacaaggaaagggcatggctacattattttctctcctttttttcatcatcacgctcatgcttgagagagcataactttattattttcataaccaagcctttccctccctcttttctcttttttttgaaaggttttcctttttaggagaagaaagcacataaaagcatggagaatttatttttggtggtagtatggaaatggaatggatagatgcttgctcccagtgtaggagtttagcatgtgcatatatgttggtgtatgatcttgatcatagagcatgagaagtatttacacaagtcacaagaatttgataaagttcaacggaattgcaagtaaccaaaatatatatggcttaatcaatatggaatatttttggctctagtaggaatttatatcaaatgaggaacttcataagttatcattttgaaaaataaaacatccggaattcgagtcaaacttagaacaggatcaaagcaactcttatttactatctcatatctcgcaacaacttagacttagatcagcaaatacagctcatttacctcaggttccaagataattgttggctactcatattcaatttttgagagagtacttacccatgaacccatacatgagagatataaaacatagcaactattcatcagttcaacaaagagaactaagttgtcttacctagcataataaaatctaacctatctttttggtattttctattttgcaaatttttatgttgtttttaggtttataaatgcaattggaaagggaaatatgcaatgtgatacaagttaccttagtggggggagagacatctccctcccaagcttggcttttgctcagggtccttgataaggattgaacccctggaagcggaagtacgcttgaaggtcatcgtgctgttgctgcatcatgttgttgatgttggtgaactgagcatcagcattctgttgccattcttgtgtttgtgctatgtgttcctcaaggttgtgttggttctctcccgtctgcatatcaagggtatccattttcctagtgatttcacccaagtcacaacgagaggaacttgagcgccattcactgggagatggaggcataccacttgatttgggggactggttgttccagactccccactgtatgtcatgaggcgcctgccaccggctctcgctggcactttcccagctcgagactccaatgctatggcgtggagcttgggtctatccgggtgcatccccagttggctcccaaacagcctcatacatctgtacgggtgttgaggacgttgaaccttcatgttcattccttgccatgttgtgtgtcttcctgtatgtgcacgagattcttctatggtatgcaggggaatagttagttcatgacagttgtacaaatgatatcccgcgttaggcaacgtgatttcatttgtacaaccagggaagaagtatatcaaagatctatctactccaggtttaagaatatgccctttcactagataactctcatcaacacagggacgagcggttggaatataagcaatttggtcattggtaaataacccctagtccctttgctatacgagtaatcaaggaagtgcactcaacaagagcagtaaatcttatactctctaaccattaccttatcatacatttcagaggagcaacgttaatcttcctaaccatggcaaacatgataaacatgataatcaattcatcctctctgataggtctaagatcacctctaggaaacaaagtcatagaaatccatttgtgcataagcctaagtgtaggattagggatatcattagtcctaggtttcttgcaaattggagcaccagaaatgtcttctcgaaatctttttttctcaaactcggaaattcctttccgaagatcgattttactgcaatcgtaaaaaccaagaagtgtacttaatcctttccatgaaagtgtatattcatcatggaaaaagcgaaaggaaattacatcttctatttctttcaaagtgcttagaaattgcaaagtaagcaaacgagaaccacgctcatctaccacaacaaatatctgccatccaacagctttccaaatagcacgaaagtcagtatccatacctatctttttcagcagcgccggagcgtatactcgcgtgtgagcatactcccggtctttcagcatgtagtaggcttgtctttcccgatcaccgacaaggtcgaggtcagcgtcgctcaagagacgttacgaaacgtcagcatcctccattgagacatcgatggatgaacgattgctagcctcatcatgatgacttgatggagagccgtgtaacttcttgaacagacggaatagttgtctcttcattctgcacaaaggaacaagaacggactaactcggcgggggttagaataacaagagtttcacccgctgtcatgccccgattttcgttcgggattaaaaatcattaaataatgcattttgtagaaattaaataaaatttaaagcaaattaatcaagtgaaataacgggagaattaaagttttcccctaaaaatcattggccgagaatatttggtaatattataatgatacaaagttcatttaatcaatttaaataaaaagaaaaataaataaattctctctttctctccctcccctcccttttgggctcggcccagttttccctccctcgggccggcctccctccttccctcctcccttctcccttttcggcccgctcggcctctctcccttgaaaagtctacatcgccccctcctggtctcccctctcactcaggctgacagatgggtcatccccaacctcaggcctacaattgtcgttgccgccatggccgcccgagccgccccacgtcgccgcttcccccacccacctcctccaccccacgcgctcttgcctggctgtgggacctcgccgcccacgtccccgctgtcctcacccactccgtcccatgaaaaccaccaccgcttccccgcgacgattccacccacgttgtgccggttactgcccctctcggccccgatcccgccgctccgagcccatataaatgatccccggagcatcctctctcttttccccatttttcccgaacctgtcacactctccctcgctctcgcaacaccgcgtcgcgcgccgccgctcgtcggcgtgctccagctgccggctcccgccgtgttggccgtcgccgcaccgcgccgagccgcacctcggcatccggtctgcctccccgtatccctatcggaaccacctccgcaccgtgtacccaagccatcaccgccgttcgctgcctccggccgccctccaccgccgcttcaaccaccgccactgctcgctgcttgcaccattggcttcgctgtcgcaagagcaaggccgaccgccggagcaccactttcgtcatcgacccaaggccgccgcctcatttgccgcctccggtcgcagattcccgcagttcctgacctcctcgcggtgcgccgtcgcttccctcggccacgcaaggaagagaagaccctcggccaccacctcctcgccgccaggagccgccgtaatgtctccccgctgagtcccgccgcaaacgccgtgctcggccagtgttcctcgccgtgccgcgacgcctctccctcctctaacccctcatctttgctcccctcggccgcacctccgccgcggtaaggagtcgctggagcgccatctccgaccccaacccgagaagcgccgccaccaatcctcgtcgtcggtcgcctccccgtcttcgcctcaccgtccccgtcctctcgatgagccccctctcccttccccgcctcctcccgtgtgcgccgccaccgcccgctgccggcgaccatcaggcgccgccgccctgctcgcccgtggccgcccggcccctttgccgtgccatgcctgcccgtggtcgcccaatcggccgccctagccgatctgggccatccacgtggcctccctatgccacctcgtgtgggtgccctcgtggcaccacgtcggcgccacctccgctcagccgttcgtcgtggccgccacgtgtctgccacgtggtgcaccgcgagccggtgcgcgcgtggacttggtccacggtgcacccgccacccgtgagtcaccgatgggtggggcccgcttgtcggcaccaacccttccccctcggctgacgccaacaattatttaataattgtgcaaaaaaatcgatattaattatagaaattcatttaaatggctcaaaacttctaaaattcatatctaattcatacgaactccatattgagccattcaacttgcaaaattcatctaaaattgagctctatatgttttataattgccatgtactgtttcatgtactgtttgcttggtttttattagagtttttcctcgttttgcgtgccagcgagtagattctgccgtttcggaagatcgtagttgtgtggaaaagagttcagaaggttgttgtgaagaagcaaggcaagtcacacattccccttgagcattttgagcctaatttacaaattttttatcatttgcaaataaacatggattgttttgctaattacatgggatcagggtttacctatatgctcgcttgttccatgtttacttgatatctgtcctttgtcaacctcgggaaataaatcgactagctcatgttacttatgtgacctagtagaaattttatgcttagccatgcttaattaccactagctcagttgatgggataattatagtattagactttctagtatcatgacaagctgcgtgctcgagacaaccggccatgtttcattggtcaagattatccaactaaaatgcaacttattggtgggctatgggtgcatggttttgctagtcgcacccatggcaattataggcgattaaggacatgtgagtccaaggccttgacggtgccttgtagccttttctcgtggtcatccaagcgtttcatgaggaggtccagcttggcagcaagcatctccgtctccttgacggtgtgcatgccttgctaacgggtctggagtcgttcctcgctccagcccatattggagaccattttctctataagatcgatggctactcgaaccgtttttgagaaaaaagctcctctagatgccgctccaggtggtcgcgagacgtaggagtgagtccatcacgaaggacattggttttgctcagtggtatgaattttgataggaatgccgtaggaatgcccaggtgttgatcgtggcatggttggcataaaaccattgcttcgttttcccaaggagggaaaatggaaacaatcgcagcctgacggcgttcggactgacacccttcatggtatacatgctgcagatctccaggaactgttgtagatgggcattggcatcctctttaggcttgctgcagaacgggctagcctgcgccatcatgattaggctggacttcagatcgaaatctacgtctcccatgttgatttacagcccagtatccacgctgtcagcagaaggagcagtgaattcacggagagttttgtcagccatagtcttgaaagttggtagcgctggtatggctggtttctttgtcaggagaattttctgcggagtgatgactcgcggcttgacgctctgaaagaaagcctctggattttccttgaagttttccggcaagttgaaaccagtcatgcactaccctgcttccacaataaaagtgaaaacaaccaaggttagcctgcaaaggacagtggttatacagaggtaaatataaagtattagtaatggtaatctctttataaatcttccccagcaacggcgccagaaattcttgttggtatttcttaatgtcattactagaaatataattcccagcaatggctcagaaatactccttgtatattatggctacagatttcatttgcaagcgcacagatataccattgtagcatttcacccaagagttttccaagagtatcatatttgtttaatcccgtgggaagaacaaaccgcaggccatggtcaaggcattagacttgcacatcacttgcgaggtctgcgggaacgctggcattcggcaaatgattgtcccaggacctgtgaagaagcaaagttcatggggaacaatggctatcatccacaaggaggccaatggtggaatcaggcccgcccattctacctaggaggcaacaacagcaacaacaataacggtaatttcaacaaaaagcttgctacttacgataaaacccttgaaaatataaatgtcaagctagaaggattctcttctgctttccaaaaccagctgagtttcaacaaaatgatagaaactcagctggcgcagctagccacgctagtacctgctaaggaatcaggaaggattccggggcaacccgaaccttccatagaaaatgtgaaggcgatcaccacgaggggaggaaaatccacttgggatccgctataccctaaccatgtagggaccaagcaagccactgaggaagcatagtcttctgatacgactgaaatagaagaggtggcacagctctacaagaccatgccgtaggagtgctgcgacaccttgctattgccttttcctcaaaggcagaagaagccctccatggacgagcaatatgctcgtttcatggatgtcatctagaagatacacatgaacatacggtcgctcatgggtgcaatgcgagtgccaacatacggtcgctatctgaaggacatcctgaataacaagaggctactgcttaccacggggatgtcaagttaacagaggagtgtagtaatgttatactccactggctcctggaaaagaagaaggatccgggttgtaccacaatctcatgctcaattgggacgcaacactggaccaggccttatgtgatcttggagcaagtgccagcgtcgtgccaaaggacattttcgagaagctgaattacacggtgttggtgccaacaccaatgaggctccgactggccgactcctctgtccgctacccagcgggcatcgccgaggatatgctagtgaagatttgggatttcttcatctaggtagacttcgtcgtgcttgacatggactcagataaggaaacatctctgatccttggacgtcgattcttaaccactgcgaaagccagtattgatgtgggagttagtagcatccggttccacaatgctctatggtcaagatcaggtatgggccgaatcctcaaaacatcaaggacgttgaggtcaagccaccaaagacggatagctagatcgctttcatgaagaacttcctgaaaaaaagaagcaaccaagaccaggccccgtccgaagaagacgctggtaaaacctggtgtacatgccaagcagcctgtgagaccggctcccaagaagccgccggccacacctaagaccaaaaaggtgtggtgggtcaaggaaaatacatccgctgcaccaccttcggagacggatgaaaaatcttcacgttgaacagctggaggtatggtcctactcatcggacctaaaatcgacgactccctcgccaataggtaaagttggtatgtatctcatattttctgagcaacatgaaagtaaaatttgtggcattcatcaatgtgactcccacacatgaagccattggaatccaacggctgaatgtggggccagtggttcggccgaaccaggcgagcaacagttaggttcctcccttttgacgccaatggctagtgggtcccacctcacagttacagctatttgatatacactacataaggggtatggccgagagaaggggttcataccattttcaactcatttccactcctcaacttttcttttgctctcaagctagttcaagctttgtctcatgttttagaatcctacatttgcatatacaagtcactttagtgcaaggctaactggtgggcagatcatcttgtgctaacttaacccccgctcgagtttgctttgtgctcttgctcttttccagtcatgaagagatggctctcctgtctgttcaagggatccggctcagaatctagccgccatcaagatgagtcaagtgatcggtcatccgccgacgtgtcgatggaggatacggacgcagtaccgcaactctagagaactccaataagtccaaaaatcatgttttggtgctttttgaactttttcgtacagctggaaaacatcgcacccacatgtgccaatatatgccaatattagcattaattgacaaaaattcgccgcgcgagtcacggagtgattttttgacacggacgtttccaatacacttcaatatgtgcaaaaatcatgtcttggtgctttttgaactttttcgttccagtgaaaaacatcacacccacgtgtgccaatattggcattaattgacaaaagttcaccgcgcgaatcacggagtcattttttgccacgaacgcacccaatacactcaaataagtccaaaaatcatgttttggtgctttttgaactttttcgttccggtgaaaaacatcgcacccacgtatgccaatattggcattaattgacaaaagtttttcgcgcgagtcatgaagtgttttttgccacgagcgcacccaatacactccaacatgtccaaaaatcatgttttggtaccttttgaactttttcgttccggtgaaaaacattgcacccacgtgtgccaatactggcattaattgactaaagttcgtcgcgcgagtcactaagtgatttttttgccacgaacgcaccctatacactccaataagtccaaaaatcatgttttggtgctttttgaactttttcattctggtgaaaaacatcgcacccacgtgtgccaatattagcattaattgacaaaagttcgccgcgggagtcacgaagtgattttttgccacgagcgcaaccaatacactccaataagtccaaaaatcatgttttggtgctttttgaaatttttcattccggtgaaaaccatcgcacccacatgtgcaaatatatgcaaatattagcattagttgacaaaagttccccacacgagtcacggagtaatttttcgacacagacgcacccaatacactccaatatgttcgaaaaatcatgttttggtgctttttaaactttttctttccggtgaaaaacatcgcatccacatgtgccaatatctaccaatattagcattaattgacaaaagttcccacgcaagtcacggagtgatttgttgacacagacgcatccaatacactccaatatgtcgtccaaaaatcatgttttggtgtttttcaaaactttttcgttccagtgaaaaacatcacacccacatgtgccaatatatgtcgataatataactaattgacaatagctcgccgcacaagtcacgaattgattttttgccatgaacgcacccaatacactataataagtccaaaaatcgtattttggagctttttgaacgtttttgttccggtgaaaaacatagcacccacgtgtgccaatattagcattaattgataaatgttcgccgtgcgagtcacgaaatgatattttgccatgaatgcacccaatatactccaataagtccaaaaatcatgttttggttctttttgaactttttcgttccggtgaaaaacatcgcacccacatgtgtcactattggcattaattgacaaaagttcacagataagtcacgaagtgttttttgccacgaatgctcccaatacactccaataagtccaaaaatcatgttttggtaatttttaaactttttcgttccaatgaaaaatattgcacacacatatgccaatatatgccaatattatcaataatcgacaaacgttcgccgcgggattcacaaagtgattttttggcacgaacgcaccccatacactccaataagtccaaaaatcgtgttttggtgctttttgaattttttcgttccggtgaaaaacattgtacccatgtgtgccaatattggaattaattgtcaaaatttcgcgagtcacgaagtgattttttgccatgagtgcatccaatattagcattaattgacaaaagttcgctgcgggagtcatgaagttattttttgccacgaacacacccgatacactgcaataagtccaaaaatcatgttttggtaatttttgaactttttcgttccagtgaaaaacattggacacagatgtgccaatatatgccaatattatcattaatcgacaaaagttcgccgcgggatttacgaagtgatcttttggcacgaacacaccccatacactccaataagtccaaaaatcatgtttaggtgccttttgaactttttcgttccggtgaaaaatattttacccacgtgtgccaatattggcattaattgactaaagttcgctgcgtgagtcactaagtgattttttgccacgaaagcacccaatacactccaataagtccaaaaatcatgtttggtgcttttcatacaaattgacagaagatcgccgcgcgagtcacgaagtgattttttgccatgagcgcatccaatacactccaataagaccaaaaatattgttttggtgccttttcagctttctcgttccggtgaaaaacatcgcacccaaatgtgctaatttatgcgaatattataattaattgacaaaagttcaccgcggaagtcatgaagtgattttttgccacgaacgcacccaatacactccaatatgtccaaaaatcatgtttttgtgctttttgaactttcttgtccggtgaaaaacattgcacccacgtgtgccaatattggcattaattgactaaagttcgctgcacgagccactaagtgattttttgccacgaaagcacccaatacactctaataagtccaaaaatcatgtttggtgcttttcgtactaattgacataagatcgccgcacaagtcacgaactgattttttgccacaaacgcacccaatacactccaatatatccaaaaatcatgttttggtacattttgatctttttcattccggtgaaaaacattgcacccacgtttgccaatatatgccaatattagcattaattgacaaaagttcgccgcgggagtcatgaagttattttttgccacgaacgcacccaatacacattaataagtccaaaaatcatgttttggtgttttttgaacnnnnnnnnnnnnnnnnnnnnnnnnnnnnnnacgtgtgccaaaattggctttaattgataaatgttcgccgcacgagtcatgaagtgatactttgccacgaccactaatggttgctcttctctagcatgaaaagtggacatgttcaattcattaatggcacactcatcttgattaattgcagcaccattaaaattacctttggttctctcttcggatgatgtaggtgcatcagtcttctcttcttccttcgtgagtgttgtagatgtcgaaattataagcacataatgatttaatttattccataaataaataatgacattgcagatgtaaactagattgaatgcatcattagatctacacatgactaagcagtaaaacatgaacagatcaaatatgcgcaacatgtcgaaccggttgctcggcaggaactactcgcggttgcgggcgtcgacgaaggcgcgcaacacgcgagcggagaggaaggcgagccgtcgcggacaaacagggagcagtcgcgcgaagcgcttcccaaaaaccttattgccgccttctcccagtgtaggacgtcgaaggcagaggttccagagacctgctctcctgatcgcaggtgcacgcctgcgagcgggatggagtagttaacagcgacggcgcagcacagaggaggaggcaaaccctagattgatttcgtgtgtgttgcgtgaaggcggcggctcggtttatatagagataggtcgcttgatcagggcgcccgcacaatctccactccgcgtaaccgaaccggataagtcgcgcgtaacttatccggactccacgccgttttcacgcaccagatttttcggaatgtttctaaaacaaaagaaatccgaatttcccgcagcaaaacaaaactgcaaaaggaggctgcatctgcgcaagggtgaagagccaattttgcagaccattcgacgcgtacgtcgtgcacgcgcgccgcctaccctgccaggccaggccaggccaggcgagcgagcgcgcgcatgtgctttccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgtgccttagcccatatattaattccaacaatcccccaccaaatctcaaaatcccactgagatttgcctttttccaatgtattgttaatataccagcggttcgatggagaccgattaaggttgaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcaaactcctaggtctttagtaagcttcctagaagattcacccaaaatttccatagactgcgaccaacagtcaagcttacaaaggtgagttctttcaagaatgctctgcaggacagcatcttcgctaattaaagccaacataactcattaaggcatagccaacctgccttgcagctcacgagagtacatgcatcttcacttagagagggtatagatcggtactctcctctagtttactaatggtttgttcttcccaggttctaattcacgggatctccgatcacatagactgggttaccaccatagtataactcacatgggtctcaaacccatctccttcgatgcattatctatcacatttcgtgatagtcccttcgtgaagggatctgccaggtttctagctgtttggatgtaatccaacattataactccggagtttctcaatttcctgacagacttcaatcgtcttttcacatgtctagacgatttcatattatccttagaactattcattttgacaattaccgtttgattgtcaaagttcataaggatagccggcaccggtttttcaacaataggcagatccattaatagatcacgcagccattctgcctcaacagtagcagtatccagtgccgtcagttctgcttccatggttgacctcgtcaaaatggtctgtttgcaagacctccacgaaacagtaccaccacctagtgtgaagacatatccactcgtggctttaatctcatccagatcagagatccagttagaatcactataaccctccagtaccgcaggatacccagtatagtgaagccctaattccatagtacctttcagatagcgcattactcgctcaagcgcacgccagtgatcatctcccggattagaggtaaaccggctcaacttgctcacggcaaaggagatatcaggcctagttgcactagccaggtacatcagcgagccaatgatttgggagtattccagtagattcctagcaattcttttgttcttgcgaagcaacaagctaggatcataatgtgttggagaaggcttactatcaatgtagccaaagcgattcaagatcttctccacataatgggactgcaaaagtgtaatcccattctcacctctaattagcttaatgtttaagataacatcaactactcccaaatccttcatatcaaaattttgagacaagaatgatttaacctcatttatcatctcaaggtttgtcccaaatatcagtatgtcgtcaacatacaagcacataataactccctcacccccaccatggcgatagtacacacatttgtttgcctcattgactgcaaagcctgcagatgtcaatgttttgtcaaatttctcatgccattgcttaggagcttgtttcagaccatacaaagacttcaacaatttgcacattttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaataggtgagtaagtgtcaaagaaatcttcgccttctttctgagtatagcccttagcaacaaccgagccttgtactttttaatagtaccgtcaagcctaagcttcttcttgaacacccacttgcaccccacaggtttacacccatagggtcgctctgtcacctcccaagtcccgttagcgataatggaatccatttcactacggacagcctccttccagtagtctgcattaggagatgcatatgcttctgaaattgacttaggagtgtcatccacgaggtacacagtgaaatcatcaccaaaggacttagccgtcctttgtctcttactccttcgagaagcttcactgacatcctcctcagtgacatgttcatgtgtatgttcagtttgttctggtggtgtgattgaactgggaattacttcagagggttggctcgaactactatgtgtatccttcattgggaaaaagctttcaaagaaggtagcatcacgagactccataattgtaccaacatgcatgtcaggtacctcagatttaactattaaaaatctataggcaatgctgtgatgagcatatcccagtaagacacactccacagtcttaggtccatgtttgcgcttcttcgttattggtacattgactttcgccaagcacccccatgtgcgcaaataagaaagtgatggttttctcccaatccatatctcatatggtgttttgtccttatttctgttaggaactatgtttaacacatgatttgaggtcaacaatgcctccccccaccatgccttaggtagtcccgcggtgtccaacatggcattcaccaagtcagtcagtgtgcggttcttcttttcagcaatcccattagactcgagagaatagggaggcgtcctctcatatataatgccatgttcttcacagaataagtcaaactcgtttgagaaaaactctccaccacgatcagacctaagcttttttatctttctgtcaagttgattttcaacttctgccttataaattttaaaatagtctagagcctcgtctttcgttttcaacaagtacacatagaaaaatctagtagcatcatcaatcaacgtcatgaaatatcgttttccacccttcgtcaacaccccattcatttcacaaagatctgaatgtaggagttctagtggtgccaagtttctctcctcggcaatcttgtgaggcttgcgaggttgcttcgattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggttcacagacttattgcagaaatcagaaagggaaaagcgaaacaggcctccgcactcataacctttaccaataaaatatctatgtttacacatgactactttattagactcaaaaaacaacttaaatccgtctctagtcagacaggagccactaacaagattcctgtctatagaagggacatgctgcacgttcttcagctgcacgatctttcccgaggtaaacatcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagactgattaattgaaaaaacagtaggaaaattaccatacccacttccatctccagtattgccaatggtcacattagtagacttagaagtctgccctgcaggtgccttcatccccttgcgctgtggacacttcctagctagatgaccaggttgcccacacacaaagcaagtcctctcatgttggttaggattgttgttgttcttcttctgcttcttgaagttggtggtctgttgagctttgtatttccccttgctcttgttcttggccttgtgcacaacattggcactgcactgcccaccatcgcccttagacgcggtgtctttttcccgagctttctcctcaacatcaagagacgctatcaacccctcaacggagtattcctgtctcttgtgtttgagtgcagtaccgaaacctctccaagatggaggtagtttcgcaataatacacccggccacaaatttgtctggtaagacacacttaaggagttcaagttccttagccatggtttgtatctcatgagcctgttcgactacagaacggttgtcagccatcttgtagtcatgaaactgctgcatgatatatagatcattgctagcatcagtagcaccgaatttagtattcagtgcatcccacaactccttagcgtcggtcatatgcatatacacctcgaccagacgatcgccaagccactaagaatgcatcccacaaagagagtagtggcctcatcaaattctttctgctgatcagcattaagaacgcccataggcttgtcagtactcacccagaagcatttcatagctgtcagccacagagtgaccctgatctgccatctcttaaagtgcacaccggtgaatttatccggcctcagcgcatcggcaaaaccagccatagtaaaatcaccgcgcctataataaggtttttggattgtcgaaattataagcacaaaatgatttaatttattccataaataaatcatgacattgaagatgtaaactagattgaatgcatcattagatctacacatgtaaactaagcagtaaaacatgaacagatcaaatatgcgcaacatgtcgaacacataccgaggtggcggaaagatcggttgctcggcaggaactactcgtggttgcgggcgtcgacgaaggcgcgcagcacgcgagcggagaggaaggcgagccgtcgcggacgaacagggagcagtctcgcgaagcgcttcccaaaaaccttattgccgccttctcccggtgcaggacgtcgaaggcagaggttccggagacttgctctcccgatcgcaggtgcacgcctgcgagcaggatggagtagttaacagcgacggcgcagtacagaggaggaggcaaaccctagattgatttcgtgtgtgttgcgtgaaggcggcggctcggtttatatagagataggtcgcttgatcagggcgcccgcacgatctccactccgcgtaaccgaaccggataagtcgcgcgtaacttatccggactccacgctgttttcacgcaccggatttttcggaatgtttctaaaacaaaacaaatccgaatttcccgcagcaaaacaaaactgcaaaaggaggctgcatctgcgcaagggtgaagagccaattttgcagaccattcgacgcgtacgtcgtgcacgcgcgccgcctaccctgccaggccaggccaggccaggcgagcgagcgcgcgcatgtgctttccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggccttagcccatatattaattccaacagtagatggcatctcgatcatattgcacttctcctcatggtgaatattctgagctcccttcaaaatgtcagtaataggaggcacaagcatagctcgtttctcccttgggttctttaaaatattgctctcaacactgcaagcaagcatgaacaagtggcctatatgaatatatgtcacgttaataagcccagcttgaatatcagaattaagccctctaaaagatctagtcattttgttctcattgctttcttttaaaccactataagtgatacaaattttaaagttatgaaagtactcccgcatggttttgtcaccttgttttagttgctctaatttctcaaggagagtacgtttataatacgaaaacacaaaatttttcctcatcattgttttgcattcatcccaagtttcaagcttattgccaacagtataccaccaaaaagatgcagaaccggtacatttattattagcagccttaatcatttgagcattagagaaatcatactcatcaaattgtttgtctactgctagcagcagaatcatacttaccatcaaaaactggcaatttagattctacccttgcaagatcattatcatgtacctcatatgtgatgcatgaagaagtcgctatatctcgttgatggtgaagatgttgatgttgagcatgaccatctcgtttccccttgcgcaatcctgccatggttagtagcaaacaagaaacatacacaagaatatgcacgctcctaccaactactaggtagtggcagctgaaatatcatacacacttaagcttttcaccaagctcttacaagtacttaccaaagcaagcggaatggtgacgtacaccgactcaaccaagcaccccaatggagtttggatgtatcgatgccttggcaaacacttgttgtacgactgcaatcaaatctgtggagctctgggtaggcttaaatatgtaacaaaggaatagcaaatgctcaatctagaaaatacaaagttgaatgatcgttcaaagtcaagtaccgtgctcgtcctaggctagaatgtactagagacgcgagcctagacacaaacgatacgacaaaatagcactaggaacaatttatgcacaactctgatatatgaaagcaaactcaaagatacaactgatttttctcttttccttctttcttctttcttatttttcttttctttttcttttctttttttggtgcggcttttttttctttgtttttttacgcacctttctaccttttctcactttttttatgatttttttttaccaaaaacagacttaaggacctcaatgcaagattacagggactcaaatgtaaatataatatatacagggactcaagtgtaaaagtctagaccaaaaaaagaactatacaaaaatggaatgtggaatttatgccggttccgtttttccaaacagatctcgaaaccgacaccaaacaaaaattcaccaagctgtctaacaaatcacggtaccaattgaaaccgagacgagatgagaaggatggagtcggactttcctagtcacggtggtgatgggtgcggtaggtggaagggttcagcctgcccccccacgagtggaaaccgaatccaatcaaaaaaaactttccttttgttttctttcctttttttttcctttcaccccaccgaatccaaacagatctgctatattcgtttttgcaaacagatttccaatgcgacactcgaaaaagaaaatcaccaatgtatctatatgggaagccatgtcatagatgcaaactgagagaaaagggaggagtcgaactcactcggcctgttaatgtgaagggcaccacgaccgaataaaaggaaaagtcgcatgcaaggaaaccgaatccggttaagatagaaaccgatccaatctactaccaaaaactgatctaatctaatatcgtccttccttcttcctcacacgcaacatcacaggcgtaccatcacggcacagccactgaacagaagctatgcaactcaagaactcaaaaactaaccgacagaaacttctgaaaactacaaaaatagtaccgtggcaccaagccgattccattttcgtaggtctcgacgacaacagagacacggaggcgacgacgactatggtataaaacatgaccagaactcgaaactctaaacgaactagatgctaagaccggcaactacgactcgacgatgcaacagaaaactcaacaaagcaaaaattgaaatggacaatgcaatggcacaagtatggctaggtataggatacaattttttttgtatggcaattttctggttataggaagataaaaactcaccgagcaatgaaagctctgataccacctgatgaaccctgagctccactcgagttactcaaggctgttgttggcccgatctttcagagagttgatgataactccgatttgggagaaacattgacaacccgactataaccatactagacgttgttgtgttgcgccttagcgatcgatacacctctccgtgggttgttgatcttgccggtgtagatcaaccgtattcctataagcaaatcgaataaacaatcaagaacaagataaagccaataattgcaaataggaattgactacaaatgataagttggggttccgtaacgagtaaacaggcgatctaaccgatcacgggattacacggcaaagtagcaaagctaaactttaatctaaacaaaacccaagtaaccctgaaggggtacctacctaactataggggtgggaggacgatcaaggggtgccaatggtcgttctccacctggttggggcacaccgcacatgggccccacttgggccgaggtctcaaacanagttacaagccctaggcccaatacaggtgatgcaacaccttgtttatgtgattgcggccaaatgacatggaaattggcgacgaggctacatccattggaaagagggctccgagagctttctatcaagtactcacgggctgaaaacggaggtcgtatgtagattcggcggccgtttgaagtcaacagagtagcaggtggccgaatcggattccagcacttggaggacttcatcttgatatctccttgttcatccatgatgtgagcaatggttgtatccgtccgtagtagtcatggtcacattatcatccttgcccgtgaggggcttgttggaggcatgtcacgagggccttcggctgggtctactaaaaccacaaggaccatgaggtgttggctaagtccaagaggcaaagccataaggaaaagcagctgggcaaaactagatgatgtagaccgaagggtttgccaccaagcccactatcctgacgagccatcactacgggcgaaggccgtaaagcgaagcaggagggttttgcttgagttagaagcggcttcggcagagggcttgggagacaccgcgccccatggaggccttgcgccattaatgggctggcccaaggagttcacttaatagcccgtaaacacaaaggacactgtgtagcctcactaaagtccctatcgtaagggtatccatataaattctcctgtacaaactaaaccctatagggtatgagcctgtattaagactataaatagccccctagggccgtgtaatgggggatcctaaaaaattatcttatcgattaatatattgcttttactattccaacaatctaccgagtgaaccacgtctttcgacgtgacgcggttgtcttttgacaacaagcatgtacctcactcatgtagcatttgcagttacataagtaattaaactataactagagctatcatatatgtaggtgccctcttcttttttgttgttagaaaagaaaggaatttaaaggcaagtaagtataatgttatatctttatggttgtataatagtgagattttcacgaactggatatgtaaatttgccagcttacaatgaatttactgaagttggggtagataaagaagtgaaatattgcaaacaaatcgaggaaccatacatcaagttagagaataacaaattaaattgtagatgaaattcacctagtctagttgttgcgatagattaactcttagctttagcaaaataatccaaaaattgcttttaattggctgtcaaagtattacctaattttacccaacccaattcactgtaagcggaagtacgattgaaggtcatcgtgctgttgttgcatcatgttgttgaagttggcgaactgagcatcagcattctgttgccattcttgtgtttgtgctatgtattccgtgaggttgtactacatctctcccgtctgcacatcaagggtgttcattctccttgtgatttcacccaagttccaacaagaggaactcgagcgccatacacttggagatgaaggtattccacttgatctgggaggttggttgtccccccattgtatgtcatgaggtgcatgccaccggtcctctctggtgcttgcccagcttgagacctcgatgctgtggcgtggagcttgggtccatccgggtgcatccccaattggttcccaacctacctcatatatttgcatgggtgttgatgatgatgaactttctcgttcatttcttgccatgctgcgcgtgtccctgtatgctccacctgcacgagattcttctttggtctgcaagggaatggttagttcacagcagttgtacaaatgataccccacattcggcaatgggatttcatttgtacaaccggggaaaaagtatatcaaagatccatctactccatgtttcaaaatatgccctttcactaaataagtctcatcaatacacggacgagcggctgagataaaagcaatttggtcactaacaacccctagcccttttgctatccgagtaattagagaagtgcactcaacaggagcagagaaccttatactttctaatcattgtcttatcatacatttcacaggagcaactttgatttttctaaccatggcaaacatgataatcaattcattccccctaatgggtctaagatcacctctaggaaacaaagtcatagcaatccacttgagcatgagcctaagtgtaggattatggatatcattcgttctaggtttcttgcaaattggagcaccagaaatatctttgttggtatttcttaacggcattactgatcgataacgaccgtcaacaatcttcccaaaacctattttccttgaacctagaaattcctttctggagatcgattttaaaggaatcgtgaaaaccaagaagtgtactcaatcctttccatgtaagtgtatactttttatggaaaaagcgaaaggaaattccatcttctatttctttcaaagtgcacagaaattgcaaagtaagaaaatgagaaccaggctcatctaccatagcaaatctctgccaaccaatagctttccaaatagcacgaaaataaccatccatacctatctttttcagcagctccggagcgtattctcgcatgtgagcatactcccggtcactcagcatgtagtaggcttgtctttcccgatcactgacaagatcgaggtcggtgtcgttcaggagacgtcgcagagctttggcgtcctccatcgagacatcaactgacgaacgagcactagactcatcatgatgacttgacgaagagccggaccccttgaacaaacgagacaatcgcctcctcattctgcacaacggagcaagaacggactaactcggcgggggtcagaatagcaagagtttcacccgccgattagtttcaccaaagcaacttgtatatatgcaactaagaatttgaatttgagggacactatcaaaccttgaatgaacttgagagcaaacattggagagggaatgaaaatgtgttgaaatggggtgg

SEQ ID NO: 39526 - DNA, 21724 bp, Oryza sativa
caccccctggtgggcccaaccagccccactttcggccgttggattcaaacggtcagtgcggtatggcatagtgaattttcattgaaaattttattttggtttgctctgaaaaatttatttgaagaatatcctcaaaatccgaaaatcctaaatgcaattttgaaattcaaacatgtgatgatgcaaaaattcaaattgttggaaataaacatgcggatacatacaaatttacctgttgacgaaggtcgcgtcattttaggtccgacgtgcaagaccgtacctcctttcagttcagtgtatagattttccacccgtttccggaggtgatggagtgggcgtctttggcttttccttccacaccttctttggctttggtgcagaaggcggcttcttctgagccgactgctctagcttcttggccggtgtacttgattttaccggcgtcttccaataatggttcctaggcattgttgtttccttttccaggaaattttgcataaactttaccagactatccgtcttgggcggctccacttcaaccacttgaatattttgcgggtttggcccgtacttgtttctgaccatggagcattgttcggtccttgattgaaactcaaacttttcctccttcccgttgatatggaaacggatactccctgttcctacgtcaatgttagctcctgtggtgctatggaacggacgccctaggatgagcggcgtctcttttcctgtttccatatccagcaccacaaagtcaaccgggatgaataaatcccgtatcttgactggcacatcctccgctatccctgctgggtaacgaactgacgagtcagccagttgtaggcgcatcggtgttggtgctaacaccgtgaagttgagcttgtcaaagacgtcctttggcatgacgctgacactggctccaagatcgcacagggcctggtcgaactactatgccccgatcgagcaggtgatcgtaggacaccctggatccttcttctgctccgggagcttgtggagtatgacgttgctgcattgctccgtcagcttaaccacctccgttgttgggagcggtctcttgttgttgaggatatccttgagataacgggcatatgttttgaaaagcggaagcgaagccatctagcttaacattaatattttcaaggatcttgtcattgacagctagctttttacttaaggcatcagtggtttcagcttgcgcaaaaacgagatccttcaaggagggttggttagagaagttaccgttgttgttacctccttgataatatgggcgtggctggttccacccctgacctccttgtggacggtacctattgttgttgttgcccatgtacatcgcctgttcacgggtctccgggcagtcattcccagaatgacccgtgttgtcgcagacctcacacgtaacgtgtgagtccaaggccttgacagtgccttgaggccgtttgtcgtggtcgtccaatcgcttcatgaggaggtccagcttggcagcaagtaattccgtctccttgatggtgtgcatgcctcgctgacgggtctggagtcgttcctcgctccaacccatattggagaccatcttctctatcaaatcaacggctcctcgaaccgtcttggagaagaaagctcctccagctgccgtgtccaagtgatcgtgggacatgggcgtgagtccgttgtagaagttttgctggatcagccagtcgtccatcccatgatgaggacaggcggacacatattcctgcagtcgttcccatgcttcaggaatgcactcatccctcgtctgctggaaactagaagtccttccacgaagggcattggttttgcccatcgggaagaacttcgagaggaatgccgtagaacacttgtcccaagtgttgacagcagcacggttggcgtagaaccactgcttcgcttgcacgaggagggaaaacgggaacagccttagcctgacggcgccggactgacgccctttatagtgtatgtgctacagatctccaggaactgctgcaaatgagcattggcatcctcattaggcttgctgcagaacgggctagcctgcgacattatgatgaggctggacttcaagtcaaaatccacgtctcccatgttgatctgtggcccaatggccacattctcagcagagcgagcagcggactcacgaagagtcttgtcagccatagtcttgaaagtcagtggcgctggtacggctggtttctttgtcagtagagctttctgtgaagcaacgactcgcggcctgacgctccagaagaaagcttctagattttctttaaagttttcggcgaattgaaaccagtcatgcactaccctgttttcataataaaagtgaaaacaaacaaggttagcttacaaagggaaatgattattagttcaggtaatctctattatgaatcttttccgacaacggcgccagaaatgcttgttggtatttcttaacgacattactagaaataaaattcccagcaatggcgcagaaatactcctggtatattatggttacagagttcatccgcaagagcacggatataccattgtagcatttcacccgagagtattctaagggtatcgtatttattttatcccgtgggaagatcatgtagagagaacttgactaataatttttatattacttgtgataatcatatcctaagtaggggttaagataatcgaagggtagagtgacacacaagcagtaagctactcattctcataataaaatatataagctaagtggaaagaaaagagaaagagaatctattcttatacttctagtatacatacattctagttatccgatatactaactaataccctctatccgatgccctcctagtacttcgagaagccacccctgattgctgagttccttatgacaacccgtcatgaccacacaaccggggctaaaatacggaggagtaccctccccaggaaattaacttaggactatctacatgcgcggatgaatacccgtactgagctgtcaccatcagtggcccacctctcatccgcagcatataaacccaaataataatataccgtaatctagaaaccacgcctaaactaccagatactactctaatatcatcgtcatgacatagagtaattgcataagcaaacattatacccacaccaaagcatctcccagataagctagcagcatattcagtataacatgaacataatgtaaagtaggtattcatatactcggaaagtatttcaataccataaatgtataaagaggagtattctaataaaagtacaaagcttacaaaagaggaaaggaaagctactagagccatacccgaactcttccgaaggcttccgaactctattcctattccactaacttaagaacactaagctatgagagagctcttgcttgaggtgtgtgttgaagtgaagagagtgaaatccttatataggctgccaatgacggttgtggcagttggaatggtcggaattgccctccaacagtcattggggagtgatccatgccgtccaaaaaaaaccctgcatctaacggtgccaagggggttcggccgaaccccctggttcggccgaaccaggggccggcccaacctagcccaaattcagcaggtggcctcctccgttgcatcacttcgtagacttgtgaattttggcccaattcatcgtgtcaattctgagttcttggcacattcatatataagtctgattctcgacacgtccgattgatttatcgcctgtgttgatgtcgattctcctccactttatgattattctctgcaaaaggttagtgaacctaatactagtggaatattattattctaacatatgtatgcattgcaagcatcactagttctcctctattttggtaatattgacggtcgaaactgatcgataacgaccgtcaacagtggacctctaggcttggacaaggccttttatgggcttacttcattttatttttacagtgttttcaatgaattcaactctgagagtgatgtttatattaaaaactttcaactttcaactcaaaatttaagacttttaagtcctattttgtaactttcaaatgatacttctatcgacgagtggtactcgcggaccggatgcatagagtatcggggtacgttggaacaggggtctacgtagtacgacatcaaagcagacaaaagacaaggattatactggttcaggccccttgtcaggtaatagtgctaatccagtttgtatgggattgatgatgatgaaaacagattacaaagagagtaactgaaacaggcgataccgacgagatcgtagtcgagggattcgacaagacctcccggcaagtcggctctgcatactccggcttcgtaaactttggtgggtgtgttggcgatgagattcgatgcccttcgcctccccttaggggtcccttttataccgtggaataccttgacccccaagtaagacttagggatatgtaaactggcacgatataaccagagattttaccctttccgagtaggattccggcaatttcttaactcatagagatattttccataatttaagatagattcctaacggcgtatacggaaacaacccgtacacgtgaagatataccttatagggatgttccataagtcgtaggatagagggtatgccttatacgtaaccctgacagtagcccccgacttcaacttaaatgaattcatgttatcgcttgcgacttctcttgataacacgttgtcgtactcgtgtcgtaggctctccggaccttcattatatttgagagatgaaatgaataattcaagtcatcaaacaagcataatgaaacatccgatgcctcgagagagaaatattggagacattgctgagcccttagcctgccagtcaacttcagcctgatatgtgcccgtcaaaccactcgaaggcggcgaccagatgtgttacacattcaggagacttgacaaaaatggctaaagatctacaacctctcaaatattcctaactcatactgatgtaaatctagttcccaagatgtgcactagattaacactttcatcttaagcatgattatacatagcaaacacaactaagatgaaagaagcttaagacttacaacaacttaataattacataggccgaccggccaaatagacttattagagaacagcggaagcttgactacccattcacaagcacaccaactaggggtttaccccattaaattctcatcctagaagaagcaatcggaacccgcatcactcaaagactaagtctaaacctgcaaacaaaaggttatatcaacagcaagagtcagtacattaaacaagttaatgtactggcaagcacaagtcatactacatgtaaggcatatattcaaaggaaggcaatatgtagttcaatttcagcataaagcaagttttgtttcacaattcttttgtaaaggagttgatgcttcaattaacaaagacaagttttaagtttcattattaacttcttcataattccatcataatcaatctcttattgccatacttaacaataagtcataatgtatcaccacacacacaactcaacacatttatcaatttcaaaccaatgtcacatgatcacatttttaaaacatagtctatactcatgacacatcaccaaagcgctcatgaccgtgagcacagctaatcgattagtttaaagaactctgcagagtttgtacaactttacccacatgatatgaactctctagtttgttttgagtttgcaagactccaccacactcttcacgttgaatgtgatctagaggccataacgaagcctttacactacttagagcctagccttgcaccagcacgatacgtgttcctccatcctaggcatacttggaatatacctagaaccgttaagtggcgggcccacgctttaaacttaacgccgtggtggcggacacgacgggaacccaccacgtggcacaataccgttgtattggacacacttggtcacctaaactaccacgtcggggtaaataggaagctcctctgaattatacgaactcatacacaccggcctaccagaatgcaaggctagtcctaaatagattaataagcttaggccatcccataatagcacatgtggatgtacgaataactttaaatgggtgacacaagttcggtccttatggacttgggcaaacactccccctatcggtatgcaactaacaccatatgcacaccacttgccgcccaagtataaaatcacattttacatattttagttcgcaaatacccatcatattcattttatttcagcaaaggttcacatatgaaaatcacattttaattatagatggaatgagcatttgcatatttctaagcatggctaagcaagtagttccacatagagcatatataaacccatttgagcacaaagagtgtaccgtaaccatttctaggggttcaagctgcaagaggctcaattattcaaggtagggaatgcagcaaataggtcataactaccttaacccaattttaaataccaatatagtttaagttcacatgcaacgttgcaaacaaacattttcattcctcaaatcatgggattcaatctgttcaaaggatgggaggagaaaacttaccttgatcagataaatgttagcacctaatccacttcttcaccgattatgcaattatctagataaaggacacgatatgcaattaaacaccgaaagagctaaaaatccaaaatgctctaaaatgcatgatttatgcacagtgggttggtactgatctgaaatgaatttaggtgaaataattcctattttattttattccatttgggagttatgaattttagaagttttatcggtttatagtagtatagtcttaggtagtgttataaaatacttttgtaaagtgatttttattatattagacttcacaggggtgtggagatgtgttttctaagactaacacatttggtttcacaatttttggagttataatgaatttcttatagattttacaagttacaacgtgttttaggcatatagtgttttatatgttcatgacttttgagttataggttcagaacatgctacttcctgtttgagttgaataaaaggaataatttggttaactaaaacatttttatttcacatgtttatggtctttactactatggttcatattttataaactagagatgctctaatctaaactagcaatatattatattaacctagaaattgtcatatgagctaagttcttctaagttttagtggatgaggatggaactatggcttcactggtcaatcaagtttttatttaggtttaattagacctaaagtgtatatatacttatacatgtttatgtattacttcaacactgtgtttaaattcttatttcactaagttaaggttttgatctatgttctctacaaaaggtgccaaattttattttactatgttgaagataactatttgttggttctatggaaactttgttcatttcatttggactaaaaatgaattttctacaagttttacaaattaaaggctgctctatgttattaaatccttatatgaatatttagagacttttactacacagtaagtatataatcttatttcataacatggaaatacatgttttggtgatcctacaaaacttaagtttactcaaattgaagctaaattgggttctacatgaatttctaaagtttagcttatctaaaactaatcattatagatataatagttttagaggcatttgatgcaaagtaagtaattacttttatttcacctaatcagagagtgcatatgatgaatctgcagtttttgagtttgtttcaaaatgagttgagatgaattttctatgtattttataagtttgtacatgttttatgtatgacctatcttagataaattttagagacattatttgtacagtgagtgtcaagttttatattcctggaataaagttcataacttcaagaatctacagcaactggaatcacttcaaaatgagctatatttgattttatatagattttacaactttgtacatttttctgctaaacatatatttgtttgggcattttcctaattatccttcagattttaaaggatggggtccacatggctgtgagggaccaatatgcacaaaggcccttgaggtttctaggaatcaacccgcagtcttaggcccatatgtcagtgtgtttccacaattgtaaacggatccctgcacttaatctaattcacggaagtcatccctctgctctagacagagcagagctagccatggctgagctcgatctcgagctcaccggcggcaaacggtggctcgtttgaggttgaggtcaagagataaaatgaagagcaagctctcgcgattccattcctctagttttcttggttagaggacatcggagtagcgccgatggcgagtgtgagcggcagtggttcttggggtgaaagtgcatgtgtgcatggaagtcgattccgaacaaaaaggatgcatgcatgtggtcttctagccttcaggatgctcatcgacggcagcagcagtgacttgtggaacggctcggtgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcaatgatgacggcggaggcaattctagatcggcgccggtgaagaaaagatgcgttctccaagtccttcacatctccggctggggttcttgaggcgtgttgaagaggaggttgaggcgatgacgatggcgcagtggcttgctccgaggtggtcgagaatggccggacgacgacgatggttgaagcggcggcgctccggtgcatgctccagggcgttgtcggcgtggcttgcgttcccggcgatgcactgcacgagaggggtttaggtcaaaagaggaaatgctcggcattgtgtggagagatgggaacacgaaagagatggaggtgaccttgactcaaacggagatggcgaaggtcgtcgtcactacgaccggtggcgaggttgaggatgacggagaggctgaggacctctccctcggcttcttcagctcctgagtgatgtgtggagttgggcgactcagtctggaggagatggaggcatgactcagtgacttgaaggcgtcgacacgtcttcaccacgcgtcgacgcgtccaggactcggtcggctctcgatctctccctctctgtgtttcttggtcggctaaggatgaaggacagaggaagggccagctgaagaggctgccaggtgggtccaggtcatggcaaactaggctagggtgagagggttgggcagaagactgggtaaacttgatttttcgattaattttcggaattattttctcctctaactttgtaactccataatttaatgtgtggaccaaataaattagtgttgattttactggaggtagatgattacacctagattccattttctttggttgcacttaaaaataatgggtagactgctcacagaaattaaacaaagatgggctattagaaagctagattgaatttttaggaggtttaaacagaggaggaaaattctagaaaaattatatttaggcatgataaataatctagtatttgaataaattattttccatgttcacttatgagcagttaaatgtacttttggatgaagtatggctttagccgattaaaatttaatttgattccttttagctttctgctttgactaattaatttgtggtattaaacttagttattaacttgtaccaatattatagtgaattgcttgtgctaaacattgtctatctaatttttttccatggtttttaacttgcaaataatattttagagaattaggattactttactttgtatatgtgttcccacttcataattgcacctaatattgttacagggattacattaaacttcttttgggctgagaagatgatatttgagtttaatattaagtccacatgttatcacccaagattaactattggtttgtttagtaattttaacccttttagtttatgctcatgagacctattatgaaaagcgagaccaaaatccaaatgcacaagggactcgagcctaggcatgcattatgcacatgtatgctcaaaagcttgatgacatttctagtctaatgttgggaatgaaaaggttttattttgttctcaaattttaatcatgcaatggtttaagttggtcatcaactaaattaaaacggaaatttttggctctcaaaaattggagaagttaacctctaactattttgacaagaaattttaagtcctagaatttcgggtatgttacaactcgctaggtcaatctcagttgtttaaccgtagagacatggagctatcgacaacgcttgcagggagcccatcgattcgaattttgaatttaaattgaagtctgaacaacggcctttaaagggcctcaggaaatttcggcggcaatctctcccctttcctcgaaatgcgaaccgttaggtagtgcgcctatttaatagaattttgggatccattttgagttcgcccgccataaaacctttactattctccggctccctgggactctccgtttcccccatcttcgacaccttccaccggcgatcctcttccgatgatctccttccaatggcggacctcgagcagtcttcctccgacgcggccgcgttgaagaagttgtacaatgagggggccatccccccaaagcagaccatggcaagggaagcaggaggactgacccttccccctgttaacagtgaaatttggtaagcccggagtagtcatcggcttagagtcagcatcggcttcgaagtcctgagattagtcgatgagagttattaagtcgtcagtggttggattcttgctatattcggttgaggaaattgatctactaaaggaagcttatccagaagagaccgagttcaaagagaatgcggcatggcaaatatatctattaattaggaatagtttgttagtttccttttatctttaggaaagtgtgtttagtatcctataaggactttatgttttctttcttgtccgacaaggacttgtatcaacccaagggtataaatatgtacacccggggtctatgtaatttatcgctacgatcaatacaattcggcgcatcgccaccccttttacttctacttttgtttttacgttccggcggaacttggcacccgacgcggggctacaacgttttcgatctccggcgaagggataagtcgaatgttccgtcggtccaggcaattgtatcgtctacgtcggcgtcgttcaaggctgcatcagtacattcgacctcttggattgctctggtttggatgatatatttgcctacctatttatcatatgtctctgttaatctagtcttagcatatcaatttagctctatcggctacttctcgttttagggtttctgccggtatcggctaaatcgcgttgctagattgggttagcttagacatcaaccaccctgaaaactcagtcaacggcttgattgtcttgatattatgtttcttttcatacttagtgctgcatcagttaagtttgatctactaagtcgagcttagaaccataatctctagcctgcttcttgattgccaataagggcttcatcggggtttcatccggtgagttatctggacgttgcatcggctcataaggattgcatatacatataagttcgatttagccgatgacaacaaaggtttcactgtttaatctaaacatgtggatttcatgacatcggacctccaaccgatgtgtgctttaaccttcagatcgatacttatttatcatatcattgctagccaattggtttatactgcattatattgttattttattatatcatcatcagccgattgcctttatatcattatctacattggacatatagccgattgcttaaaccatatcgctatcggctggtatcggcattggctattatcggctatcagctggaactactccatcggcttgtcagccgatcggctgttttgatctactttttgcatatcttgtcagttgcaggatcaaactgactggcacgcccgcatctcaccaacctttggacctgcagtagagcaaggcagatcttccaggccggtgtgttcgattttttcatcaacacccccgtgctaggtcgtatagtagtagtagaggattttgtccggtgtggtttcctacctccttccgaatttctcttattgatcttgaacttctacggcctttctctcttgcacctaaaccccaactccattgcttttttgagcatatttgctcacctttgcgaggcctacattctggtagtgcccgttttagatcttttccgctttttctatgaactccggtggatgcaagccaatcgggtttcgggatgatgtgaccatggctactatgggtacgaccattgctcacatcatgaatcaacaagaagacatcaagatcaagtcctccatgtgctgcaatctgattcggccacgtgttacattgctgacttcaaacggccgccaaatctacatacgtgctccgttttgggcccggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataagtagttaggtaccccttcagggtttctggggttttgtttagatgaaagtttagccattgctacttgcttgcagcgcgcgtgtcggctagaccgtccgtctgcttgttcttcgaaaccccaacttatcatttgtattaaattcctatttgcaatatcagattgcttttatcttgttcttgcttgtttcttcgatttgcttgcaggaatagggttgatctgcaccggcaagatcaacaacccatggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgagaggaactcaaggttcatcatttcctttaggggattgtttctgtcctttatctttttagatccattgttaagaagcccttttttgagaagagaggttatcctgttgaaagcaagaacaattaacagaaggatagtccaatccctctgccttatgtaaagaggggtaccatctacccacaggtaaagggagtaactatatttatgtcgccatatttttcatcaaaaaatagtcggtatatatttacatcgtaaatttctaaattacatatgtaattttagtgtatttacaatgtaagtcctaaaattacatatgtaagtctctaaattacatatgtaagtataatgtaattataatgtaagtgcaatgtaatttctatattttgcattgaaaattacatatattgattacttatgtgaaagaacgtgccaacgagctacggttaaagcagtgcttcgagccaatcaaatgcaattgatgagaccaatgccaccgaaaaaagcggcgctccagccaatcaaaggcttagaaaaatttcgactgagaattgagaaaaaatatgtcgccatatttatagcaataccgcaggtaaatgtaggaccctgctacctctcatttctaccaatctatcctcttttccaagctttaataataataaaggggcaaagcaccaatagaggagcagggtgggatagaatggtagtttcttagtttgataaatgatgttgtggtatctattaaagtgtgagtaccctcaggtctagtatagcataattactcaccgatatgaggatttgctgactcatggattacaaaggccaatgagaatccgacctacgaaggaagatgttaccatcaaaagaattcagaacattttggtatcttatccacatgtcagtaatcagcaataaatttacacttaccccaacaagaacaccaatctcaataccaaaaattaatgttgtaatgaatgtgattgcccatagaaagaaatccttcttatcaatactccacaagaagatagcctcctcgtagtctacctaaataacgaaaatgtccatgacaaatcagattgacatagtttacatcataaagtgagaaagctacaaaacaaattattgtgacatgtcagagaagaaagctcaaggtggagggtaaaataaattaactatacttattttttaggtaaaagcactaatatgtaaattgttacaatgtttttcaataaaatgtttaggttggcacaatttcgtcagtagcttcctttgaaaaaagcactacaaaggcatcaagattgacagagcatctttttcgataaaggtattttgatatatctgagaaataagatgtccttaccaggctagtgactgcagaaataacaattgcagccaaggcacactgaaggaagaaatatgaaatcaaattagtaatgtgtgtaattaccatagctaataaaatatctgagatggagttttctgcagtgcatgtttagcacaatagtacaatgtttccaacataacattgattcatttggttacaggcttaatgcaacaaatggggctgaaaagttgatttctgcaataaagttatgttttttatttgaagtatcaagagtacaaaactgtggttatttttagctgataatagaggatctcaagtaagactgcattttacataggccagtttctttgctaattaaacctccgtcccaaaatacaacaacttttagctctcaggatttgtcccaaaatataacaacttctccaccaacattctcttcccaaccaatcacaaccctccattcacttttcccacctacctccactactcatccaatcacaactctccaccattcacttttacctactttcttaataaccgtgtccaactctaaaacttcttatattctgggatggagtacagacaaaaaaaccaaattaatgcaggggaatgtagttattgttgcagtttcttagtaagtatctacaggcataatcatcaaccaaaatggaaaagcaaatgcatttcaaaaagcaaaactgtacctacgtttggtacttaactgtaaacaacttgaatatattaaaaggtgtgttatttattaacttttatacacaagagatactataaattagttgcagtagatctgctaaaagtacaacttcaaattaacttgaactgtgaaatataccacaaatacaacaaggacctgtttgcaacaccaaatttcacattattttcattaaaatgcagcaggaatatggaaaaacaaatacgacttccagagcagtaattacaaaaaacaagttgcaaaaaagattctcagatggcaatctacatggaaccaatacttaaaagggtgctgtcaaataaacaagacatgtggagtctaacctgaggtatatccgtaaacaagggtgtcataaacaagagagcaccaccaattattatgcccattatgattccagatagaccagtttttgctccactttcatgattcacagctgacctagaaaaggaacctgaaagaatagtacaaaataatcagctttttgaagcttagctctagtgaattaagaattttaattatgtaatatacagataaataagcacagaaatgatctctcattaatatggttagtattttacctgtagcaggatatgaagagaaaaatgaaccgcatatgtttgctataccaagcccaaataactgtgacgaacaaaacataaaaggaaggtatgagtttgagcaaatgaaaatatttgggaggaacgaaacacagttcctactgtataagagtgcctgacagttctgtgtaagcaacacacaatatttgttttcagatcttcacaaactcctaagtcttataagcattatacaaagatgtgccggaataatggattgagacattttccattatggaatcaaacaataactcagccatcagaaaaaaaaaaccccatcaagttaaactttgtgtagtttgcagttaagacagacgtgagggactcagggtcggtaattttttatattttaaacctttttaatataatattttaatactgaaccatctaaaattttatttccaactctgaaccttttggccacgccaagctagctagcgttgcctattaactttgccacgccacatgtattggcgtgacagtactgccacgttggattagatatgacacgtcatcagtgttgtcatgccgctgtaattggcgttgcaagcgtgttctgccataccattttctctggcgtgacaagctttgccaccggcagagactaatcacatgcatgcttaagtacaggctgttgcttgcttgctgcagtaccggggatgtaattattgttgttacacgattgagctgctcttcgtccgaagaaaaaaatgagctgctcattgctgctacatgtaacttgcgttagcatggtgctgctacatttttccgtaatcgctaaattataaatcagaaaaaataagagtactaattaattatggtgggattgaatactggtataactactagctctgctatcctactgtgttttatacatttaggatgtgttcttatccatactttcctaacttttattctctcttttttcgcatgcacgcttcccaaactactaaacaataagccattttttaaaaaaaaaacatatataggagtttttaaaaatatcatattaattcatttttatttttatagctgatactacctccgtcccagaatatagcaacctaggagcagaatatagcaacctaggatgggatgagacccatcctaggacaacgaatctggacattctgggacggagggagtatttaattaattgtgcgctaataaaccatcatataaattttgatgctatttaaaataccaataatttgataggataaaatttggcttcgaacaaaaaaggcccttcgcacttgcatgtataacaagctagatcaattcgacttgctaattttaacgagctaaaagtttggctcagatcgtgaaataactaactaatctcatcaacaagttttaacttatttatatcagcttaaaaatattaatatttaccaatttatcacatgttaacacgatattacacactaactcacttaaatacaagtggtggaaatgtagcaacttttagctttaaaaaagagtaattgcctaggtggtcaccgggagaagacagtacgcataaaaagatatactacctccattttttatcaagctaatgagctaaaagcccatatcagcttgggagtaagtttttgcaatattgctgtacacataatagccaaaggaaagcgacaagcagaatatataaaagcagctaatatgactgtatgggccaattgaacaaaagcagtgccaaggaaatgtagcagagggcacaagcagctcacgaagtcacgcaacagcaataagcaaggaacaacatgtggtacaggtacagtgaagcagcagccaagccgttcacgaagcttaagcatgcgccactccatcggcaagcttgtcacgccagagaaaatggcatggcagaacacaattgcaacaccaattacagtggcgtggtaacactgatgacgtgttatgtataacacaatgtggcagtactgccacgccaatatacatgtggcgtggcaaagttaataggcaacgccagctagcttggtgtggccaaaaggttcacatttgaaaataaaattttagatggtttagtattaaaatattatattaaaaaggtataaaatataaaaaaattcctcagggtcacagacacactgacttttacataacatcttttggcgttctccctccttttcatattataagatgttttgacttttttttcctagtcaatctttaagttttaccaagtttctttactattataaaaattgaagatgtttacaccaaaattttggtacatcatctttgagttggttcaatgtcacctatgtccaattcgacgtgactctagaataactattatacacccccttcccagcccaacccctccccctccccctccccctcccagtccaacccacaccatcccaccgccctgacccgcgcgcatccccgactagcgtctttttttctctcctttattttttctatttctccttttcttttctcacgatcattctgtcctcttcctctccttccaatctcctctcttttctcttccttttctccttttttccttttttttctcttccaaatttctctcataaatattttccttttgaaattatcattaaggtgtgcatgcggcaagtttgttactttgcaaatgctttccatctacaggtaaaaaactttcactaattgaacaatcaaaatttcaatctttggtcgatgacgtttagcaaaatacacgtgtcaacttatggaatagccacccgatcgatttgtgagactatggaaagatgtacataaaggattcttcgtgtgatgacacatgaagcgagtgtaaccgggttcaatactacatatgatttttgactttgttttgccattgttttgtttgacttgtttcggtttgtcgtttaaattgacagagtttatcaattgtgaaaaatgtcttcacctgttaaaacacacaagcatttttgctagtatagaaaaacatagcaacattttcaacaccaaacaaacatgtcatcaaaatatattcaatattaaatttagtgaaactaatttagcgttataaatgttactaaaattttgtataaagttaatcaaactgaaagaagtttggctaataaaaaagtcaaagcgtcttataatataaaacatagggagtaacttgtttgttgttcttaaatttcaaatgctctaaaaagatttaaatataaactataagatgataaaaaaggatttggtgcacaattactaccatagttattagaaccggaccggaccggctgtccgactagaaaaaaccgaaaccagggcgccggccggtccggttcacctaaaagatcgctgtgcaatcaaatcggcaagaactcggttgaaccgggcggttttccaaagaaccggacaaaaaccggagctggttgaactgctggaacggcgtcacgtggaggaaacagaagcgcgcaggttgcagccttgcaggtgcgtcacgtggagttagaaaatagggaaaaatgatgtagtacttgtgaatcgaacccaaaacctccatgtcaccgcataaagcatcaaccaccaggctatgagccaagatgtgataatagtataatacaaatctatttgaaccgcaataaaccgccggttggaccggtccaaccaataaaccagtgaaccgagtgtattaccggttcgagcaccggtccggtcttaataactatgattactactccatttctcggtgcactaactattcatataattaatatgcaatttacatactaaccgttagtctactaataactatccttagtctgcaaattgtcactctctaagataatgtgcatgaaaaatcattgtgtaattttataacatgatcaatatgtaaagaatatttaataaatttggttatgcatgtagaagaggtctactaattatgacctcctctaagatattgtgcatggaacctattatttataccacataacatgaatatataaagagattgtttttgtgacaataaatggggagcagcttgccccaacatgaattcaatgcattagttaatgatttacaactaacctccttattggggtccaactcatagccattcttcgcagccaaagctttagcaataccaacagattcctaaaattgtatgatacaaatggtgaataacactaaagcaagtaaaaaggactaatacatactagatttattgtttaccaaaatggcgacgccagtgataagtactgcagttggcattagggacatcagatgctcaaatcctcgaggaatggagaatttgggaagaccttgcggtatttcacctacctaagcactcaagaaatagaggattacataaagtatagtttttcctgacagacaaattatggtcaaccgacagaacaaaacaacctaattctgcgttcttctaaaatggaaatcatttaaatgttgaatatatatgtttatcaaaaaaggtaactaaatacaaagaacaactaaaatatatcttatacgcacatttgaatataagaagcatcaatgcatcatataacaaaaaaaaagagtcaaatgataatgaaaaacattcttttgtgggtgttgataatgtagcaaacactaccatgaactgcagtaatatgcttaggagtttaccttcaagaataatagtatctacttttttataatgaagaataataatacctattgcgtagttattcccaagacatatcgttagtttcgttgattggtatgagttcgattaattaggaacatatccgtttggttagcaactaaagaaatggtttgttaaggatgtagagattgtattattagggggtaagctgctcacggattcacgtgaatagtacccatgctactgtagctcagaaaccctccttataaaaaggtcccatgtaacccactaccaattaagcaataaataatcataaagctaggtctagcttgataagagtctatggacaactgggacaagctcggtgctgacaagagagatcccgcctttatcccgatcttcggacaataccttatccatgaatgaatgtctataacaattcaatttacgaacaaagtaaagctctaaactagagaaccatagctaagagactattgtaccacaattaataagatttacttatacttgttcattcaataacaacgaatcaagtaattccattggaaaaagcaaccacaactttttagtgtaaataatattctaagggataagggagaaaagattggtaagtgtagtataataacccacttcatagacataaattcatagaagtagataatgttgtgatcagagtaaatttcttattataaagtacttccattgctcatattttgtaacatctaagagtaagaaatataaagaataatgtaggtgtttcttaccactgatatggaagatggatggaaaattttcacaaaaattgttccaaacacaactgctgtaaggggaccagaagctcttaggaaacgcagtcttttattcgattttccctgaaaaaagtttcgcttctcaaggtaaaaaaaaaatagaagtctccccttgattgtaatgtttccagaaaaaaaaaataacagaagaaccatactgataaagaaagaaattaaaaactcactagatttttcattatgagaagaataacaaaaaaacttgatcccattacaaatggtggccaggagaactgcaaaatggaactgctatattaagttagtgaaa

SEQ ID NO: 39527 - DNA, 1985 bp, Oryza sativa
caaacatggaagagcatgaatatgttactagctaatgccccatccaagtacctgtccgctatgtgaccaagaggaggaaaccattcaacatattttgataggttgtgtcttctcatgacaagtttagtatctcctctttcatcggcttggtcggacagatctttcaccacaaccagaggatggttgtttttgtgaatggtggctaaagatcatttctccggttcaaagcactggaagtgtgatctgaattcgctcattactttgggagtgtggctgatttggaagcaccgaaattattgtgtttaacagagtctctccatatgtgcagttgtttcttaggcaggttttggaggatgggctttgtggtgtttagcaggacctaggggcttggcccagttggaggtagcaggtggctagaatttttttggtgtttttggtcacgtcctcttggttttggaggattttggtgttattttcctttccttttccatcaccacagcagtgggtgtcttaaatatttaaatctaatgcagtgatacacaattctcttgcgtatttgagaaaaataacggtactagctaaatgtacataggttcgttaaatgttcacatacatttttgaaaattcattcacacactacatatatacagatgaaattttaaacgttgttaaagacaaatagaattacaccgtagcgtttagtatgggcatattactagtatatacacaacaattcaatcatcttagacctttttgtattaaattatgatcttgaaggacaaataagaaaagaaaaacaacatatggaaagtccagtgtgtaatcataatgaatccagggagcaatttgcagaaaatgaaattgatgaggtaatggtggtgccagtgccttcattttaggaagtatagaatctatagatgcatacgcacaaacttttaatgttcaatccaatcattttcttgagaatataaaatacaagaaatacatactaatgtttttcggtgcactacaacagcgatgaattgggccacagaattagcatgtgtgcataacataaggacacgacagttgttcagtgcatcatgaaatagtcatgaaatcctcaaaaatatctggttgtgatatatcagcttttcctatgaacgtttgctgcttttgtattggcacacatgactgttagacaacaaatttgtttatgtgagccccaaaaaaacagagccccacaagagcagaacacctttgtacccatgaaatgatcctagtatcactctaaaagtagcaggacctatatactgttgccctctacatgaacttcatgatcactttccatgaacatatgggataacaagttatagctatagctttagtaaaaaatcttgtaaaggatatatcatcagaacatggtgaaaagcataaggatatgcggctggtggtccaaaattttaagctatagtcatagctataatgctgagacaataaagcatttgtcttgaatattcataagtgtaaaattccaaaggaatatgtgtagatgtgtccatacttcttaaattatgtcctatctactgtaaaatgacttaaaaaagaacaccagctacccagagtagaatagaattaccttagcaatcccatcaagcattctaatacaccaaccatgaatgccaataatatggctaattctgtgtacagctcactagatgaatcaacaataccaccgaggacattagaaactagaagagagacaagagccactggacccactgccaactgtctcgatgagccaaaaattgcatagacaaatagcgggacaaagcctgtgtctgttcagccatggaaatagcatactaacgattaagctcaaagacatacaaatataaaaaactacaaagacaggagttgcaaaagatataaatacttacataacccatatattgggtgaagcccagccaactttgcatatgacattgcctacaatacaatgctaa

SEQ ID NO: 39528 - DNA, 12086 bp, Oryza sativa
tcctgcagcccgttcatgaatagaaatgaaattgttgaacaaatgcgtcccaaaataaggctaatttatgttctccatgttggcaaattcagcctatgtgaaggatatacaccagtttgcaacttattaagcagaaacaccagaaaagatgtccagaaaattcagtatttgtcagaaggcaaaccaacctaagtcctcaaactgcaatttgcaatggtgttaacagaaggggtagccgaatgatatgtaagcaagctacatgttcgatagagctttccatctatagctgaatgcattgctgaaaataactccatatatggaaattgggattatcttattccgggccagcatgaaaagatggttggatccactaaataatagcgccgtgtgcaatagaccatttttaggagacgaattgacactcatccattctatacttcaataatccagtcatactacagttgacataattagatcttagaactagcgaccaccaagcagtaaactgtaataacttcaaaaaacaattatgtaactgttcctggcgatatgatgacaaactaactagacaagcaagagaataacctggagattaacatgttcaatcagtagccaaaaaatcaggtaattacaaggacattctacatcatgtttcgaggcaatgagttttgaaattaacaaatataaccatatctttcccgtttgataaccaggattaggaacagttgaagccgtgcatagcaatacgaaatgttgcgaatcacgagggtaaagaatgtacttggggcacgagcatgacgccgacggtgatgccagcggcgaggtcggcctgcagatcctccttcaacctgtacgtccgcatccacgacaagcagggcagagccgcctccgcccaatcccgcggccccattccccgcgccttcaccatcaccacggaccaccacgacggcgaggacccagcgaccgcctcctgtggatgccgcagtggtataacccgcaccgacctgcccccaccacccgccacgacgccgagctcgccggagctcgccgacgcgtaggacttctccattaaatcggaggccgcctccttgcaaccaaacgattcgagttcagacgaacagtaaaccccaaataaaacaaaacgtttagtctcggtctcattgctcaccgggaccggcggccaccgcagcggcggaggtgcgagcaagacgactgtgggtagtcgaggaggcgggcggccgtggacgggatgcggcgacgcgcggcagcgggatgagtgcgtcggcgagccgcgcggcggaagtacgcaggaggggaatggacggaatggtctctctttctttctgcgctagcctactagtcgaatgctgaggggtaaactgatgatccgacggtcctggatgagcaatgattcccagcctgaggctgacgcatcacgttgatgtaactggacgggaattgcggatgagtgcacgctgaccggcaagatggcgatgtacatggatggaatgctggcaccggtccattggtttgcttgtggacagaagagaagtaaaggtctcatcttatgtgatgatgcagatcgtgtaaataaattattccctcgttttccaatagaattatatgcaccggtccgttgaattttctgtaatattataccctctccattcacttttgatcaacatatactactgtttacacctaaatttgatacctatgaacgaaatacggaaaaatactaaagttttgaaagcgtcgggtttccttcacgggctggtccgaccacaggtgtatgtccggtctgagccggtctgaccgcaggcatgtggccggtcagaccggtagagtccgcgtccgaggcgaatttcattggttctcgggttttcttgctcggtaagggatgtttcgggttttcattggtttctatactgagttgaacgtggaggaggacttgtaggaggcaagaccaacccctttataagggtcaaggctggttcaaccccaatccccaacaatctgtaaaatcaaatcgttcttttacttttacttttcaactatgtccatctttgtggtttgcgccataaaccgtccgtcgtcgctgcgagaatacgattacccctttgtaggtttgttccgtaaacctttcgtttgcccacgagacgggtagttatcctcgtatcgatctaaatcggcctattttgatctctaaatcgactctgctagccggtttagctttttctacggaacccatctcgatttggcctttggcgagatcgggatgattgacgactccatatcaccgcaaggcgtttaggtgttccaaatgtgtttatcttcttgccaaaaaaaaattgccaacaactacataatgaagcatctgtttcatttgctcttcctgaaacaacaacataccttcaccgatgcgcactaaatggaatattggatgctttttttcctcggtcttgattcacttctcttatatataagctgatcaaaagtgaatggagagagtataagtgtgttggtcgtctcattaaaaaatatgtaattactctttactctgttttattatgaagtataatttaagcatgatttatatttttcatatttaaaattttttggacaagtcaaacatactattaaaaaaatagaggggccatcttcgaaaaaacatagaaagtaatggggaatgcgtagcagaccacctgattcacatctaaaaactattccataatgaaagaaaaggttagtaggatcgttggaccatctcttcaaaaaaaaaaaaaggatcgttggaccagccatctatttttttcaatagttacttgtgcgagaaaattagaaatctctctcctataataagtggagtacgggtcgcaacctatccttctcattgtgccgatagtcgattaattattttcctttcaaccattaatgcctatcatataattagcttttcgctgataaagacaatattatcctttcgcataatccttttgctatgagtagttttcagtgacaactaccctcatgttggcacgtaataaggaaactatggtgcacagtagaggaaaatattattgtcttattccgttatcaccggttcccacttctgggtcgtcatttatatatactagttgataccccgcgcttttaccgtgggatatgtagatgaatgcatattatacattatagaatgatatatgtacatgtttaaataatgtgaaaatgatgtggagataatgatttgacattgattgtatgttgaattctaaaaatacaataaaattgtaaataatatgttatatttgtttgatattaaaaatgctctaggtaataattattagtgggtaatgatgtggtacacttgcaagtgatttaaatactctatgtaataattgctagtgggtgatgatgtatcacacttacattgagatttagaagttagtggacatcaattttatagtaagatatgattccctccattttatattataatgcactttgactttccttttaagtcaagcttctataaggcttgaccaagattatagaaaaatagagtaactcttataacaccgaatttgttccgttaaacctaatagtgaatatatttcaatagtatgtttgtttggcgttaaaaatgttgctacgattttatataaacttagtcaaacataaagatgttcgacttagaaaaatgtcatagtgtctcataatataaaatggagggagtattgtgtaaactgtaaccatcgtttgtctatgcaaaagaaaactgatggtgttatttgtacattataggatagaaaaggtttgtataatgtatgtgaagtgttacgcttaccaaggtaaatatacggtacaaatcccaacttgggtgaaaactcgtgtatgaaagtgaatctagccctaagttttgcatgaacgacattaatatccgcttgctcgttaaccatctcttcttcacactaaccatcatccttggtctcacttgcagatttccattcacccatctcattcacaagcatggttcttcgactagggcactcagcagcaatgtggccacgaccttagcatttgtgacacacaatatcgcggctacgggacgaggattttgctataggtgtaacaagccgacgagactcattgcgtgtagctggagaagatgccgaagatggttgtagcttggctatagcagctagtggagaggctcgtgtggaggctctctgagaacgagcgccaacaaaagtgatagtttgttgcgtgcgatgccataggactgcattggagcagccactagaggaccaattatgccgttcttattgaatgtacctttccatatgttgggcttgatcaagaagatcttgcaaaagtgttgaataaacatctccaaaaagtcagaaatttcatcattgagaccatgcaaaaatcttgtcattttcgactcatcttctttaatgtgagcacggatcaagagcaactccatttccttgtaatactcatccactgtacgagtcccttgacacaacaattgtagcctattgttgacgatccttaagtaccaattcgaccatcgattcctacataatagcaaatagaagaatataaaatggaataccaaacttagaggtagtgtttgctactaactatttccacaagtcttagtgaatatttgtatgcaggtgaaatatggatgaaaaccacccaccatgtgacaaaatacacctccgtacaatcggacgtgtttacacggaatggagaccccacatgtcaatcaaaaccacctaaaattgagcacaaccatggtacagcatattgagggcccaccagacagcctctcccagccgaaggagtggccgggaggtgggctagaagttcggccgaaccacaaggtcgcctgagccgacttcggcccctctcaccatctgcttccacgtgtaggctcctgagagatgtgtaacacatttggcatgttgagtctgaacaatatctgctttgctcattattcggcattgtgtattttatatcgattggtgtcaatttgtgaccatgggcacattgaggtgtgtgtggctatttatgcatgtatggatccgactcatccaaaattatgtggcggtcacaaattgcactggacagtataaatttcgagcgcccacaacccgcccttacggggccagggatagtgcatccatggattgaacggggcagagcccataagttatgcggggtgagggatcaatttccacccgcaaatgaccaatggggccctggttgtagaaagcccataaaaagtctagtcattgttggtatttcttaacctcacagatagaatctgcaagctcacggaaaataccaatgtagcacttcacccgggagtattctaaggtatcgatttccacaggaaacgtgtgtgtcagctcttcactagttcatccaaggacacgaagctacagataggcaaaaggatagagaggttttaccggtaagaaactatgtctacagaaagctaaactttaatcctaatgtggtacttcgggcactggccaactcgctgctcccagatatcgctctactgtgcacccggacagggatgacttcagtgatattgagtgctgtcaccacctctacgcctacctcacacctactgtgggatgcggagcaaacaccagaaattaactacctagacaccgtgtctaagcaattaataacttgatgtgaccatggctacaatggatacaaccgttcctcacatcatggatgaacaagaagatatcatgatcaagtcctacaagtgctggaatccgattcggccacctgctacactgctggtttcgaacggccgcctaatctgtatacgacctccgttttcagcccgtgagtacttgatggaaaactcttggagtcctctttccaatgaatccagcctcatctccgaattccatctcagtcggccgcaattgaagaaacaaggtgttgtgtcacctatattgggccaatgggcttgtaacttcgtttgggaccccggcccaagtggagcccatgtggggtgcaccccaacctggtggagcacgaccctagggcacccttggtcgccctcccacccctataaatagctaggtaccccttcagggtttctcgggttttgttagattaaagtttagccattgcttcatgcttgcagcgcgtgtgtcggctagaccatccgtatgcttgttcttcagaaccccaacttatcatttgtattcaactcttatttgcaatatcagattgcttttatattgttcttgcttgtttcttcgatttgcttgcaggaatagggttgatttgcaccggcaagatcaacaacctacaaagaggtgtatcgatcgctaaggcgcaatgcaacgtcttgtacagttgtagtatgatcgtcaaagttcgtcctaaatcgtagttatcatcaactcaccgaaagatcgggccaacaacagccttgagtgtcgagtggaactcagggttcatcataactactctagtgtttataactcactaaagtagtcactatattttactgaattatagtgaacgatgatcccgtactctgattaggaactaaccaagaaataattctcaccgagcaaaactaaattactcaaatgatatttcaattataatccgagtaataaacagagcagaatgaaataggaagacgattgccgataactccgaaattccttcaacttcttctaccttactctctccctattctaatatacaataaagtacactagagcctcttttaattcagctcatgcttcaagtgtgtgtgagaatgagagaggagaggggtatttatagcttgcttgggaatgtggagatcctccatggaatccaaaggacatctcttttctcctcttggcacgtgtccatgacagtttctgcaggtacaaccatcattgggaagtcgttatccaccgaacgcaacttgggcatgggccagcggcctccgtaatggttcggcagaactcagggttcggccgaacctaggacggctccattggctccgattttcggcctagacactcattttgggcccctcattctattggtgtggatggaaggcccatttgaaggtgtttaattggatttttgggtccaaaactcgatatgttcggatacgcgtttgattctcctcctccttcatgtatattttttctcaacataggtagtttgtcacctgcatacgaatatacaccaacactcgtggaaattgttagaaataaaccctaccactatgttggatgttttgtatttatggttttatgcaggtattgacggtgagaatttggtacttaatagccgtcaacagtcattattcacaagaaatggtccaatactagtaggcccaacgaaggctgaaatacaagcaagccagcttgacttgtatgaaggtacctttccaaattccaatttccttagccgccactaccagcctatctcactacctgcagaagtggaggtaagccactcacacttacgcgaaactatcacgcacttctttatgtcgtgggccagcatcgttatgcgctaagcccctcctccgctgcctggtctatgcctacttgacggcctcagcgttgcatgcataagtaccacaacgacccaactgaacgcttctgttgttgcactcactcaccggttccctgatcgcatcatgccacgcgctgagttctcttccaatctccctctttccaaaggccaacgccgcttgttgtccttaaaagatgcgatgacacataggtgcagggccccgagggtggtgcagggacccaacaggtatggggatgggagacattttccacccgatatcagttcggaagtgggggcaagtgaggaagtcaaggaccgagggcagagacgttccagcccaacccatccccaaccactattgaaggtcgttaagtacaaaatttaatagtcaactcctgcatagaagaagtaaaatattatatcaacttagtggtggtagtttattactaaccattttcactagctttggtaaagataggcatgcaggtcatttaaggagaaaatatacccgccatgcgaaaaaatgaacctccgaccaatcaagtgcgaatacaaggattggagggcccacctgatactaaaaaccggcctaaagtgaggccaaaccatcctcaaccgccataggggcccacctgttagagacaaagggaagttggttgccagagacggtggaggtggtttggccgaactagcctcggcgctactaaccgctagcttccacgtgtcaactccccattggtcctcaatgacgattaagaggggggtgttactgacatttccaactacccacaaccatcattagcaccctatataagaagtaggctttcatatttgcaacacacaccacttgagctcaagtagagtacaactcacatgtagtttcatctttagtatgtttttatagtgagaaagtgagaggaagctccggaaggagtgccccaaaatatcggagttctctcccagaattttcagaggagtgccgagttaatcgacattcttccaacggagttttggagaagcgcttgggggttgtcggccttcttctcgattgtacctcggcggaagcttccttttataaagtaactgttcgagatacttttatactatttaattagtttccttaagtgagatatattctcatcagtgtgggttcgtcgcttagtttataattaagtgctctagtactaggactctggataaagaagaaattttttgcgcaaggctagagtagtaatcaataacttacgcgtggtgtctaacttagatgttaccttcgtttgttgtgtggtctaagaaaagtggggtaggcggcaggtggtgacagccctatttgtcatttgcatccctccacattcaggtacatcatagaagacaaggctggactcagctaattggcataccaggggagggccggtggccaaagcacttgatagagtttccaatcctatcattagttgttgtcctttgttgaatcatgttcttagatagtactacaacagcatcaatgtgtttgcagatttatgtgtgtgcgtagcaaataccaattcccacacctaccccgttgccacccctagccatagctagtggtgtacggggaagtggtgctggcatgcagttaattagaagtccgtcaacattgtctagaaaaagaaaatgagaaggattccctaaagaaaaaaaagagaatgagaagtacttttaggtaacaagcaagctacatcgatgatttaagagatatatgacactgttaggtgcttgttacatgtaataacattggagatgtaggatatatatttttaaagcctatagaaattaaaataaaaatcatattatcctaaaaattgtcatggtattttatatccgtccccaaccaccagccataagggattggtatcttctatgaagctacaacccactgaacacttaaaagttcaacatgaaagtataaatatatattactccccccgtttcaaaatgtttgacaccgttgactttttagcacatgtttgaccgttcatcttattcacatttttttgtgaaatatgtaaaactatatgtgtacatgaaagtatatttaaccatgaatcaaatgatacgaaaagaataaataattacttaaattttttaaataggatgaatggtcaaacacgtacttaaaaagtcaacggtatcaaatattttaaaacggaggaagtagttaacatataagtaagccacgtcaacccactaagcactgtcaacacgcatagtacatactaaaacttaaaacttaaatgtaactgcatacatcaactacaaattattacattataaaaatcaatatgtaagcatgctaaggcggtatttggtggcacgctaaaccaagcgatggattaacgtataatcaattaagcgtataaaacttaaaaattagactaatataattctttataagtaacttttcaatagaaaacttatgaaaaatgcattgtttagcagttttaaaagcatacgtgcgaaaaacgagaaattagaagttgaaagtggggaaaagaacccaacctaaatcatcattcatcatataattttcacacatttctatcaaattcatcatttatcatattaatttctacattattttaataaatattcagtcatatatatttgctacgagagcctgtgaaaggtcatctgattcaggtaaactttgcacttgtctagaagcggtcgttttatcagctgagcaatatgccaatagccctttatcctatgggacccaagcgagcacgaccgggcctaccaggaaccactcgagagtcgagaccactagatagggatgcaagcggggcggacaagcaggtttttttttttccgcttatttcacttctagttcattttttcttctaaattttatactaccatacgaaaaatagactaacaagcgggtttttatgcgaatagcgggactatccacttgcatccctaccactagataaggtacaagtgctctcaccggctagaaaaccgccacgttttcacctagctgattcgcctgcttcgtctccctgcgcatttgtgcctacttgtcccactcgcatccacgacctcaagaaaccaaaccaaatcaaagcacaacaccacacgccatgctctttgtgtggttcaggtttgcgcatgtccgatcgaaaaacaagtaaagaagccacgtactactattactggaaaaataagaattgaacaattaataggagttgctagctaagctttgccattgctggaaacacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtaagtcttaatgttttttcttacaatcttacacgaattttcatcaatgaattatctacactagtaacttacccgtgctaactatacgataacattaaaccaaagactatcatatgttaacacaatcaaaaatataattagataaatttaaaactcacgtaaagattgaacaatagagagttgttatattttaaagacaaccatgtgcgcaaaatagcatggtaacctttatatcttcactcaaaaccatctattttttgatgcactgagaaattcttataagtaaataaatactatttgctcatgatatgcaaaataactacaagcaactcttattgaaaatttttccatgataattcactgacatattggtcatggatccacatgtcaatgagagaatggaggtcaactttcggagtcaaataaagattttatcccacaatttttggataattaaattatcaaaattacattatcattcataaataaaatgagttgggtaaaaggaaacgagaataccgaacacccatccatccaggtgtgacttcaagagttcaagaccaagaccaacagaaaaatgcattctcaagctcctaccaagg

SEQ ID NO: 39529 - DNA, 757 bp, Oryza sativa
ggagcactggcggcttggttgacgggcggagcaccggcgactcgcggggcggcggatccggcggaggcgactcgcggggcggcggatccggcggcgacgactcacggggcggtggatccggcggaggcgactcgcggggcggcagatccaacggcggcgactcgcgggggggcgtcgcccagcggcggcgactcgcggggcggcgcggtgcggcgagtccggcgacggtgacaaggagaaggggcgactcgtggggcggcgtcgcccgacgaatccaacggcggcgactagctttgcgaggcggcaggtctgattcgcaccggtggatggcagctcggcgacgaggtgcagtggctgggctctacggcagtgacccacctcctcgtcgaccttgggcctccctgtcgccggcgatggaggatgggcacgccggtgattttgattttttttttcaaaatctggattccaattttcttcttttttaatcaaaaaatattttcactggcgggtgttttatcttccgacagcgaaaaccgaaatttgtgctagcggttgtcttagccagccgccagtgaagacaattttcgcggcggttgtgttaagccggccgccagcaaaaatcgatcttctctaacggtttgtcgctgctagcgtagatgctacatcttaactagcctttactttgtggcggctccgatatccgccagcaaaaacctaaaatggccgccacgaaagattgttttcgtggggtgcagga

SEQ ID NO: 39530 - DNA, 11649 bp, Oryza sativa
  unsure (1)..(11649): unsure at all n locations
gactgatcaaatgatcattacctgacatgaaagaaattatctgcacttaagaggaggcacaattcacactgactgattaatgttgttaatcagaggagttgtgttccaaattagaatgattctggtactaacagacgttacaaaattttgcaactctctctgatatcatgttaggactctgtctcaggtcaaaaacaattatgctactcacagattttgtacaaaatttagccctgacttagagttaatactccaattgtgccaaattaaactctaaatcaaattatcattacctaaaaagaaagaaattatttgcataaagaggagacataattcaaacctaactgatcaaagtttccaaccagaggagagtgcttgaatttaaaacaatgccagtactaactcagtgatcatgctctaaaccagaggtctctgtttcaaatcagaacaattctgttactcacagattttgtacaaaaatttagccctaaccaggaagtcccatagcaaacaggagaggttcgctgctttccttggaagtgccatagcaaacctgtacatttatatattctgaattcctcaaaggaattttgaaagcaagctgccagcatgctcaatattaaaaaattcaggttactttaaatgcttatctttatacaattcaaacttttataaaacatnaaaactcccagtttccattgtacaattcaaaaactattaaccatttagtaataaattcacttaaccactcatataagaagcaaagtcaagggacaataacaatgtatatttcagtgttctaaatttcagacggcccaatgcatattaaaaacaactatgccatttttctatttccatttcagcacagaaatatatacttaatataggagtacatagtagaaatacatagatatacatagttagatatggcaggtaccaatcaacaatcatccgataaacatgtagaaatgcactcctaactgcattgtggatgctgctggggaagtcaaccaagcatcaactatggacctttgtaagttcttccgaacaaaagatgcttcgtctgtacgaccataaccgtcaaacacctgtaaaatacccctaaaaatttgaaaccattaaccatctgctgtgaaaactcgtactgaacaaaaaaaaatgatgaacttaacatctcacatatgaatgttacttcagaaatttactgctggtgatgttgggtcccggtttgagcaaagtaatttattcccaaatgttcagtgttataattttattgcctagtttcaagtgctctaaactcacagattgtttacatgcatcaacagaatttgagttggaaattgtcagtgttgaacaaaaaaaaaactaaccttttgattgactggaaatgaaactcttgtgagtctcaatttccctcaatttattgcttctgattaactggaaactgaactctagtgagtgttaaattcccttaattgattgtaccactcaggaagactatctgcctacgtgcagtttgattcccaaatatgttcagaaccatacaaagacctaacccatcaatcctgccaagtctttccaatttcccacaagccctgtattgcatctgcacgccatctcatctaatctcacatcctctcacaaaataacagcaaaatagtccgggcaacagctgctgctgcggctgcttttgttgtgggcactaaaaacaaattggttattttcaagtctaagccattgagggagttgttttggttggtttgctcggtatttcacatgcactattttcgcaaatttgcatttgaactgtaatggttgaaggaacgggatcgagcgatgcttaccttgtccccagcgtggtcgagaggattccggtggtggcttaacagagagcacatggcgcaggatccttggcggcgcgagggagtcggcggtggcgtcgcgacgcagtcggcaagaggggatgccggcggcgtctatttggaggcgtgtgagggggtgccaacagcgtcaaactggaggcgggaattgatggcgacgcgatgccgggcgtcggcgtcctcgcacgcgaaggaggggcgtcggaatctatggcgcccggcggctgctgtgatgcggttggtgttgggatacgcgtaggctacgatagcataaatcaaaattttctatcacgtaaaccaggaaccatgcaagtattagatcatagatcgttaccactcgacgcgctgcgcagcggaaggcgctaagaaatcgaaggaattctcgcgaagtagcgcgtgtcgttatagaggaagtagtcgatcgcaccggctcgaccttctcctcgccgtattcccacgccgatcagcatcacaaatcagaggcgcctctaccggtattcacacgtacagggacggaatgccacgcgtagatgtgctagcacccgcgcgcggctagggttttgctcggggaggggagtgacggctagggtttcttacgtgatgcaatacctccgccggttacacccctcacgaatatataggatccatcactcgggcctccaaggcccataggactcctattcggatccctatctgaattaagctcatattagatccccatccaatccctttattccggcccattaagcgtgcgaccctgtaggttcatgtacactcggctgtaacccgaaaactccttttcggtccacgcgtcaacagcggctcctagcagaacgtattgactcaccgggcatacataaagatcatatcggctgaacctctagtgtatacttgtatgaacccctttgcctcacgatatcgattaagctcaaagttagatatgtgctatcctctaatagctcaatcatttactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagcagtccctaagtaagctactacacatgttgagaaccatgataattttaagtctaaggattcaacaccaacactaaatgagatcactgatgacacaacatatatggctcttgcagtgtctcatgttgggtctatccaacaacatgttcaccaacatgtgtccacattattaatttggtatctctataccatgatccatgagacatgatcatcaattaatacatgtgttgatcatctaaacatatttgttccacatatgatatttgatcagggatcctttagaaatagcaacacacaacataaagagtctcatgaaagaatcacatattcattaactaataatgagttatctatttcaaggaacaaagtcggataaatatgtaaacatagtatatgatacaatcatctctatgattgcctttagggcatatcactaatagttggagcggcgacgactgttagggttaggcggcggctggcgttgcgtgagagatgtcggatgtcggtggcgccgcgcgcgaatgcggggtgtccgaattgacagtgggcagatatccggcttcagcggcggagaccacgacatagattctgtgtgagattggtggctcgacatcggcagcgaccgcaggcctggactggtctgccgcaaagaccgtctttgagccgctttctcgcccccaccgccggcaccgcctgtgtcagccgccacaatgccaggccagcccagactgtcgaagaaccatcgccgccgttgttgttgtcttcaccagctctcgcccttcattgaatcaaacacatttagccacaccacacacatgacgttcgtttcggcgggtggcggagccggtcagcggcggccgcggaggagatcgtcgctggctcagtggtctttggcttcgacgattggagtaaggggtgagacagcatcacgggtgccgcggcggggagcggggcgacgcttgcggtggcaggggatggaggaggtcacggtggtgaggggagggggatcgatctgggcgggaggagaggatttggggaaggagagcacgtgagggagtggcgagcggtgtgatttttgcgcaaggggagtggggtgatatgcgtgcgggctaaggaggggataggggaaacgtgggatgatctgaggcattggattgaatgattctgggccgttagatttgatgaatgagtaatgagtaatgtaggtgtaagagtgagttggtgaattattagagggtatataggtataggtatatatatagtagggacgatctgaggtattggattgaatgatcctgggtcgttagatttgatgaatgaggatttgatgaatgagtaatgtaggtgtaagagtgagttgatgaattatatggtagatgatatactttactagttttttttatttttttagagaagggtaaaaaataaaaagaaaacatatactctactagtgactttaaagtttcatattccaacgaatctttcaacacttgattaaaattatggaattagtggtgttctggcagcagaaggtgtttgcttttcttacgatttgtttatacacaaatcctactcagtaaaggggaacccaatgctttgctaatgaaagcgtttatcaaagcggtcctgagcacaatcttagtctactttctaatcaccatagatcctccaaaatgggtcttaattgccaaaggtctatgtgctcattggagtgtactggcttaggcatcgacaatctagagcttatgggtgttgcgcttaggtcctgatggatctcggcccaacgcacatctcaatttaagccctagcaaggtctccatatgccgtactctaggcaggaacgcgagtttgctgttgtttccatgacgtgcgtgctaggcgatggcaaatcaattctcttctgggaagatggttggttgcaaggtgcgagcatccatttctaggcgcctgcgctctatgagtgtgttctggagcgcatccactggagcctctcgatcgcagacgtattaagaaacaacagatgtatcaacgatcttcgcggttctctaggagtatggccaatcttctagtaccttttgatctggttgatggtacgtgccacaacactatctgtggaccaagtcggactccttcctctataagtgagaaagctcaggttcctactccgcttgctaaccctaccacgcactattcatgggcaggatcccattccatcactcgctgatctggaatccatggcctctcctcgctatagctactttttgtgattggtcgctcactggcattgctagactgttgatcgtctggagaaaagaggcctcccacaccccgcttgcagcatctatcatgaccaatgggaagaaacgactgattgcttgtggattgagggccctaattcattacagctttgatggatcatcctttcaggcctcgggttacactagtgcttcctcgccggagtctcctcattccatgattggttgtgtgctctagccaccacaagtccaaaaggaccagtgttgtggctttgacatgattgcaccccttggggcttggtccattcgaaaggagaggaacaatctggtgcttaatcaatttaatcgaacatggcttgaagtggtcgcggcaatggcgcgggaagccaccctctggaagctttcccggccttcgtcgcaggcgttgctaccttagttctttaggtcgctaggttgtttcctctgttatcatgagaataaacttaagcttcccctgtttttccttttcccctttttatttccctacctctgttctgtcttttggtttgttatttcttttgttttgctctttgtaagttttactcctcttgatgcaaaggtgcacaattcttttgcgtattcctcaaaaaatgctttgctaatgaagaggtcaaaaaatgcacatttttagtaaggagggaacaatgaagaggaaaacgaacaactttccttgagaaatcaaaatcaacatgtacagaatcactacaacaaaaccccccttcagtgctggctaggaaccctaattggtgccagattccgagatgaccccaaataaggggcataaatgaggcaggctcatcggtgcatgatttaaaacaaaaacccttattgatgaggtgcatgatttaaaacaaaaagtctgatcggctcgattcaagccaattgagcccatgcattgagtccaaaaatttcccaattggttcttcatctatcccaaattgtatttcaatatcaccattgaaaaagtgaatcacaaattttggctcaaatgcattacgtactactcgaattggaaaggtaaaagtacaaattgccggatctgacctcgagctcatggcgaccaatggcccatggcgaggtggaggtcgagagagcgagggaggcacaatgatcggtagggacgttgagaagggaagtagacctcgagctcgtgacggtggatctagctgccctcgagatcatggtggccggatctagccgtccccgagcttgtggcggcgtatccactggcctggaggaggaggcgctacatgtggcggcggtggagatgacaaggggcgtgcggcatctgtggcagataggaggggcatcagctgcagcagagaggaggtggtggtggcggcgagagatcaatggagtgggatcaactctgagagaaaagtgcgagagagaatgaggtggactctgagagagaagagaggtggaaagattaacttcaaggaataaataaaactagggctggctcggtttgtctgctagactctcttagaggtgttgtttttttaaaatgcctcatatgtgggcatccgctcatattggcttgactaccgatttttaattttagattagaccacatgtggagttggaatgaccagaaaatacttatgtgtgctggttttagggcatcccggccctatctggaccttttttaatacctaaaagatagaaacttatttaagaatattcgaataaaaaactgctataatagtcaatggaacagtcacttctctccttggctttaattttcctgtacctagttttaatatgaggtttgaattggtcctgtcatccctatcctagatatatacctataccgacatacagtatatttcctatactcgctttagtaaaataaaagtgttgttttggacttttctaattcaatgagttacaagttcaactacttataatttgtacaaataaaaaaaaggtaacacacgtatgagaaataatttggtacgacaattttatccacataattctagggctgtctgtgatatcatgctcagcggcggagccagaatgtgctcaagagtagggttgaactagtataatagaatgtgccctagctgccctactcctatatccgccccattcatgctgaaaaattgtgtgaaatcagttgaatttttagccatgcgataaaacatgtgtcaaaatcaccacccacccacccacccccgagcgcgccccgccgagcgcgagcgcccttctcacgattgcttctccattaaaacaatactcattgttgggtcaggactgagaaaacatattttatcttttgttatttattgggcttgttttcatattgaacaaccttaacattgttgctttgggctattcaaaagaagctcaaaatctgtctgacatcaacacacaaattctttccattaagtcataacaaacccaacatgagaaggtccatttgtagccaggaaacaacaccagagcgagattgaatccattttgttatcacacaacttttgcgtgacaaagctcagctagcaagattcattagcaaaatccttacaaacaaagaaatcttgacatatcctgtatgcataaatagattaattccaaatgatattaccatctctaatcaattttagcaacaaacttaaatgtatgcatcgcaattaatttgtgacataaatatctgacattatagtgaaggatctgtgttccctctttttcctagacagcaattacgtactgattcatcatactaacatttgtctcatgttaacaaaactaattgtgtccgattttctccatgataagcatggactgttaaatctcactgacatggaaaacccattaaggctcagttttcccaactcatctctctcgttttccacgcgcacgattttcaaactaccaaatggtgtatttttttcaaaaaaattatatacaaaagttgtttaaaaaaatcatattgatctatttttgaaaaaaaaaatctaatacttaattaatcacgcgctaatggattgctccgttttccgtgccggaggggagtgttcccaaccaggaggagcgaacactccctaagactgcagagactaatagagcaaatgggaataaatgcatgaaacatggaccagaagttttgtatgataaggcgggaggaaggacagagattacaggtattcgttgagataaagtgcaaagtcaccaccacctcccattgccaaataatcagtggagcaaaatgtgaaatctatgcaaatcctatgaaagaaattgtataaatgacctgttggatgatataaagcagttgttggtctcctgaaagattaataaatataaagtacgatcagtgtaaagatcgaaatagatatccaaaaaaattgctagaagataatcaagcctagtagtcactaaataaattactctcgaaattttttatgcttcagtgcaaacaatcaagctcagtgcactagcactactaagtagatgcttgatgccttgattgtctaaatttaagctcagtgtactgattttgtaattactaagatatagatagcacacaaggttgacaaaattaggttacgatagttcatattaaaattacattgataaagaaaagtagcataaaccctttttacatagcagtagatctatggaaaacaatcatggagtactaaaatatgcaaatgtcatgataattttttagcatactcagacaaactactgtatatatgaagtcaacatctacagtgcatgcatggcaaatgcaacccatatgatacatgtactacctatactaactcagccctaaacaaaaaaaaaatatcaccaaaaatatatgggttaattgatcaacaattccaaactggtgattttctagccaggggataaatgaggtcgagtcaccaaattcttacattaccaacttgtcatttattaatagcatcttttaggataccttccatttgtcaaggtatagaaaagaaattatccactaatctaataaggcatggagaatgactcgatgcatgccgctttcatatttccaccctgaaaaatgaagcaactaaactataatttgggtatcaaaactagtaagtacaatgactcacatagggcctaactacctctatgacatacgtctgaattcattcagcaaactatgttgcagacaaacctacaaattcatcaagtcaacgatcaggttaacaatcatgtgaatattacacacactttgaacaaaaaatcttctaggtgatagcttatgccctatagagtgggctaatgtagggaatattgcaatttgaattggctaacagataatggttgtcccagtcttacctcttggtggttggtcggcaaagttgataaaacatgtagttagataaccgctagttaaggaacattgtcatatgttatatgcaactactaaatgctaacaaaacaatactattcggatgtacaaaattaattgctcagctagtcaaggattgacaaaactgatttccagatatttggtctagaaaacaaaactaacttttgcagaaatatcaaatggctgacaaaacacaaaactagaaatgttagtagttgagaaaactagacatgagaacttgttttgtacttattattgatgaggtattcagatgcacatagtcatgcataaaattctaatgagtaaagtccatcaccggtccctaaacttgtaccgctgtgtcatcccggtccctaaactcacaaatcaaccgttcaggtactcaaacttgttcgactgtatcatcccagtccctaaacatgcggatcactcgtttaggtcctccaacttgttcagttgtgtcacctcggtccctaaacaggacggtctaaaaactttatatcaaaaaataattcataactttttcatgttaactctaatgaagacaaactttatatcaaaattgtagccctcaacgcgacctacaactttgtagttgaaaagtttttaaattaaaactgtttagggtcccaaaatattgttgcatatttatagattttgtaattttaattttaaaatacattttgggacaaaaatgacttaaaataaaaaaaaattcaactacaaagttgtagatcgcgtcgcgggctacaagtttgatatatagagtttatcttcattagagttcacatgaaaaagttatgaattatttttaaatataaagtatttacaccatcctatttgacccatatgatattcaaatccaagtttagggaccggggtgacacagctgaacaagttggaggatctaaacgagtgatctgcaagtttagggatcgggatgacacagtcgaacaagtttgaggacctgaacggttgatttgcgagtttagggactgggatgacacaacgatataagtttagggaccggtgatagactttactcaattctaattaaagactacctttggagctcttgacactagtctagaactagcacaactactcagtacacctaaaaatgtactagaaaaattacaaatgggacacaaaaaacaatttattttggcaaaatttagaaggttaacaaaaacacagaaaagacaaaaccaaaaccaaaaacataaacagaaacagaaacacagagcaaacaagaatacaatattttgctaatgattggtctttgtgtaggtactgaaaatgacattgagatagtatgcccgatttcttttcagaatccacaacaaacaaaactgatactaatcttttaaaatttacccaatattaatagcccccaagttcagatttttgaacacaaatatcagtgaatttgcaggacaaaacctgctaattttcagtaaataatagacaaatcaatacctgaacataggaaattagcccatggacgatatgttgcttaatttcttcagaatccacatccaccttcatggataagaactgacatcctccatgcatagtaaaactctccttgaaaagaattagagtaaacaaatcaagctaatcaaattcttttaccacaaacttgaaccatatagaagttctaatacttttgaacatgtaaagaaatcaaaacttctgcacacagtgacagaaatgctgaccaaaatcaaagaagtatccaaacatatgaacacattgcatgtcccacacacaatattctgactaacaaccacacacacaaatgaactctgtgtgaaggacccgagaagaacatgcaacaccatcaccaaagaagaatagcaagttactaactactatctcctgcagagaagactgtgacaaacaacaacaaatcagtttgtagcatggcctatagtactattctgt

SEQ ID NO: 39531 - DNA, 22585 bp, Oryza sativa
tcttttatattatataaaatatgcattcatccacatatcctcagcaaaacgcggaatatcaaaactagtatagtatgcatttcaaccttgttcgacgatcgctcaggtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgataacgctattgatctgatggtaaattttgatcaataataattctcgttcagaaaacagacagttttgagtcccttttcgcacactatagttactgcgtgtgcattgcttggaaattccatgaataatgtttgaagaattgcgttgatgcttcaactttgggccactttggttctcaaccctaccaattctttagtactgagagttgacttgattacatttggttcgttacttatagagagccagtggtggatgtaggtttaaaatatagatgggacgacggagctagccctaattagatgatggcacaatacatacaatccatagtcaccggctgatggcggcagagctaactctaattaggtgatggtacaatgcacacaaaccatagtcgccggctcatgacactggcgcagcagtgcacgacacggatatcgagaaagttaacaacgaaaattggtagtcgaacaaatatatatgatttatatgtagagagagaaaaagagaaatgttgttagataataataaggggaaccactttcaattggggttataaaacaagatgaaaaattatttaggggtttaagtgcttcgccaaaatagttcaagtgagtaaaatatatttttttatatatttaccaatttaactatttactgtgaattgtatagaaatagaaaaaaattatatatagtcaaaatcaggaacagtcaaaatggtactacttacacagaaataatacttataagtcacgaattttcataaatatttttgtctctacttaaaatatttgatttatctgattattcaatagtagacggatgaataatgtgttaaaaataggtctacaaataaggtttaggggcgtagctgcgtggggcgacacggatcatagctggaccggccgaccctccctgcctaatgggtgcgtccaccactgtagagagctaatgttgccaaactaacctttgtgttcaatctaaaccacaaaatagagcctaccaaaaggttggtagggcacaaattgcacatcaatatttaaaatgtccctttctcttcttaaatagaggtacggtgtgtgcaatggcgtcaggagtgcacctagcacaatacgcacgtgtccccacgcctccaccactaagcactaagcataatttgttataataaaataataaataaatagatgcgttgaaagttttaatatataagttcaaagtttcaaaagttaaattgaaggtttcagttttgagttgaaaagtttcaaaaattcgagtagtgttttctaaaatttcgagttgaaagttcaaattgttagcagaaacttccaaatttgggttgaaattttgaagttgtcagggttacgaataaggcataccctctatcctatgacttatggaacatcccgataaggtataccttcacatgtacgggttgtttccgtatacatgtaacaccctgaaaattcgacgacaacaatctaaactctaaaaatatgggccttcaaaaactttttaaataaattgcatcatgccaattttctccgcctatttcattggaatttggtttcgaagtttatcaataacgaataaggaataattaattaggaataaaacctaaaattaaattggcaaaagaaataattaagatataatttaaaataaagatgaggtgaggatagaaatgaataaaatattattgcgaccatatttgtatcaattaaatttaaatgcgattgaataggaatttactctaattaaattcaagtaaaattttataaaaataaaatatcggtaaaataaatctagagtggatccattggttggaataacacaaatattgaataaaccatatttatgcaaaatttaggatttatagaatcaaatttaaataataaataggctaaaatcgggttaaataagaaaagacactgttcattgcactctaggtgctcgacgtggtcccttaacccagcccctcctctttcccctctctctgtcgccaccgtcaccacgcgccgccgcccgtcgcgcctggccgcctcgcgcctcaagccgccgcgcgctgtcgccatcgtcgcctgccgccgtgccgccgtcgccatcgccgcctatcgccgtcgccatcccatcgccgctgccgcgccgcgcgccgtcgccccgcgcctcgagccgtgccgttgccgcgccgcgcgccgtctcgtcgcctcgcgccgcgcgcccgccgcctcgctccccgcgccactgccacgtgcctggccgcctcgcgccccgagccgcgccacgccgtcgccatcgccgcccgcgtgccgcgcgccgtcacatcgccgcccgtcgtgtcgccgcgcgtcaccaacgccccgagccccgcgccgcgccgcccgccgtcgtgtcgccgcgccgccgttgcgtcatccccctttctctccctctttcccctcttccctataaacacccccacccctctccattgttccccactccattttcctcttcctcccctctttccctccaccgcgccgccgtcctcgcaccgccgcgccgccgccctcggtgtgccgccgcgccgcaccgtgtgccgcgccgggtgtcgccgtcggcttgcgctgccgtcgccgttgtcgccgccgaccgccgctgtcggtaagccgccgccttttcccccccttgcgtccaccgctttcgccgccgggagggcaaagagccgagagagagaggaagggagaaaggagctgggagagaagaaagaaaagaagagagaaagaggagagaaaagaaaagaaaaaaataaatagaaattaggggagatcagggaagtttagaaaatttaaaataattagaatttaattatagattaattatagttgtagaattacaaaatttaatataaattatggattattcttggcaatttctataagaaatcaattcgcggtaataatttagatgtagttaatgactaaacaaatagatgaattcttatagattattatagattatttttgggtaatccctataagtaatcgattcacggtagaaattcggatttaattactagggattttagccatgtattatatttaatcatttagtcatagactaaattaaatcgtataatatttctaggatttcgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaaggaatcgactttcatttggatttatttggatttttatttgaattctgaattcaaatcaattttcgcacgtaactatagagcccgagggagttgcggatccaagcgatggtcaagacccgcaagactttgagcaaggcaagtcatcactattctttgaacatgttgatcccaattacgaaattatttttatttacaaataaaaattgcatgcaatgatgaacattctacttgtgattatgccatgccttgattattgtttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatgttgatgatatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaatcgtacttctcgtatgggtatagacctagcggattagatagccgagcggaggcagtatccctgcatagatggttcacccctgagtgaggcaggtgcgctacggtgggacagccgttgaggtagggccgagaggcgtgccctacatcggtgtcgctataggtaggactgccataagtgtgtgagagagagaacttaacttgaaccataattcaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtcccatgtgttgggacgaggcttatgtgttgggcagtcacggagtgcgggtaaagtgtacatccactgcagtgtaagtaaatcaaatctattcgaatagccgtgctcgcggttattgagcatcgggacatgtattacacttggctagactctaaattcttaacttgtgtggaatgggatattgcatgatgatttctatgctaatggagccacttcctaagaggcgggaaggtgaacgtcctcagaaaaccatgacgactcaatggcgggaagctatccttgggatcacaatggatggtggacagaatcgtcattgtttaatatgaacactggtaataaaatttgatcagtctgtgctaggtcttaggtttgtgaaaggaattacaaaacttgctttgcgcaaaagaaccatagtcatcctttgaatacccctgtcatatgcattgttgctgtggtggcttgttgagtacggttggtactcacccttgcaatatacaaacttaatcagaggccggagatgaagcttcggaggatccctatgcctattaccaggagggtgacgaagacgatggtgctcagtaggtcttagttacggtcgttgcctgtggcaatggcgtgccgctgccttaactccgctgccttaccttcttctgtttttggaatgtattccagaccgctcggtccgatgatttaagactatgcctgcgggcttatgatgtaataattcgtactagacactcgtgtatgtgcacttggtatttcagctatgaattcgtgtgtaccagactactcgatccagggaaatggtactgtttacacgattgattcctgttataaaaaaaacgggggtccacaatacgccattaggaatctatcttaaattatgaaaaatatctctatgagttaagaaattgccggagtcctactcggaaagggtaaaatctctggttatatcgtgccagtttacatatccctaagtcttacttgggagtcaaggtattccacggtataaaagggacccctagggggaggcgaagggcatcgaatctcatcgccaacacacccaccaaagtttacgaagcaggagtacgtggagccgacttgccgggaggtcttgtcgaatccctcgactacgatctcgtcggtatcgcctgtttcagttactctctttgtaatctgttttcatcatcatcaatcccatataaactggattagggctattacttgacaaggggcctgaaccagtataatccttgtcttttgtctgctttgatgttgtactacgtagacccctgctccaacgtaccccaatactctattcatccggtccatgagtatcactcgtcgacagtggcgcgccaggtaggcagacttggtgctcaaggatctaccagtatgacttcaagactttccgacaacaatgtcaccgccagcatcgatcaaggagcttctacctcgacaccgctggtgtggactcaagtcggatccattgtctttccggtctataccattacaccaatgtcgactggcccaatcatcatcgggaacgagagaggtacaacaacgactgagagaaacgacaacccgccgacaattcctcccacttaggtggagaacggaacatcgatggccccaatacctgggaggaaccctcaggcagctgaatttcacctccatgtgaaagataaaagccgacaaggatgaccaccctaaaaccgagaacttggtgtcctgtgcataagacaaccaagcatactctcgagggctgcccggtgatactccacgtgcaagctaaactctacacctgttgggaacgagggatttagtgtacttcaccgacgggagccacctactgtccgatccacacatctagatctcatgatcttacaagctgcagaatcttcctcaaaaccctcaaaccaccgcatcatcgcgtccaacaaccacgagttccaaccccatgtgttgccaaggaaccagatgcggcgccaatcccagatcggtttgtggggttcgttggcactgttgacggtcgttatcgatcagtttcgaccgtcaatattatcagaatagaggagaactagtgatgcttgcaatgcataaatatgttagaataataatattcccctagtagtaggtatactaacctttctgtagagaatgacaataaagtggaggagaatcgacatcaactcagacgataaatcaatcggacgatgtcgagaactagacttatgtatgaatgggccaagaactcagaattgacacgatgaattgggtcaaaattcacaagtctacaaagtgaagcaatagaggaggccgccagccgaagatgggccaggaaggcccagcccatggttcggtcgaacccatcctggcaccgttggatgcagggttcggcgtggacgtccaagattgcatcccaatgatggttgcagggcacttcggacaattccccttccacaaccgtcataaccacctctatataaggacttcactctcttcacttcaacacacacctcaagcaatagctctctcatttctctcaagtttagtttagtaatatctagctagtggaataggaatagagtagaaatcatgagtccgaaacccttcggaagagttcggatatagctctagtaggttttctcttctcttttgtaagctttgtacttttattagaatactcttctaaatacatttatggtattgaaatactttccaagtatatgagtacctactttacattatgttcatgttatactgaatatatggctagcttatctgggatatgctttggtgtgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacgggtattgctccgcgccagtatataatccgaagttaattcgatggggagggtattcctccgtatttagacccggttatatggtcatgacgggttgtcgtaaggaacttggcagtcaggggtggcttctcgaagtaccaggagggcatcggatagagggtattagctagtatatcagttaactagaatgtatggatactatgtatattagaagtataggaatagatttttttttctctttcctttccacttagctcagataatatattatgagaatgagtagtaatgcttgtgtgtcactctacccttggattatcttaacccatgcttagaatttgattatcacaagtaatatataaattattagttgagttctctctacatgatcttcccacgggataaaataaatacgatacacttggaataccctcgggtaaaattctacaatggtatatccatgcgcttgtggatgaactctgtaaccataatataccaggagtttttctgcgccattgctgggaattatatttctagtaatgttgttaagaaatgccaacaagcatttctggcgccgttgccggggaagattcataatagagattacttgaactaatactttatatttacctctgtataatcattttactttttgcaggctaaccttggttgttttcactgtttgctgtggaaacagggtagtgcatgactggtttcatcctgccggaaaacttcaaagaaaatccagaagctttcttccggatcgtcatgccgcgagtcgttgctccgcagaaaactctaccgacagagaaaccagccgtaccagcgccaccgaccttcaagactatggccagcaagactcttcgcgagttcactgctccctctgctgacaatgtggccataaggcaacaggtcaacataggggacgtggattttgacttgaagtccagcctcatcatgatggcgcaggctagcccgttctgtggcaggcctaataaggatgccaatgctcatctgcaacagttcctgaagatctgtagcacatacaccatcaagggcgtcagtcccaacgccgtcaggttgtgactgtttccgttctcccttcttgggagagcgaagcagtggttttatgccaaccgtgctgccgttaacaccagggacaagtgctctacggcattcctctcaaaattcttcccgatgggcaaaacgaatgcccttcgtggacgaatttccagtttccaacagacaagggacgagtccattccagaagcatgggaacgactgcaggagtacgtggccgcctgtcctcatcatgggatggacgactggctgatcctgcagaacttttacaatgggctcaccccaatgtcccgcgatcacctggacgcgtttgttggaggagccttcttctctaaaacggttcaaggagccgttgaactcatagggaagatggtctccaatgtgggttggagtgaggaacgactccagacccgttagcgaggcatgcacaccgtcgaggagacggagttacttgctaccaagctggacctcctcatgaaacgcttggacgaccacgagaaacaaccacaaggcaccgtcaaggccttagactaacacgtcacgtgtgaagtctgcagcggcacgggtcattctaggaacgactgcccggaaacccgtgaggaggcgatgtacatgggcaacaacaacgggtatcgtccacaaggaggtcaggggtgtaaccaaccacgcccatattatctaggaggtaataataacggtaacttctctaaccaaccctccttgaaggatcttgtttttgcgcaagctaaaaccactgatgtgctaagcaaaaagcttgctgctaatgataagatcttagagaacataaatgtcaagctagatggctttgcttccgcatttcaaaaccagctgagctttaataagatgatagtaacccagtttgcttagttggcatctttagtccctgcaaatgaatccgggaggatttcggggcaacccgacgcctccactgaaaatgtcaaggcgatcacgacaaggggaggtaagtccactcgtggtccgccatatcctaaccctgcagaaactaatgagatatcaaaaggagcgccatctagtgactcggttgacatggaggttctgccagaaaagactatgccgcaggagtattgagacacacggttgctgccgtttcctcaatggggtaggaaaccatcagtggacgagcaattcgctcgttttattaaagtaatccagaagatccacatcaacgtgccgttgttggacgctatgcaagtgccaacatacgcccgttatcttaaagacatactcaagaacaagagaccgctcccaacaacagaggtggtcaagctgacgaaacaatgtagcaatgtggtactccacaagctcccggagaaggaatcacctgctcgatcggggcacaacaattcgactaggccttgtgcgaccttggagccaatgttagcgtcatgccaaaagacgtgttcgacaaactcaacttcacggtattggcaccaacaccgatgcgccttcaactggctgattcatcagtccgttacccggtagggatagcagaggatgtgcctgtcaagatacgggatttcttcatcccggttgattttgtggtgctaaacatggacacggggaaggagacgccactcatccttgggcgcccgttccttagcaccacaggagccaacattgacgtgggaacggagagtatccgtttccacatcaacgggaaggaagagaagtttgagttccaaccaaggatggacaatgctccatggtcagggtaaagtacgggccgaacccacagaatatttaagtggtcgaagtggagccacccaagacggacagcctggtgaagtttatgcagaatttcctggagaaggaaacaacgatgcccaggaaccgttattggaggatgccggccaagaagttagagcagccgactcagaagaagccgtcttccgcaccaaaaccaagaaaggcatggaaggaaaagccaaagaggcccgctccatcacctccggagacaggtggaaaatccgtgaactaaatcagaaggaggtacggtcttgcacgtcggactttaaacgacgcgacctttgccaacaggtaaattggtttgtatccgcatatttgctttcaacaatttgaatttttgcatcatcacatgtttgaatttcaaatttgcatttaggatttttgaattttgaggaaattcttcaaatgaattttttaagagcaaacaaaaaaaaatttcaacgaaaattaactgtgccacgaccacactgaccgtttgaatccaacggccgaaagtggggccggttgggcccaccaggggttcggccgaacaccctggtttggccgaaccggccaggcaactgctaccagccatttttggcagggtaacagctagtgggtcccacatgtcatttctgtccgttatgggtaccctataagagccagccggccgagagagggaattccaccccatttcaacacattttcattccctctccaaagtttgctctcaagttcattcaagctttgatagtttccctcaaattcaaatctttagttgcatatatacatgttgctttggtgtaactaaccggcaggtgaaactcttgtcatttctaacccccgccgagttagcctgttcttgctccattgtgcagtatgaggaggcggctgtcttgtctgttcaaggggtcaggctctccataaagttgtcatgacgagtctagcactcgctcatcagctgatgtctcgatggaagacgccgacgctccgcgacaactcctaagcgacgctgaccttgaccttctcagtgatcgggagagagaagcctacaacatgctgagcgaccgggagtatgctcacacgcgagaatactcaccggagttactgaaaaagataggtatggatgttgaatttcgttctattaggaaagctgttggttggcagagatttgttgtggtagatgagcctggttctcgtttgcttactttgcaatttctatgcactttgaaagaaatagaagataatatttcttttcgctttttctgtaaggagttcacactcacatggaaagggttaagtacacttcttggttttcacgattcctgtaaaatcgatctccagaaaggaatttttgggtacgagaaaaataggttttgggaagacatttctggtgctccaatttgcaagaaacctagaacgaatgatatccataatcctacacttaggctcatgcacaaatggattgctatgactttgtttcctagaggtgatctgagacccattaggggagatgaattaattatcatgtttgccatggttagaaagatcaaaattgctcaggtgaaatgtatgataaggcaatggttagaaagtataaagttctatgctcctgttgagtgtacttctatgattactcggatagcaaaagggctaagtgtcgttagcgaccaaattgcttttatctcagccgctcgtccgcgtattgatgaggcttattaagtgcaagggcatattatggaacatggagtagatggatctttgatttactttttcctcggttgtacaaatgaaatcccgttgccaaatgcgggatatcatttgtacaactgccatgaactaaccattcccctgcaaaccatagaagaatctcgtgcaggtggaacatatagggagacgcgcaacatgacaaggaacgaacgagaaagttcatcatcctcaacacccgtacagatgtatgaggcaggatgggcaccaactggggatgcactcggatggtcctaagctccatgccatagcatcggactctcaacttgggcaagcgccagtgaggaccggtggcatgcgcctcatgacatccaatggggggacaatcaacctccccgatcgagtggtgtgcctcaatctccaagtgaatggttctcgagttcctctcgttgggacttgggtgaaatcactaggagaatggacacccttgatccagtacaacctcacgaaacacatagctcaaacgctagaatggtaacaatctgctgatcctcaattcaccaacatcaacaacatgatgcagcaacagcacgatgaccttcaggcgtactttcgttttcaggggttcaatccttatcaaggaccctgagcgaaagccaagcttgggggggggagacatcgctccccctactgaggtaacttgtatcacatttcatatttccctttccaattgcatatttgttttccaattgaatcctataaaagttgaaaaaacaacataaaagtttgcaaaatagaaaataccaaaaagataggataggtttgagtcatgctaggtaagacaagctagttctctttgttgaaatgatgaatagttgctctgttttatatctctgatatatgggttcttggtaagtgctctctcaaaggttaaatataagtagccaacaattatccgggaacctgaggtaaataggctgcacttgctgatctaagtctaagttgttgcgagatatgagatagtaatatgagttactatgatcctgatactagtttcacttgaattccagatgttttgtttttcaaaatgataaaattggaagttcctcatttgatataaattcctaccagaaaaaaatgctataatggttaaaccatatacattttggttacttgtcattccattgaactttgtcaaactcttgtgacttctgtagatacttctcatgctctatgatcaagatcatatacccacatttatgcacatgctaaactcctacactgggagctatacaaaattccattccatttccatattaccaccaaaataaattctccatgctttcatgtgctttcttctcctaaaaagaaaagaaaaaaaatccttttgaaaaaaaaaagaagggagggaaaggcatggttatgaaaaataaagttatgctccatcaagcataagcatgatgtagaaaaaaaaattgtagccatgccctcttctaatcaataaaaaaaaatgatttttaggagaagaaagtaagcacaaaggagaaccatttttcttttattttttttcctcatataccatttccaccagataccacacacaaattttgcatgaacttgatcttgagtatgtttagttatctgctctaatcgaagtttttgactcagtaataaatgtgaatgcaagtatgccatgtttgatccctaccgagctccacatatcaaaccttagagtaggaatcaaaaaaggcaatatttggtgaggaattcatattgatacacttacagagattgagtgaatcaattgaggaacttggctttcttttgcaaaatcgtttgaaaacttccggaataagaattgaagaaagattgggttattggtactctaaattgatgttctgtctttcaactgcccaaggcaaggagaagcagtgtctcgtgggaatcaagggtaagggtaagctaccgtgccaaagattatttaatctgagagagagtacatataccttgcacctgtatccttgagatatgcagcatagtagcaactcctgatcaacaatcaagtctttgtttcctttcgtccttcactcgggacgagcaaaggttaaagcttggggggttttgttgacggtcgttatcgatcagtttcgaccgtcaatattaccaaaatagaggagaactagtgatgcttgcaatgcataaatatgttagaataataatattccactagtagtaggtatactaacctttctgtagagaatgacaataaagtggaggagaatcgacatcaactcagacgataaatcaatcggacgatgtcgagaactagacttatgtatgaatgggccaagaactcagaattgacacgatgaattgggccaaaattcacaagtgtacaaattgaagcaatagaggaggccgccagccgaagatgggccgagaaggcccagcccatggttcggccgaacccatcctggcaccgttggatgcagggttcggcgtggacgtccaggattgcatgccaatgacggttggagggcacttcggacaattccccttccacaaccgtcataaccacctctatataaggacttcactctcttcacttcaacacacacctcaagcaatagctctctcatttctctcaagtttagtttagtaatatctagctggtggaataggaatagagtagaaatcaggagtccagaagccttcggaagtgttcgggtatggctctagtagcttttctcttctcttttgtaacctttgtacttttattagaatactgttctaaatacatttatggtattgaaatactttatattatgttcatattatattgaatatatggtaagcttatctgggagatgctttggtgcgggtataatatttgcttatgcaattactctatgtcatgacgatgatattagagtagtatctggtagtttagacgtggtctagattacgggatatcattatttggggttatatattgcagatgagaggtgggccgctgatggtgacagctcagtacgggtattcctccgcgccggtatataatcctaagttaattcctcggggagggtattcctccgtatttagccccggttgtatggttatgacgggctgtcgcaaggaactcggcagtcaggggtgtcttctcgaagtgccaggagggcatcggatagaggttattagctagtatattagttaagtagaatgtatgtatactatgtatattaaaagtataggaatagattttctttctcttttctttccacttagctcagataatatattatgagaatgagtagtaacgcttgtgtgtcactctacccttggattatcttaaccccttcttagaatttgattatcacaagtagtatataaattattagttgaggtctctctacatgatcttcccacaggataaaataaatattatacccttggaatactctcgggtgaaatgctacaatggtatatccgtgcgcttgcggatgaactttgtaaccataatataccaggagtatttcaacgccattgctgggaattatatttctagttatgtcgtaaagaaataccaacaggcacaaacaagccatccgtgttacacctcatggaaggctacgaatcctcttcgcagtcacccagagatgtgaacgtggtcgacaatactgagacaagtgcgtctgcagttgcgggaacgctagctcacgaattgcggaacctggatacgatattgagggagagtccttttgatccagcagcaaacccaggcgccaaccaatgggcagagcgactacgggagactgtgacgaacctcaatgccgcatttgctgaagcagcaggtggcccagagccgcgcagggacgaagagcgacctaccaaggacgcagatggagaagacctcgtcggaagacatgcctccggcgaccattcacctcgatgaagacgagatcctacaccgccgcgccgtgaaggtttagatcttcgtgaacatctaaaccggcgccggcggaataggagggatcgaaacgagaatgaccgtcgtcgtcgtgaggacggtactccgcatcgacaacaccgtcatcgctctccctcgcggcgagaaagagatgatggccgagggaatacccccaacgaagatcgagaccgttggccccataatgaccgacgcgacaacgacaacaatcgagatcaggagaataatcgccgaagacaggagagggacagtgacaaccgacgagatcgaaactcccaatctcctcacccgagtcgagatcgaggacacgatcatcgctcgagaagccgagctcctgatccccaagcgacccctcatcctcgtcttcgtcgtcctcttcggatcggcttcaacgacaacgtcgcgaccacgggccacaccctatcccaggcaacggacgtagggcattcacacccacacttcgcaatgtgcgatggcccgagaagttccgaccgggatcgattgagaaatatgatggaagtacccagaagaatttctgcaagtctactccacagttctctatgctgccagtgcagacgtcaacgccctggctaattatctgccagccgtgttgaaaggctctgctcgttcatggtttgtccatctcccgctgaacccgatttcttcgtgggaagacttatggcagcagtttgtcccccacttccaagggacatacaagcgccacacgatggaagatgacctacacgctctaactcagaacccgggcgagtcattgcgggagtatattcggctctttaacgagtgtagaaatacgatccccgagatcatcgatacttctatcatacgagcattcaaatcaggcgtccgagatcggtacaccagccaggagctggcaacgcgccgaatcacatctgctcgaagctattcgagatcatcgattggtgcgctcatgcagacgatgctgtgaggcgcaaggagggaaaaagcaaggcaagagatgagaagaagaagtcgaccgacagggatgcaccagagttgagcaaaaagagatgtcgcaagagtgggaagcgcaagtcctcgggagaggtccttgccatggagtaagtggcaccttccaggcgctccaacccccagagcgacgactcgcgcaaggcatggtgcccaatccacaagacaagcaatcacgccatggaggactgttatgtcacgcccggaaattcactaataatttccgaagtaatttgtgcataaaatcctcgtccaggaatcagccgaggtacacaaactgacaatttaatatacaaatccatcataataataacgttacatacttacaaaagaaaagaaaaacaacagcagcggaataacggtttagcgatggcttcagctccactcccacagggaactcaactggggtataagccaaacgtcttacatactcaacaagccacacagcaaatatgcaagtgcacaaggataccaaaggatggcataatataggctcatttacaaaagcagcatttagcaaacatttaagagtaataaaatagtagagtactttaatcattaattttaatcaacactgaacaacacgcccatgctgctcaggcccaaccattctgaacaaccatacccggctgtacagatctatctccaaaccaggagctaagcaaattattaccaattatagcatcaataattattgtgagaggtgtgagactaatcacgaaaaacattgctcaactcgcccataaccgcgggcacggctattcgaatagttttactctagccagaggtgtaccactatacccacaagacacagcctcaacatcatgtctaccatgcgtcgcgatactggaaagtacccgaatagaggctgtgacaataccccatgcacaacataactcaccacagtgcaccattcctggatcataatcaccccctctataaatataacaagaggcatggactccccagcgacccccatggacttctcgccgcttctcagtctggtgccccgcaatgaatcatgctatacaaaaggtaaagccgttgcccacgctggcttgtggttggcacggttaatgtttcacaacagtagctcgcgaaccggtccttaattgtcatgagcacgaccttcaaaaccatgtgctcacaacccacctttaatcaagttttaattatcaattaattataataacacaattaaccatcgtgagctaccattaaatataaccataagtaataatatagtataattcaccccattaatgatgctaatgtttctaagcatggctaagcaattatatatatatatcatttagctgaaccaaaccaatatataaggttctagctaatcaaattataacccataggaaaataaagtcatcttcggccattaattaattgggaaaggctcaccacccgatgacattcgaaaataatgcataagttgaaataaaacattagctttaaacgggttcaacatgctcaaagggttgtttgggatctgtgtgacttgccttgatcttccgcaaacacttctgaacctttctcaatgaaaacgctctcctccggaacatcggaaactaaagcgaaagaacaaaatcaacaaaacagtacaaaaacaagcaaaaccagtacatgtggatatttttaacatgtagatcatgattttagatgaatttagagacttgaacggcctcattccgacttcatatgaattagttatgaatttttacaagattaaactgattttaagatttaattttagaagggaaaagggctttatgacatcacgatgacgtcatcaccggcgagaggctcgggacatcacggtcaccggcgatctaggtcacggcggcgagaacagagggcaccaacgtgacgagcacgacgcggtgaactcaccggtgcaagaaacaacaacggacgacgacgaacgacgaccggcgacgagctccgaatggcggcgaaggctctccggtgaccggtggcgacggcgaaggggcggccgagcttcccctcttccacgcgcacccgacggcgacgtgaggaggcggcggcggcggctaaaacgacggcgcgaggcggctgttcgccggccggcgacggcggcggtttgggtggcgcggcggcggcactacggggcacgagagagctcgggagatggggcaaacgaaagagaacgactaggggatgctatttataggcttggattgaagagatcagactccaaccgagaggaatcgaagccggaaaatccgagggttagttggagagataaacacgaatcgagctcgattccgcgttgatttcttcgggataaagtccgattcttgggggaaaagatagaggaggataagaggaatatttcccctcaactaatttcgcaaacggagcacgggatgcggcggatttggtggaggaagcggcggcagcacaggtacaggacggctggctcgggctctgtccaagcttgaagacgacactgtagcagggaggcgaattagactttcgtattgggctggctgaaaaaaaaggaaagaaagaaagagaagagggagctcggctggaccgacttgggctgcacagccgtgcacacaaaagagggagatgggctggaaagggcccaagactaggaagaggattattattacttttccaattaaattaatcactgaaatgatatttgaattgttaaaaatactttcaatgctcgaataatttcaagaaaaatcctgaaaatacttgaacactataagtatttaataaaattataagaagaccatttaatgattaatttaatatgtgaataatttctgaaatgctctttgtattaggaattgagctccgaaaaatccgagaaaatttcagagagtataattaaccatggagaatttaataaaaaataaatccatccatgctttatatttaggaaattttatttcccacatttaacttcacttgtaaattaatgaacatttaatataaattctaataataatttattaaataatttataaatcctaaaacgaaaatcaggatgtggcatgttatgtcatcaaaaaggagctcacgagacaactagcgatcgagagagggaagcgagtatgagtcgtcgaaacgacaaaagaagccgccggcgacaactctgattccgcctttccagaatacgacctacatgtctcccacatcttcggtggatccacatcatacacctcaaagagagagtacaagaaagcggaacacgaagtctgctccacctcacagacgactactaccaagatgaagtggtctcaacacaagatcaagttatcggaagcggatcaccccaaaattgcgactacacctggcagatatccgatcgtggttgaagccactattcggaacataaaggtggcaagagttctcatcaacggcgggagctcgatcaacctgttcttcgccagcaccttagacgcgattgtaatacctcaaagcgagctgacgcccatagatcagcccttccattgaatcaccccggagtcgtcgtctaaaccgttgggaaaaaacacgctacccgtcaccttcggacacgccaaaaacttctgaaaacttctcaaagctggcttcataagagaagtcctctatccagagtggctcgcaaacccagtaatggtacgcaaagccaacgggaagtggaggatgtgcgtcgacttcaccgatctcaacaaggcgtgcctcaaagaccagttccctcttcctcgaatagaccagttggtgaattcaacggctggttgtgagttgttaagcttccttgacgcttactccagctaccaccaaatcagcatggcaaaagagggtgaggagaagacagtgtttatcacgtctttaggtgtattctgttataccaagatgccttttggattaataagcgcacgcaacacatatcagcgcgggatccatggagcactcggtactcagctcggacaaaacgtcgaggcataggtggacgacatcgtcgttaagatcaagaagagcgactcattgatcgatgacctcagggaaacattcgacaacctccgaacatatcaaatgaagctcaacccggacaagtgtacgttcggaggaccgttagggaagcaccttggtttcttggtttcaggacgaggaatcgaggcaaatcctgagaagatcaaggcgatcgaaaacatgaagtcgcccacaaggcttaaggaggtccagcggtgacaagatgcatggcttcgttaagccgattcgtcgcaaggatgggagaacgaggacaacctttcttcgccctgcccaagtgttggtatttcttaacgacattactggaaatataattcacagcaatggcgcagaaatacttctggtatattatggttacagagttcatctgcaagcgcatggatataccattgtagcatttcacccgagagtattccaagggtatcgtatttattttatcccgtgggaagatcatgtagagagacctcaactaataatttatatattacttgccataatcatattctaagctggggttaagataatccaagggtagagtgacacacaagcatttaactactcatcctcataataaataatctaagctaggtggaaagaaaagagaaaggaaatctattcctatacttctaatatacatagtatacatacattctagttaactgatatactagctaataacctctatccgaagccctcttggtacttcgagaagccacccctgactgccgagttccttacgacagcccgtcatgactatccaaccggggctaaatacggagaaataccctccccaggaaattaacttaggattataaaagaggaatgggaagctactagagccatacccgaactcttccgaagacttccggactcctgattcctattctaattctattccaccaactagatactactaaactaaacttgagaggaatgagagagctcttgcttgaggtgtgtgttgaagtgaagagagtgaactccttaaatagagaatcactccc

SEQ ID NO: 39532 - DNA, 13338 bp, Oryza sativa
aaactgatcgataacgaccgtcaacaaaaccccccaagcttgaacctttgctcgtcccgggtgaaggacggaaggaaacaatgacttggttgttgatcaggagttgctactatgctgcatatctcaaagatacatgtgcaaggtatatgtactctctctcagattaaataatctttggcacggtggcttacccttacccctgattcccacgagacactgcttctccttggcttgggcggttggaagacagaacagcaattagagcaccaatcacccgatctttgttcaactcttattccggaagttttcaaatgattttggaaaagaaagccaagttcctcaaatgattcactcaatctctctaagtgtatcaatttgaattcctcaccaaatgttgccttgttgattcctactctaaggtttatatgtggagctcggtagggatcaaacatggcatacttacattcacatctgttactaagtcaaaaacttagactaaagcagataactaaacattctcaagatcaagatcgtgcataatgtgtgtggtatatagtggaaatggtgtatgaggaaaaataaaagaaaaatgcttctcctttgtgcttactttcttctcccaaaaatccttcttttattgattagaagagggcatgataacatttttttttcaatcatgctcatgtttgatggagcataaccttttattattattattattattattattattattattttcataaccatgcctttccctcctctttttttcttatcttcaaaggatttttcttttttttaggagaagaaagcacatgaaagtatggagaatttattttggtggtaatatggaatggaatattgcttagctcccagtgtaggagtttagcatgtgcatatatgtgcatgtatgatcttgatcatagagcatgagaagtatctacacaagtcacaagagtttgacaaagttcaatggaatggcaagtaaacaaaatgtatatggtttaatcatgataggacatttttggctctggtaggaatttatatcaaatgaggaactttcaattttatcattttgaaaaacaaaacatccggaattcaagccaaactagtatcaggatcatagcaactcatatttactatctcatatctcgcaacagcttagacttagattagcaagtgcagcccatttacctcaggttcccggataattgttggctacttttattcaatcttcgagagagtacttaccaagaatccatatataagagatataaaacagagcaactattcatcatttcaacaaagagaactagcttgtcttaccttgcatgactcaaacctatcttatctttttggtattttctattttgcaaatttttatgttgttttcaagttttataggatgcaattggaaagcaaatatgcaattggaaagggaaatatgcaatgtgatacaagttatctcagtggggggagcgaggtctccccccaagcttggctttcgctcagggtccttgataaggattgaacccctgaaagcgaaagtacgcctgaaggtcatcatgctgttgctgcatcatgttgttgatgttggtgaactgagcatcagcagattgttgccattcttgcgtttgagctatgtgttccgtgaggtcatactggatctcccccatctgcacatcaagggtgtccattctcctagtaatttcacccaagtcccaatgagaggaactcgagcgccattcacttggagatggagacacaccacttcatctgggaggttgattgtccccccagtggatgtcatgagacgcatgccaccggtcctcactggcgtttgcctaggttgagactccgatgctatggcgtggagcttgggtccatctgggtgcatccccggttcgtgcccaacctgcctcatacatctgcacgggtgtcgaggatgatgaacttccttgttcgttccttgtcatgttgcgcgtctccctgtatgttccacctgcacaagattcttctatggtctgcaggggaatggttagttcatggcagttgtacaaatgataccccacatttggtaatgggatttcatttgtacaaccggggaaaaagtatatcaaagatccatctgctccatgtttcaaaatatgcccttgcactagataggcctcataaatatgcggacgagcggctgagataaaagcaatctggttgctaacgacccctagcccttttgctatccgagtaatcagagaagtgcactcaataggagcagagaactttatactttctaaccattgtcttatcatacatttcataggagaaattttgatctttctaaccatggcaaacatgataattaattcatctcccctaatgggtctcagatcacttctaggaaacaaagtcatagcaatccatttgtgcatgagcccaagtgtaggattatggatatcattcgttctaggtttcttgcaaattggagcaccagaaatatcttcccaaaacctatttttctcgaacccagaaattcctttctggagatcgattttacaggaatcgtgaaaaccaagaagtgtactcaagcctttccatgtgagtgtgaactccttacggaagaagcgaaaagaaataccatcttctatttctttcaaagtgcatagaaattgcaaagtaagcaaacgagaaccaggctcatctaccacaacaaatctctgccaaccaacagctttccaaatagaacgaaattcaacatccaaacctatctttttcagcagctccagagagtattcttgagtgtgagcatattcccggtcgctcagcatgtagtaggcttgtctctcccgatcactgacaaggtcgaggtcggtgtcgttcaggagtcatcgcggagcttcggcgtcttccatcgagacatcagctaatgaatgagtgctagattcgccatgatgacttgatgaagagccaaaccccttgaacagacaagacagttgcctcctcatactgcacaatagagcaagaacggactaactcggcgggggttaggaatgacaagaatttcacccgccagttagtttcaccaaagcaacttgtatatatgcaactaaataattcaatttgagggaaactatcaaagcttgaatgaacttgagagcaaactttggagagggaatgaaaatgtgttgaaatggggtggaattccctctctcggccggctggctcttatagggtacccataacggacagaaatgacatgtgggacccactagctgttaccctgccaaaagcggcaggtagcagttgcctggccggttcggccaaaccagtgggttcggccgaacccctggtgggcccaaccgaccccactttcggccgttggaatccaacggtcagtgtggtcgtggcatagtgaattttcgttgaaaattttattttggtttgctctgaaaaattcatttgaagaatttcctgaaaattcaaaagtcctaaatgcaattttgaaattcaaatatgtgatgatgcaaaaattcaaattgttgaaagcaaatatgcggatacataccaatttacctgtttgcgaaggtcgcgtcattttgattcagttcacggattttccacccgtctccggaggtgatggagcgggtgtctttggcttttccttccgcaccttctttgatttcggtgcggaagacggcttcttctaagctggctgctctgactttttggcgagtgcaggtgattttacctgcgtcctccaataacggttcctgggcatcgttgtttcctcctccaggaaattctgcataaacttcacgaggctgtccgtcttgggtggctccacttcgaccacttgaatattctgtgggttcggcccgtactttatcctgaccatggagcattgttccgtccatggttggaactcaaacttcacttccttcccgttgatgtggaaacggatactccccattcccacgtcaatgttggctcctgtggtgctaaggaatgggggccccaggatgagtggcgtctccttcccgtgtccatgtctagcaccacaaaatcaactgggatgaagaaatcccgtatcttgactggcacatcctctgctatccttgccgggtaacagactgatgaatcagccagttgaaggcgcatcggttttggtgccaataccgtgaagttgagcttgtcgaagacgtcttttggcacgacgctaacactggctccaaggtcgcacaaggcctggtccaattgttgtgccctgatcgagcaggtgatcgtaggacaccccggatctttctccttctccgggagcttgtggagtatcacgttgctgcattgttccatcagcttgaccacctctgttgttgggagcggtctcttgttgttgagtatctctttaagataacgggcgtatgttggcacttgcatagcgtccaacaacggcacgttgatgtggatcttctggattacttcaacaaaacgagtgaattgctcgtccactgacggtttcctaccccgttaaggaaacagcagcaaccgtgtgtcgcagtactcctgcggcatggtcttttctggctgaacctccttgtcaaccgagtcactagatggcgctccttttgatatctcattagttcctgcagggtcaggatatggcagatcacgagtggacttacctctcctcgtcgtgatcgccttgacattttcaatggaggggtcgggttgccccggaatcctcccggattcatttgcagggactaaagattccaactgagctaactgggtttctatcatcttattaaagctcatctggttttgaaatgcggaagcaaagccatctagcttgacatttatgttctctaagatcttatcattagcagcaagctttttgcttagcacatcaatggttttagcttgcgcaaaaacaagatccttcaaggagggttggttagagaagttaccgttattattacctcatgataatatgggcttagttggttccacccctgacctccttgtggacgatacccgttgttgttgcccatgtacatcgcctcctcacgggtttccgggcagtcgttcccagaatgacccgtgctgccgcagacttcacacgtgacgtgtgagtccaaggccttgacggtgccttgtggccgtttctcatggtcgtccaagcgtttcatgaggaggtccagcttggcagcaagtaactccgtctccttgacggtgtgcatgcctcgctgacaggtctggagtcgttcctcgctccaacccatattggagaccatcttctctatgagttcaacggctccttgaaccgttttagagaagaaggctcctccagctgccgcgtccaagtgatcgcgggacattggggtgagcccattgtaaaaattctgcaggattagccagtcgtccatcccatgatgaggacaggcggccatgtgctcctgcagtcgttcccatgcttctggaacagactcgtcccttgtctgctggaaactggaaattcgtccatgaagggcgttggttttgcccatcgggaagaacttcgagaggaatgccgtagagcatttatccctggtgttgatagcagcacggttggcatagaaccactgctttgctctcccgaggagggacaacggaaacagccgcagcctgacggcgtcaggactaacgcccttgatggtgtacgtggtacatatctcctggaattgttgcagatgagcgttggcatcctcattaggcttgccacagaacgggctagcctgcgccatcgtgatgaggctggacttcaagtcgaaatccacatctcctatgttgacttgcggcccgacggccacattggcagcagagggagcagcgaactcgcaaagagtcttgctggccattgtcttgaaagttggtggcgctggtacggctggtttctctgtcggaagagttttttgcggagaaacgactcgcggcctgacgctccggaagaaagcttctagattttctttgaagttttccggcaggttgaaaccagtcatgcactaccctgttttcacaacaaaaagtgaaaacaaccaaggttagcctgcaaaggaaaatgactatacagaggtaaatataaagcattagtttaagtaatctctatcatgaatcttccccggcaatggtgccagaaatgcttgttggtatttcttaacgacattacgagaaatataattcccagcaatagcgcagaaatacttctggtatattatggttatagagttcatccgcaagcgcacagatataccattgtagcatttcacccaagagtattccaagggtatcgtatttattttatcccgtgggaagatcatgtagagagaactcaactaataatttatatattacttgccataatcatatctaagcaggggttaagataatccaagggtagagtgacacacaagcatttaactactcatcctcataataaataatctaagctaggtggaaagaaaagagaaaggaaatctattcctatacttctaatatacatagtacacatacattctagttaactgatatactagctaataccctctatccgatccctcctggtacttcgagaagccacccctgactgccgagttccttacgacagcccgtcatgaccatacaaccggggctaaatacggaggaataccctccccgaggaattaacttaggattatataccggggtggaggaatacccgtactgagctgtcaccatcagcggcccacctctcatccacaatatataatcccaaataatgatatctcataatctagacaccacgtcgaaactaccagatattactctaatatcatcgtcatgacatagagtaattgaataagaaaagactatacccgcaccaaagcatctcccagataagatagcaatatattcagtataacatgaacataatgtaaagtaggtactcatatactcggaaagtatttcaataccataaatgtatttagaagagtattcttataaaagtacaaagcttacaaaagaggaaagggaaactactagagccatacccgaactcttccgaagacttccggactcctgattcctattctaattctattccaccagctagatactactaaactaaacttgagaggaatgagagagctcttgcttgaggtgtgtgttgaagtgaagagagtgaactccttaaataggcaggtaatgacggttatggtggttggaaaggtcggtaatactccatcgttccctcaaatccctgcatccatcggcttcacgggaagttcggctgaaccaccaggttcggctgaacctagtgtggcccaaccagcccacattttggctagtggccccctctgctgcttcacttcgtagacttgtgaaatttggcccgattcatcgtgtcaagtctgcattcttggcccattcatacacaagtctgtttctcgacatcgttcgattgatctatcgtctaagttgatgtcgattttccttcactttattgtcattctctgcaaaaggttagtagacctaatacttgtggaatattattattctaacatatttatgcattgcaatcatcactagttctcccttgttttagtaatattgacggttgaaactgatcgataacgaccgtcaacaccaagaagcaggacaaattcgagtggaaccaagaagccgagaacgcatttatcgcgctcaagggctacttgtcaaattcccctgtactcgttgctccacacatcaatgaagaattattcctgtatatcgctaccacgccttattctatgagtacagttaacgtcgtagagagggaaaaagtgcaacatcccgtgtactacgtaagcgaggccacagatccaaaaactactctacgctgtagttatgacatcgagaaagctacgccactacttccaggctcacaaggacaccatcgtttcctccttccctttgggtgaagtcgtctggaataaagacgtggtcggccgaattgccaaatgggtagtcgagctaagccaattcgatgtccactttgtgcctagaatagccattaaatcacaggtcctcgctgacttcgtagccgactggaccatcccagaggataggccagccgcccaaacggacaataaaacctggaccatggcattcgatggagcactggacagccaaggagcaggcgtcggattcatcttgacatcctccacagggaaccaattcaagcatgcaatccatctaaacatccgggcaacaaacaacatggccgagtacgaagtactactcgtagggataagagcagcagccgcacttggcgtcaagcgactaatcgtgaagggagactccgaattggttgcgaaccaagtacacaaagactacaaatgctccagccccgagttagccaaatatctcgacgaagtcagaaaattggaacacaagttcgatgggatcgaagttcaacatgtctatcgaaaagacaacgtcgaaccagacgatgcgcttccaggtgagaaccgcttcagcccggaacgtttttggatgtcctgacaaaaccatccgtcaaggacatgaacgacgaaagcaccacagccaataccagcatcccgcaaggggctgcagaggtcacaaacgtcgttgcgaacatagagacaacggacgactggcgcactccgctaatcaaattattggagtcagatgagctgccggacgacgacacagaggccgagaaactatcctgtcaggccaagatatattgtatgatcggcaatgatttatacaagaaggccccgaacggaatcctcctcaagtgtgtatcatccgacgacagaaaaactcttctcctccacatccacaaaggcatttgcggatcacacgccggcgcgcgtactctagtcggaaaagctttcagacaaggtttgttctgactaactgccctccaagacgtatgtgaaatagtgcaacgatgtaaagcttgtcaattttttaagcaaacacaccaagttgctagcacaagcgctccagactatccctttaacatggccgttctcatgctgggggcttgatatacttgggccatttccacgaggacaagggggctacaaattcttgttcatggcgatcgacaaattcactaagaggattgaagcagagtcgacaagagaaattaaagccgacaacgccatataattcattaagggaatattctgcagatacgggttgcctcaccgcatcctcacagacaacgggtcccaattcaccagcggtgatttccaagattactgcatcgaacttggagtcaagatctgcttcgccttagtgtcccatcctcagagcaacggacaagtcgagtgggccaacagaatagtactacaagggatcaaaactcgcgttcatgataggcttatggcctatgacaaaacgtgggttgaagaactcccatcagttctatgggtcgtacgaaccatgccaactacatgcaacaaggaaacacctttcttactggtatacggatctgaagccatgctcctaacggagttatgacatcagagtacatgcgtacagaagcatactgacgagaaactagacgaaaggcgaagcgacaatgtgaatcttctcgaggaacatcgtgaacgagttgccattcgggcagccgcatactagcaggccctacgcccgtgtcatgagaagcgcatcagagctcgcacacttaccatcggcgattacgtcctccgatgagttcaaaaccaggcagggcgtaacaaactctcgcctaagtgggaaggaccatacacggtggtacgaatactgtgaccaggcgcgttcaaaattgaagatggcgacgaccttgcaaatggcgcctggtcgcgagttatctaactcctggaacattcatcaattatgtaaattctatgtataaagtcaatgtatcccaaatgtgtacaaatcaattatccaaaggtattttgatctcctcatgaaatacatcagtgttttccccagagatctcttaccacgataacacccactcttggatcgaacctattgatcatttacgccgtttcgacaagcctccgagaaacctacgggaattttggttggggacgcccagagcagataaggtctcgtcggatttgaagagccgaacaaccatgtaagacctggtcatgtaagagtgctcaaaaggtgtattaactaagctgtgtaatcggaaattggtttttccaacttcacggctgggggctaggcaaatcgcaatttcagataggcaagttacgggtgatttgaagagcggaatgaccatgtaagacctggtcatgtaagagtgctcaaaaggtgtattagctaagccgtgtaatcggaaattggtttttccaacttcacggctgggggctaggcaaatcgcaatttcagataggcaagttacgggtgattgcgccttcccctccgagagcagacctcaccgaggacaaggccgggggctagggagagtaccttgctcaataacgggccaaagacagcccgtaaaaagagtagtactcgttcacaacataacctgtttaagcatttcactatataggtttctacttcgattacaaatccttaataaagataacagtatgttataaattctttctaggtgtttcttttacagggactaaaagcctaccacgacggccattgccagttcatggaagcaaaaacctcctcagctaaaggagcaagggatcgcgccagtcggtcgacctcgtccgccgataaccgcgaacggcgaaaacccccgcgcaggaacccgagatccatctacgagcggcgatcttggatgcaagcgaggacgtggcttccatcgtaatggctggcgtgacgacattcctccttgaggttgatgtcgatccgctgtcctatgccctcaagctgagcacatgcccccctcatcaaggacaagtagcccgccgtactctcctcgggctccgcgcgatcaacctttagctgacgacaaacgtcggccatggcactgcagcagctcttaagatacgacttcagccaaacctcgcagcctcggagagcctctacggcctgctcctgcttcactaccacgagcgaccgctcgagttccgcgacctcgaacttcgtcttccagtatgcaatacgcctatcttgttcagcaatgatcccatcgagatcttaaaaaggggagaggatgtaagagatgccaccatttaaacaacatgacaagtttgaaagggtaacttctctatgccatcgcacccgagttctcgctagggagcccgaccacacccaggttaggcggaccagagctcatacccacctccccatccttaacaatggcaggggtaggcatatcgctcgaggaaggtaggtcgatgcttgcgacatcacgacatccgccttgctagacatcctcggaatctacacaactacgaaagacaaagaaacacgacaaatcgacaaatggcgcgaagtaaaagaagtcgctccgcccacaggacaacaaaagcgtttgtacaaaaaccacaatacaagacggagagagtttactcctcataaagggggaggatgctctccccgagaaccgacacgctggacgtcacgttctcccgcgtggcatcagcagcccccttcgccaagatctccttgaggtcgacgccagggagagctagcttcacgcacgtgaggacatgacatgcccccgtgtggattccattggagatatcctccgcaacatgggcggcgtgctacaacgggattgcctccatctcgcctgccagctccaacaataccgatgtcagcgatgtctcgtcggggtgcgtcgggatagaagactccacgccgcacgacaacgctagttggtgcaggcttgttaagctcttgcggagggagtcgcggagggaaaagaggatgtcttgtgtatcgttcatcttcttctctaggccctggcgttgcatctcattgccggccatgatttccttcatcttctgaaggtcttcatgggcaacctcgagtcgcgcctctggctgagccaccctcccgtccgctaccgtcgcgcgggccaccacgcggtccatctgggcctccaccgcccgagaaatgctctcaagaaggcggtggcattcgaccaccatattagaccaattggccacttcgggcggcggtaggccccacggactcggcgacaacaggggcgacctccacgcgagggatggtagcggtgggagatccactcatcaccgcttcactcccgctttgcgcggagaccgccgatgcgttcctactagggctagcggatatcatcagcaaatattagagatgtgacaacggagtgggtcaaaagtttcacttacttgccggtgggcaactttaacacccttctcttcggaggaggagcgaggctgcctaagtcctgcgtaagacggcgaattatgacttcattccagtatctcaagaaagaagggtgacaacggtgcgctttacctcaaagctggcagacttctgccgagaactggcgatagcgcttgacctcgcccagggctttcgcttggtcccgctgcctcctgcaatgacgggaacggaggaaatgttggcgaccttgtccttaagcaaggcggaggcatgatggtcaacaaggggaccgacaacatctgtcaatggcaaggcctacagaatttggagtcactttggctctccaaaagaagaaaaacataaggtgcaccagtccttgcttacattgatggcggccaccttctcggatgccgacttgtcgcagagcggggccggtggttcgacggccgttgaggcagcactgatcaagacttccttgaaccgctgcgtcacgatgtcacccggaagatctgaaataaatgaagatacaagaggatgagttaggcctcagccccaaagtcatcaacgaaagcaggaagaagattacaacataaaaacaagtaccccgcgaggagattcaagttatgtcctcagtcccgggtagtcgaacgaggatgtcattggaggtttagaggtccagtccccggaacgctctggttggacctcgggcatggcaagaaccgggtcgagttctttaagttcgaggtagaaccatcttgacctccactggctacgggatgagtggcattggagaggaatgtatttcgccttcatgccaccacgaaggcggaatccacaacatcccgtgatgaaccttgagttcctctcgacactcaaggttgttgttggcccgatctttcggtgagttgtgataactaccatttgggagaaacgttgacgatccgactacaaccgtacgagacattgtgttgc

SEQ ID NO: 39533 - DNA, 17765 bp, Oryza sativa
  unsure (1)..(17765): unsure at all n locations
ctgcagcccgattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatgaaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgatttcactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgattttttttggtgcggctttttttttcttttattttttgcacctttctgcctttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccagttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggctggcagccgaatttggtgtatgggataaaaaggaaactgatttttaaccaatccaatctactatatctttccaaaacaatcttgactacttccaaaatcagatatggtaattcaccttcctcctcttgtgcacgacacaggcacggccaaaacaagcacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacaaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaaccccagaaaccctgaaggggtacctaactacttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtattcatagtagccatggtcacatcaggaaagtaactaatcaatacataaccaaataatcttatccaaagattttgaagccgccatgccatgggtgcaggagcatgtgtatgcatgcttctcctctcttcctgaccccctcatgtgctctacgtccatacatattgctctttgtgccctactgcgaccttgcctaaaccaggatatattgccgtcgacttgggacggaaaccaggactgcactttgcaatccaatcctcatggtgaatgacagcttatgtattatttatgcatgcctctggtgatttccctgtcatgcacctgatttgacccctctgcaacatggatttggatagacttgctatttctaactgttatgttcaagaattttaacttttaggtatcaggttctgatatattattgcagggcaaaaaggtaattctagtcctagtaagtaggaccatgaaaggagttctacgatgattcataaatatagcttcataggatgaggattcctgctctgtcttaagaggacttgcaagagggactcatccaaaggaagtaactagaagtaattaggtcacagtagatgattggaggctgtgattctttgtgccgtagatttttgtgtgggataggaatctgatagtctaaataagtcaagacaaccatattgagagttcaataatcccttgtactgtttggaggttgtgcttgaagaaatttgtagtccgctttgacatatcttttctctcgccatggattgttttgtcgccgttatttttgttctctataggataacagaaatatccagagctgctgcatagtattagagtataacagttgatttaactagattttatggtctgtgtgcagccgtattgggccgcttacctggcaccacagtgtaccgaaatagattgcaataccctgaggcttatacctacaacgggatagttgttgttcgaattgatgcacctatctactttgccaacataagttacataaaagacaggtggatattttttttatctgtatgaacagtttgtgttatcaattttttttcttaccctgatgtcctgatggatgttttgttgattgtgtcccttatcaggttgcgtgaatatgagcttaatctcccaaattcaaaccgtggacctgatgtcggaagagtgtactttgtgatcctcgagatgtcccgtaagatctttttcttatgttacatgatatgaggcacattaatttttttgtcatatcatgtttgcataaaaatgtttctttcaattaagaaactcatgagcatcaagtagatttactagactagttaagataaacaaatactgaacatgcagctgttacatacatcgattcaagtgctgttcaggctctcaaggacttgtatcaagaatacagggatcgccatatccaggttggcacttcttctaattaattgaacgagtgaaaagtagaaacaaatgtgtacaggtatggcattaaatcattgagtactactgattggttgcagattgcaatagcgaacccaaaccggcaggtacacctgctgctttcgagatcgggcatcatagacatgattggtactgggtggtgcttcgtgcgagtgcacgacgctgtgcaagtatgcctccagaaggtgcagagctcatcatcaagttccataaagctgtcgccacaggcatcaggggacctagctgactccgttaccactccaaaggttcaacagcggtatagttttctaaagaacctctggaaatcacaggttggggacgggtgtacaggtagtgaggttcaaccgttgctacgccaaaaccttgtttaacattatggccgactacctttctattagtatctgtctgcctgtttatatttgatgtacatgtatgcatacagtgtaaaggaaaaaaaaggaatatgttattactctcttgcaattttatatagaggaattgagatggggttgtaagtggacagtatatgtgctgccaacacattggttatctacacataaggacgtagaatatgctgtgtactgtacggtgccgcggcttgcctatcgtgaggagttgaaatgttcgcaaaattcttgtttaacttgtaagtttatgtatatacattttcctaggcatgtaataacagccgctttccatctgtatgagtcgtttttaccctattaaggcttctttggttaatccctaaaagaaaaggattataagggtaagaggattaatttcacacctcaatatacgtggaataatttttctccaattccctttcaatcctttatgaatgggcctgagcttggtttgataaaaggaataaggcgtttgacgggtatgcatgcttgtgaccgtaagctgaattataccagtctcctcaattagactttgcatcatagacgattcttaataactggtaacttataaaagtgaattaggataaaaattattttggatgtttttgtcctcatgatgttatatagaaacggtgcttcgagaccataggtaatactgtgggaacatctctgaagaagattttcaatagtataatattgtagacctgtatgaacatctctaaaggagattaatattgatgttgtgtactgatttgtagttggacaatagtaaaatgaggaccacaaaatttgttaggagtgcatttagatcaaaacaatacttgtgcaatgctattcagttgaacattcattggctctaaatcaaactgttcttttatcatgttgactaactcaagtagaatcaaaccaatggccctgggtaagatcttgtcaggcaaaggaaaaaaatagatacaataaattccctaagtaagacattttaggacaatattgttaacgatgaagatgaatggattatgtggcctattatgcatccattgtgggagcagaatagcttgggcacctctgatatctttttttcatataacctagatcattaatttttacagtgttgataggaataaaactatgtaatgtacattggataaaaagaactgaagagagatatttaaagcatagaagatcacctctgggaacaaacttgacaatgcatcatatatatatatatatatatatatatatatatatatatatatatatatatatatatatatattatatcaggttcttctaattgtgcagaactgtttcctagaggaagcagtagcatagcctgcaaattgacgcaaaaaaaaaagaagaggtanatacctgtaggtaaacatagatacattgccagctggaaaaagagaatatttgtctacctaaatacatcaacacacagtttagaatatgacaataaataataaggacaaaatgcatcaggaaacatcatacgatgttactcttgctcaatgccaaagcagtactggaactggattcatctataaagttcttagaagcaagagcggtaataagatgccttgtactttactttgggtgatttgcatagatgaaatcatggtgctactgctcctggacactaccataggagagagtaagcgttacataattaattagtaaatagaagatgcagagtgaaatgttttgtggtaaacaatgtacataccttcatccacatacatagaatttgcctatcaatcagtaaccacatggttttgctctgaaccctggttgtaatcttggaaaacaaaaatcatgtccagtcgaagatagaggaaagaagaaggaaactcatagtcactactcaccagtggaaccggatcctctgacgtactttattctacttcaaagggacgttcgaccatggatcgccgttccttgcgcatccgacgacaacaaccgtttcagtcccgtcctttgtctcaggccccacagcgcaatgtctctgcctgctctccgggagaaaattgtgattttgcttatcgcaaaagaatggtttcgctggaatactatccctccaaagtgattcattaaaatgctattctaaacaaaggggtgttcactgaaatgctattttagatctttttggttgctagaaatgattttactctattttaagttttgttctgaccaaaatacccttgtgtccttgtctctattatgttgtgaaccgttgtgaaccatggtacatgtgaaccactgttatattgtgaaccattgttatgtgaggtattttgtgaaccacatgctattcaatattatgtctacatgctgtccaaatttgttctattttgtttttacaattttttcatgcccaaaatttatgggttaagctagcttcaccattatatctttataacttggagtgagaaaaatcttgatctttatgcgcgcttgtggctaaactggactacacaccatttttattgtacaaatgtgaaagcaaaatatattgctctagcaaagcatgtgtcaaaattaactagagaggtgctgtttgactttcaaaccagtgcactagagcttttgtattagtgttaatgatcaattagtatatacatatcatgcagcggagcgtgagccgtgcataggtttcacaaatatatagcaatatattttgctctagcaaagcatgtgtcaacctgccattatcctggcgaaaggaggacatagaggcgagggcattttggtccggagaaaatctaaaagagagtaaaaacattagtactaacaaaaagatccaaaataacatttcagtgaacacctcttagtttaggatagcattttaatgaatcactttgaagggatagtattccaacgaaaccattcttttgcgatagcaaaatcacaattttctcgttctctggcccattcattgatagggacagcagtgccgcgccggccgccggagagctcaggccgccgcacactgctgccggtggggaggtcggactaggacgcggtgctaccgccgtccgccggcgaggtcgagggcgacggctacgcccgcctcggtgtttgctgttggtcccatcgcccaacgactgctgttctcggaaccgtcgccggcgaggttggattggaatcgatctgtagccgatcgaacttccatcatcaggttgccttttctcatggaagaggcagctggttgaaaatcttgctaaggcattcgtgctgtcattaacttttctcagaaactacaagtaacctgaagaataaaaatcagagctaaccagaagaaaagaaaccaaaactttgccaacagattcacagttgaatgcgacatagcaagtctacaattgcaataagaaaataccaaagaagatagtttttttccttgaagaagagatcaacgagtgcagatgttaaccaatgaaagaaatctcatggcatgaagtgaagagaagatgagtaacttttctgttctatttgttccccgtatagctctccgacgacagttccgacaacagcagccgctgggcggagccatcgccgtcgacctcgccggcggacagcggtagcaccgcgttccagtccgacctccccgccggcttcagcgcgcggtggcctaagctccccggcggctggcgcggcaccgctgcccctattaacgaatgggccggagagcaggcagggacatcgcgcttgcggggcctgagacaagagatgggattgaaacagttgttgccatcggatgcgcaagcaacgacgatctgttatcgaacgtccctctgacgtagaatagattacgttagaggatccggttccctcaccagtatcaccattcaccagtcaccaatagcaattaaggcctactttctagagcggaagtgaaagaacccaaagcagcaagtaaagaaaagtaggtataagaaagaggccctacgaaagggcgtcagcaaggctgctataacacggccacacgagccattcatcagagatgcaacagcgtggatccgccttcatcttgaccagcggtagcgatggaggacgaaacaatctccattgatgagatgctagttcgtggtgaggaagaggaggggaatttatttgcatctgaactctatctggacggagaagaggaatgggaatggttgcaagaaaatggatcagtaaaagacaggagggcagggcagtgaggcagttagcggtgagtggaagcagcacgggagcggcggccttgcttcctgttggtgtggcgaggcataggacagacggccagatggggggtcgcagcctcgcagggttggatggacaggtgcgtcgatggggcggggaaggtgaagtggccggcgctagaagggggaggcgaagtggaaccggcgcgcagagtggcgccaggaggaggacgcgaagcggggcacagtgtggatgcggtgcgggggcggcggcgcgagatgcaggaggggagttgatgcgcgtggggccgccaaagcagagtgatgcgggagaggagagaaggggagcgtggagccggcgaagcagcgagatgtgggagaggagaggagagaagcgacgcggaaggaagggctcgatgcggatccaacggtggggacaaaaaaggtgacgtggaagcaccaggaagcagagagttctagtagtggggatgatttgtataggtataggattccagtctcctgaaacatgcaggttttctaaaaagaacataaatctacatcgagaggcctatcgatttgtgccatcgcgcaatgctgggaaagccatccatcccgcgaacaagcgacatggtgtccatcccgtgcgtcgtagcgttctgaccgtgagaagggtgcttcttcctttccatctactcaggttatgcttttacgtggattgactatgtctgatgaagaatttgatactttgatggaggatacttctctagtggagggagttcaatcccaggacaatttagttgaaaagcttgctgctgttccagaagtgatattgtctccatctaagaagagtaagaggagaggtagtgacatcattcaacacgctctagaaagggcagagaagataaaggctgacagaaatctagaaaatcaaaaggctaaaggtaacttgcataataatgtttcctttttacatttttctaatgatgatatttctgcctctttacaaaatcttggtatttttgctgcaaataaggatgttagcttagatgacgctattaatgatataagaagtgtagaacatgaaagacttagggatcatgttagtttaaatgataataatgactcgagtttaatctttgataatgatttcgtagaggatcaattagaggatatctttttactacatcagttatgtagtgaaattatggatgaggtaatggattcgttttcaaactacttcagattctaagataccttccatggacaaaaaaaaaaggcaaaagagtgaggcgaaacaaagtttataaaaataagttataagtttataaaaataagttataatgaaaggagtcttttggaattgtgatgggtttaaagacccaaaaaaaacataagtttatttctgattttactaaggaacatcaacttaattttattgcgttatcagagtttgttaggagggattttacttcttctgatcttaaaaatctttgtgctagtaaagattttttgtggcattcctagggatagatctggagggatgttattaggaattaatttatgaacttttgatattggtttaattgatgagggtgatttttatattaaatttcatttatgtaataaattggataagtttaaatgggctttggtgttggtttatggtctgacgcaaaatgaatttaaagaacaatttcttcttgaattagtgaatatgtgcagatatgaagctttaccaattctcattggtggtgattttaatattttgcgcagtcatgatgaaaaaaataatgataactgtgatgatatgtgcccttttctctttaaagcaactatggatggttgagtcttagacaacttgttttgtctggaagaaattttacttacgcaaataatttagcaaaccctacttatgagaaattagatagagtattaatgtcgacggagtgggaacataacttcccgctatcctcggttgttgctcttaatagagatatttcttatcatactcctttacttttaattacaaactcctcttcaccatgtaatggacaacacattttcaagtttgaattagattggctactatgggatggttttgtagacatggttaaggaaatatggtcctccacagatgaaggtaatactcctaagcgttgacaggctaaacttcatagattaagaaaacattcgaggggatgggataaacatacaagtggtgtttataaaaaagagaaaaaatagttattaaataatcttgatttgcttgataaaaagggtgaaacagatttattaactccgggggagattgatattagatatgtttggagaaatagactagcatgtttgttgagagaagaagaaattaagtggtatcggcgagctaagactaaagatattttagaaggtgattctagtactaaatactttcatttggttgcaaatggcaaacaaaggaaaacaagaatctttgtattacaagatggtgaccaaactataaatggtgatgcgaatttaaaattgcatattaccacttattacaaaggtttgtttggccactagaggactctatcttacaattagatgagagtagaacaaatgatattcctcaaatttctcaaatggaaaatgaggctttaactcaggaatttagtgagaagaaaattagagacatagttttccaaatggaacataataaggctccgagtcctgatggatttccagctaagttttatcaggtttttctggaatgtcattaaatttgatttgttggagttatttaaatattttcataggggaactttacgtttatattctgttaactttggtactatattttatagcctatttgtttacttatgttagttttaaaatttttactaaagttgctataaacataataattggggttgcccaaaaagtcattagtcctactcaaactgcttttattcctggaagaaatattatggaaagagttgttattttatatgaaattatacatgaaattcatcgcaaaaacaagagtggggtaattcttaagattgactgtgagaaagcttatgataaggtaaaatggtcttgtgttcaacaaaccttaaggacgaagggtttctcgctaaaatggtgtcagtggattgcctcttttatccaggggggacatgttggtataaaagtaaacagtcaagttggttctaattttcaaagttataagggtcttaggcaagggaatccattatctccaattcttttaaatatagtcgttgatatgcttactatattaattataattaagagggtcaaggatgatggtcaaattagcgggatcattccacacttggtggatgatggtctttctattttgcaatatgcagatggcactcttattttcttttttttttagaacatgatctactacaagccaaaaatctaaaattgttattattgacttttgaaaaaaatatctggccttaaaattaatttttataaaagtgaatcattttgttttggttagtcaatggaatgtcaagagctttattctaatattttttgttgtaagcttgggaatttttccgtgagatatcttggtattcctatgcattttagaatacttagtaacaaggataggaaaacaatcgagggaagaattgaaaagaaacttagtagttggaaaggtaagcatatgtcaattgggggaaaattggtgttgattaattctgtgctttctagtttagccatgtttatgatttttttttgagattccaaaatgagttcttcaaaaaattaattatagatcacgtttcttttggcaaggagatgagcacaagaataagtataggcttaacccaaagatcaaaggtactcttggagttcataatcttaaaattcaaaatcaatgtcttttgagtaaatggttgtttaggcttataaatgagtagggcgtgtggtaggatctatgaaaatgaaatatctttataatcaatccttaagtcaagttgagaagaaacaaggggattcccatttttggtcgggtcttatgaaagttcagagcaagtttctaaatatgggttcctgaattgtgaataatggtgtacaagtgagattttgggagaataaataggcagggaactattctcttaaggatgggtacccgtcgttatatgctatagttcgtaggaggaattcttcaattgcaaatgttatgtcttgtgttctactaaatgtttcttttaggagagctttagtaggacataatttaaacaattggcataatttatgtgcttcaattgtgcatatttatttgactgaggagaatgatatttttatatgcaattttcatcaaaatggtgtattctcggttcggtctatatacttagctttaattaataatggctacattgagaggaataatattatctggaaacttaagatgcctctcaaggttgttctaacaaagaacaatttagctaggagaaattagcatggtagtttgaaatgttgtttttgcatgagaaatgagactattcaacatttatttgtggagtgtcactatgcaaaatttctttggagagctctatagtttactactggtttatatactcctcatagtatatctcatattttgagaattggcttgtggggggtgataaagaatataccaaacttatccttgctggagcatccgctatatgttgggctatatggttgtatagaaatgatatggtttttaacaaatcaccatcgatgtcgtatacgcaggttcttttcagggcaatatattggctctggtcttagcctcaactactaaagtgtgacgaagaaatcaagtcagtgaaagctgcatgtcgtaatctggagtcaatggttatacagttgttcactaactttggatggagattcataaatagaattcaataatttttgtgatcttgttatgccgtgggagtttttattagtttgtgtgtgcttttgtttattcatgtgtgagtttttgttgaattggtgtaataattggctgtagaaatttgagtaaaggccgggattatattccattattaaaacaagttatgtgttttttggatgaatctcaaaacacagtttatgaacttgatatgtagttacatgtgataattctatgatttttggatatgttcttccggcttcctctcctccaagttgctgtttttcctcctcccctcttcgtgcttctctttttttcaatcgataatgccgtggcggttgtccagaggtggaaagacgacagatgtcctgatgtgtgggggagtccatgctgtcctgggctaaggctcaggccacgcaagatgccccacgcgaagcgcggtagcgcgtgtgtgacacggagcgcatgtgggagaaattccgtttttgtcgagggtcaggggtcccgttacacaacacgctgcgcgcgataaaacttcttggcgcgacacagtgacaaaaaccctagtcccccaccacgaggccaccaacccacctgccctcgtatagcatgagtagaaaagttactcgtcaaataaatccgcatgtatgtggaacatttgttcagttaaaattggaagaattataaatatatcactactttcaccctctaatttataatagccattataaaaccatcaattgcaaatttgccactgaaattagtgcatgtatatggcgtatgccatacgccattgccgtttgatttggtgcagttaagaggaaaaaatatttatagaactaacgtaaaaaaaaagcaacacaataagactattttgtccttctaagattcaatcccctgtttgctctcgaccgactcagatatgtgcacaataaaagccagaatagattgaagtaaaaatattactcaccaataagattgggaaaaaaaagacttatagtagagtaaaaagattagggagtagctatatttatggcgttatatttttcaataaaaaatagtcggcatgtatttatacattgtaagtcactaaattacatatataattttagtgtatttacgatgtaagtcccaaaattacatactaattacatatataagtagtgtgtaactactgtgtaaatttcatttgacgtatttttacctaaaaagttgtcaccatatttttatagctgctaacatcttgcatcattgtttggtttatatcctgtaatttgccacagcatgaatcttagagaagatcaaatcatctagagatctactgtaaacaagccaaaaatatggtgacagtattttaacaaaaccgaaaaattacttcctgcttcaccggttctctctctaatcccccgtggcctttttttcaccactagtaatttctttactcattggtttattctctctctaatgtctcgatagctttgtcagaaaaggttataagattttttagtattgtccacattaatatagatgttaataaatctagatacatatatatctattaacatatatataaaacgaaggaagtaatttattcctatatgccaactaaaaatcgcagtaaaaagatattctaccatcaccatacgtagttacatctcaaacatcaaaatctatccatgaaaaaaaaattgcacacaaataaaatcatctgactccgcgagaaagattacagactatatgagcactaggacatcggcaaatgagcatttgacaccttcactagacctcgtcactatgaataattgttgtttgttgtagcacgaccccataaacgccgacggcatcgccacttgccgattctctagtctcgtgtgaagctcggggcgggctcagttagcaggacatctcagaagtatcggggacacagcttcataaatccataatgctatatgcttgcagtagtagaattccaattatgacgcagtacactttcgctgccttaatgataatcgtatatatgcattttggacactgaacagaagtgcctgccgacatcctgaaacaagcatccataacaaactaagggagagtttagatctaggggagtaaagttttggcgtcacatcggatattgtgtagggtgttgcatggggtgttcagacactaatagtagcaccacattgtcaaatcatagagcaattaggcttaaaagattcgtctcgcaaattagtccccatctgtgtaattagttttttttctaaaattatatttaatacttcatatatgtattcaaacgttcgatgtgacagggtgaaaaattttagggtgtgatctaaaccgggtctaaagttcatactcaggtaagggagaatagtaccaacaacaaagttaagtcttagttaatctgtttttggcagcctgcaattaagtgataaactaaaaattcaatctcaccaagcatactgcaaaggatcgaagccccaatgttcaatcaaatatcaaaggaactcctcctgtctcctgtcctagtgccttccgggcagctggctaaaaatgacgacaacaaaacagtcatggcgtccaccggcggagcaggaagagggaggacggctttacggtgccagagtaggaaacccggcgccggcggcagcgttaacgcacagggaaggcatctgcattgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39534 - DNA, 2114 bp, Oryza sativa
ggatgatgtggcgtctacgtggcagtcttgaccgagtttttatcctacgtggcgcttacgtggcattataataaaaaaaagaaatatgtaggacccatatatcattccacaaataaagtattatggaacccactgaagcacggcgagtgggtcccataatacttaccttcttcctcctccctcccttcccttcccttctctctccttcccttcttcctcctccctccctctctctcccttatctctctcccccggcctttctcctcaccttggccagagtggcggtggggagcggcggcggcagcgggtaggagtggtggcggtggcggtggggacagcggtagggagcggcggtggcggatttggttcctaattgtcggaatttgctcgctgtgctcgaatctgcgttgtgtggattttttccccagtgatttgtgggtgttcgaatcgcatgcatttggtgtgaatggcttgaaattttgttggtgattgttgttctgctgaaatttgttggtccgtttcagttggaactcgcatgcgctgctgatgttcacggaggggttagatcgagacgccctcaagtgggttcgtgaggtgagagttcgagctcgccgtgctcctcccgaagtgggtcccataatactttatttgtgtgactgacatatgggtcccacatatttctttttatttttttttattctaatgccacgtaagcgccatgtaggataaagactcagtcaagactgccacgtaggcgccacgtcatccaaaaccacctccaaaatcaccaagggacattgtttgcacaggttttgatagttagaggagtcgatatacccggttttgtggtgggaggatatgaatcatactcggccgatagttgagggagtcgaagtatactttttcctactactaagtacagaagatagctaatgggccggatagttgttctgtggactgggccttgtgatcacagtggattatgcggcccattagtcggaaacggctgattaatcgggaaatgacggtaattaggagttcacaaacgactaatgaacaccgttttgtaaaaacatgacggacaactcaccgtctccgattgaacggccgtatcaaccgttttccacaatactggttgacgctgaccatcccaccaacgtggcagccgagccgatcccctagtctatgtggcaggggctcagcgccaagccactaatgttagtaccagagcaattggccctgagctttgggacttagttgctcgcggccaaaccgctgagccggcaaacctcagcgctacagtatttggcgttgaccctaaaggatggttgccgatcgaagcttggaccactttttttctcctataatcactgcttttcccagcaaaccactatgacatctgcaggtgactctgacacaaataaagctcctctcgaacctccgccgtggcatccgagcctagttagaggctagaaccataggcttgagaccacacgttggatcccatcacttccctgctagaaacattggagtactatcttgaagtcatactgtagttttttttattagatacatacgttcggtgaacacaggtgagttagttcatttcccggttcaaagtttcttgcatatgagataccgagaaacctcttattgcgttcgggatggtggaaagaactgagggcttattcggatggaaaaaacgcagctgatttgcattcatatggattaatttctatgaataccattcggactgtaagaatgaagtataggaaaatcaaaataacttttccttttctacaagttgtacagagaaaacatagaaattttttcattcattctaaacctcttgaaaaaaattatatggattggtgtatgcatacattcctattcctccacttttcctatttctatgggttaaaattcctacaactcgaataaggcctaaacttatgttggcacgaaaaataggacaatagtatataatgtaataaattaaatattaacaaaatatattgtttagctgtttagcaaacatgctcaacgaaaacaagtactccctctatcccaaaatataaatctaggactggatggggcatttcctaatacaacaa

SEQ ID NO: 39535 - DNA, 2161 bp, Oryza sativa
attttaaaagccaaggggggccccgggaccagccacacatttccactgacacgcgctaccatttgctactatttgcatgcaaaccacaaactctacaaacaaagccgcctcatttctccaacattaaaacctctacttcccccacaaaaaaaattaagaaaaatcgattttttttcctcctcctccacttttcttcgcttcctcactaccaccttctcgttgatcctcctccccgttcttggctcccctcgcattcgtcctcacttcccttcttccatgggggttcgccgccgtgagtgaggaggaggaggagtagtactaggaggaggtgaggccatggagagggtggaggatccggacctggaggacccgaacccggacgtgggggagctgttcagccactacgacgggctctacttccgcggcgcgctcgccggcgccggcttctccgtccagtggagctcgccgccgtcgcggatggccgggtagggtcccttgctcagctcactggccctctcaatctcttgctgagggtttcttggaggagctgcattcttttctggtctttttttcttcttttttaatatatccagaaaatttgcagttcatgggaggagttagtagcatctcggtgtgatgctgtgggagaaatctttgtagcacacttggggtgttttgctttctctgtgattctctgcacttgctgctgctgctgctgctgctgctttgattttttttgttcgaatccctagcaagagacggattgatcatctcttctttttccgggcgatttcagagggagggagggtttggttttcttggtttgttagttctccatccttcaatcgacaagcttcagggtgttggtgatctttcacgaaaggtttcgtctttttagaaaaaaacgcgaatattagggaagtagctaatatcaaatactaattattagaaggggtggcttcgaacccaggtcccactaccttgtcgagctaatatcaaatgctaattattagaaggggtggggcttcgaaccaaggtcgtctagcccagtaccttctcgagctaccggaagacctcaatttcgtctttttagcatttggcacttgaagtgacataaatggcgccgcttttgtgcacttcttgctgagaagagcttcttgtctacaagtagatcatgcatattgtagtttgcatcgatatagattctttttttttagattggcactttggggggttagtactcaacggaaaccagtaatcgccggtagaaaaaaaatgttttgggatgaaagagaagtacataatctgtgaccaagttcattcataactgtctcttgttagtgtgcgggtttgcttaatgagatttgtgcatgatttctagtagtacctacttttggatcacttagacggatagtaaagactaaaaacctttaaaaattaaatcattagcagttcattatactcggtgaagtaggctgcattcattgggtagacaataagaagtttggtgatgcttctagcattctgcttaatctgatggttggccgggttgggtaatgggttatgcatgtacagtacagaataggttggggagatcatcagccagtgacgtggatgaaacagcatgtatctaaaagtttgtgtcagatagcatttccccatgattgatggcttcagttaagcaaatcctcctatcttcttgagaatacagaacatgcttcactatcacatcagataaactttagcaagagaggaaaaaaaatgttgattttgggattaaagatgcttgttagtatataactattttgttcaataaatagctgccctctgtaaagatttataggtacatcttggggaaataactagtttgtttgtctatgcagttcttttggatcgtgtaccttcggaaaaccggataataccataacattgtctgaaactgtgctgaaatatcgctcaagtattgatatgaagaatgcattgctgcatcagatgatccatgcaatcttatttgtaaagcatcataggaaggactgccggtaaatgtttgcttgtgttagctaataaatcttgttactctctgcttaatttcagtgaattcatgcaggggtcatggtcctatttttcgtgcttggatgactgctattaacacctgttctat

SEQ ID NO: 39536 - DNA, 708 bp, Oryza sativa
catcacagtacaccatgaaatccttgcgagtatccggcaagattaacaccggcgaggaaaccagcttttctttgagagtctggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcggggtccacagcaactcctttagcagatatcacgtgccctaagaatttgacttcggacaaccagaactcacacttgctaagtttggcgtacaattgatgttcccgcaattttcccaacaccagacggagattgtcacgcccggaaattcactagtaatttccgaacttatttgtgcataaaatcctcgtccaggaatcagccgacgtacacaaactgacaattcaatatacagattcatcaataactaaagcgaataaatacttacttatgaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatga

SEQ ID NO: 39537 - DNA, 1687 bp, Oryza sativa
aataccctactcctgtttggggatttgaatccgccgggtgtgtattgatctgacgatcaggttgtgtcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatgggatacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgaatagatgcacctgataggtgtaacccccgactatgtggttagctgaacaaaccaaacatatagtcaaggaataagttatccaattaaccgggtggtttttgataattatagtcaaccaagtgacttgataccaatatatagtatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaatttccaaagtattgggcatacgccatgcgcacaatgctttaacagatgtgcttaagtccctaaaagacacatggtttcaccacacctggaaatatatggcatatgtggtgtaaaatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatataggctgcagacatattaggcctaggccaaaaaatacgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttaagcatagaaaatagactcatgactatgaatccatgtggaatgtatccggaacaagtccaaattgaaggtatgatacttgtgtttgagctagtaagcccctgagcatatagcttgtccttctgtcgtagtcaccattgtccattgatggtagcaatcaaaagtgatgaagtt

SEQ ID NO: 39538 - DNA, 1342 bp, Oryza sativa
cctgcaccccgtggtagctgtataaaccagatgtagaggcgagggcactagtcagcagtagacgagacgaccggcgatgaagatggtaaggccaatcaacactggcagaatcatgcagccatggaagtgaagaaaccagtcggcagccatggcaaacgtaggcagcttgtgttgaagataccgatgcctattagtagtgacggtgatgtagccagccgtgaagaagatagcatcagttggcgttataacaggccagccgtgcaggcggtgacaccagtcagcggcggatgcggcggccggtcggtgaagacgtagacgcccaacaacggcagcataataagtcagccgtgcaggcggaagcaccagtcggcggcggacgaggcggccggtcggtgaagacgtagacgcccaacaacggcagcataataggccagccgtgcaggcggaaacaccagtcggcggcggtcgaggcagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaaacaccagttggcggcggcgaaggcaagccggtcggtgaagacgtagacgcccaacaacggcggcataataggccagccgtgcaggcggaaacaccagtcggcggcggtcgaggcgagccggtggtggtgttctgactgatccattcctggagcgtaagagataagcttaaagccatgaatcccttttatgcatatctggatctggatcctgcagaacaaacatataggatgagtagtatctgatataaatataatactcgagaaaaatcaagtattttaaaatatttataaatatgtatttctcctcttgtcaattttgatttccccgagcagatgactctgtacgtttaaacactctgtctgactagtcatagcccccaagcatcgggagtcggcctaggcatttcccaaacatggatatgagtgacatgagttcgtcattaatggaacaaagtttcacggatcagaatttactactcaggtacttttgcaattattaagagcaaaaataaattatattatctctatgcttttgatttcttccgagtaatattagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagat

SEQ ID NO: 39539 - DNA, 2451 bp, Oryza sativa
gtagacgcccaacagcggcggcataataggccaaccgtgtaggcggaggcaccactcggcggcgacggaggcaggccggcggtgaagtcgtagacgcccaacagcggcggtataataggccagccgtgtagacggaggtaccactcggcgacgacggaggcaagccggcggtgaagtcgtagatgcccaacagcggcggcataataggccagccgtgtaggcggaggcaccagtcggcggcagacgaggcggccggcggtgaagtcgttgttgttatcagcaatggcagtggcgaagacaagccggcagagtggactcgtggccgatcgaccggaaagcttcatggtccaaaattgattggttgcatgcatgtgtgccaagtgttcggtccgcagtgcatgctatctcttgtcttgactgagcctgcaggatccaaatctggacttccacaaccccgatatgaaatttatatgtacgcaagatgttaatggcttataacacattgtccggttggcaataggtacgcgaatgagcatgaacgacgtttcgaggggtgttgtcaaagaaaaacaaaggtaagaaccactttggcaacaaattcgacaaggtcatcagcgattcttatacgagtctacgcaacggtcactaaagttccaatagcatgtgaagctataaacatatcattcaggttcctaggcatcaaacttcgccaatgttacttagggtgtgtttgtgaggaggggaaaagagaatatacgcaaaaaagggtgagtcatcagcgtatgattagttgagtgttaattattttataccttaaaaatggattagtaggattttttaaccaacttttgtgttgaattgtcttgcgaaaaacacaccgtttagcagttcgagaagcgtgcgcgcggcgaatgtcgcgaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacttcttctccaaagcttctcttactgaagaggggaaggattgagcaagaatgagtacaaccacagtactcagcaagccacaccggcagatgcatgattaatgcaagggggtacaaggagtaataatataggggttaagttttgcagaaaagcagcatttaaaagtcacttagttgcccaaagccattttataaagacgatcctagagctacacagtattattaaacaaggccgtgaaccctcacgaacctgccttaacccaaggcctatgatgattcagaccgaactggcaacccgaccctgggtcccagctcgtcctaagccaacccaggccaaccattccacattttagttgttgagcaaaattttaagaattataacactgacttgggtacattgctcggcttgcccataaccgagggctcggctattcgaatagattatactctgatcagaggtgtacatctttacccacaagacacgtcttcctcacgtgtaaccacgtgccacataccaccacggtatacagacggaagacgtgacatagtttctaacccatcctagccttagacaagagtaccgacccaattccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccagagtgtccaggtgatatgaaaatttcccaaagtctatagttgtaaaaccacctaaggttacctaattagattgcgaagcatctacctaaaattaaactagtggtgtcatgagtagagagtccactagttgaggttttgtttgcctagagtgaacaaggtagtaataataacaataacaataataatatggtcataacaaaggtaaataggcatggctaagtaaaacagtgataacgcgggaatttaaataaagcgataatgcaataatttaaatcaacataagtttataaaatgggattcaatatgatcaag

SEQ ID NO: 39540 - DNA, 1381 bp, Oryza sativa
cctttttaactttgtttatttcttttcaattattatttgtgctctgaaaattccactaaaatttatttaagcattttaggcttttaggaaatatacaaaaatcctccaagcctcatttgacttttatctttgcacattttaattgttgggggctttcacatgaatttttacttattctttgcacaatttcgaggatagattttagagtcgatttgggacgcgacacgagatctttcggtttgcccaacacctccatgtcaaatatcccgcttcctaggcatcttgcatttagataggttgcaaaccgccttgaatcaaaagcacaactgcgctagcctccttgtttcagccgctggacctattcaaagagttagccaaagaaatatttatgtacgtagctccctattcggcgtgcccttcagtaaaacgggcatgaatttttcatccgaattctttttaggacttacgacaacccgccatgtctttttttccgccataagtaccatatgagcggctaaaactagaacaagagcatcatacccggcgccgtccaagtgcaaagcacttcctatctcaaatacgactgcttcgtcgtaacccttagcgagtaacgtggcatattcaccatagatgtccacgacatttacttctcgtttgctctatacgctctaaggctgcctttttggcatccggagaaaaaaatccctccttcgccgcgcgcacgcttctcgaactgctaaacggtgtgtttttcgcaagacaattcaacacaaaagttggttaaaaaatcctactaatccatttttaaggtataaaataattaacactcaactaatcatacgctgatgactgtcgcgtcccaaaacgactctaaaatacatcctcgaaattgtgcatagaataattaaaatccatgtgaaagcctccaacaattaaaatgtgcaaagttaaaagtcaaataaggcttggaggatttttgtatatttcctaaaagcctaaaatgcgtaaataaattttagcggaattttcagagcacaaataataattgagaagaaataaacaaagttaaaaaggttttataaaaagaaaaaccctaaaagtcttcttttccccccttcccttcttgggccggctcggcccacttccctccctctctctctctctcccccgcggcccaatcggccccctccccgcgcgcgcgccgctgacgggcgggcccgcccgccaccctcgctgacgggtggggcccacccgtcatcccctacctcgcgccgctcccgccgcccgcccgtgccctagcgccaccgccgccgccgaattcgccgcatcccgccgttcccgcgcgccataaagagggggaaatcactcccgtgattccctc

SEQ ID NO: 39541 - DNA, 1199 bp, Oryza sativa
ttcattcggtaccgtgtttccttctgctatcatcacatcaaaaagccccaagcactcacgccaatccctcagctttgcatacaacgcaagaatgacattccaagacacaatgctcctctttggcatgccatcgaacaccaacctcgccatctctacgtccccagcctgggcatatccatccagcattgagttccatgacacgacatccctctccggcatcgcatcaaacatcttcctggcgttctccatgtccccgtgccgagaataccccgagatcatcgagttccacgtgaccacgtctctccgcgccattccatcgaacagattcctcgcaccggccaagtcgccctcagccacatacccagccaccatggagttgtacgagacgacatcccgctccggcatttcgtcgaacaggcggcgggcggcagggaggaggccaagccggaggcaggcacggaggagcgtgttccaggtgacagcgtccgggcgggggatgtcggcgaggaggcggcgagcggacgccggggagccgagggagaggtagagcgagaggagggagttggcgatgcggaggtcggacgggaggtggccggaggagacggcgagggcgtggagcgcggaggcggcgggcagggagtgcgagtggtgcttcgaggagacgaggaggagaagcgtgaggtggtctccggggaggaggcggaggagcgcggggaggaggcggcgcggggcgtgggggaggagggagttgaggaggcgggatgagagcgcgcggccgcggtgggagtgggaggccgaggcggagaggccggaggtgacgacgagggccagggactggaggaggacgcgccatggcgaactctggccagcggcgaggcgaaggcgcggcagcaggtcggcgtccaccggcggcgagcggcggcgcgggaagcctgtggtcgagggaggcatacggtgtacggcccgggcggtttgagaagagaagcactttacaaaagccaattcacaagagttgttgtacgcaaacaattttctccacgttttcgtttggcatcgactaggcaaatcgccggtggatcattcacaagatctatcgaatcgagagactataggcctgtttcaaagagcttctacagaattagaatctagaaaataaagtataaaccaaagctgacaaacctagttttttccatttctta

SEQ ID NO: 39542 - DNA, 1082 bp, Oryza sativa
actgatacaaactcagtggcatattgttgattatctcattaagagagtgttcgctatttttttgaaaaaatgaattaatatgattttaaaaataactttcctctagatttttctgtaaaaaacacgtcatttagcagtgtgagaaaacacgcacgtcaaaaacgagagtaaaattgggaacatgcaccaaagaacacacccttaatcaccaaccaaacaacctcttaaaaatacatccccgacatagcattttgctgtcaattcattaaattttattgcaagtgtcctcaacttcactaaaacctcattaaaagtatacctaagtatactttgtgtgcataatatttccattgctgtcaaagaaaccagttcttttctacagtaccacttaaagcaattctccctccactcgtcgcacagaacaggcctcccattgcacggaacaccccttgtacattttcacccttccatggataaataagggaaaatacttggaaaccgaagtgtcttctgctttaaacaaccggtcaatcaaagctctgggaaataaaatgcccatgaattttatattttactgctgctagctcctatagtccctccggtgtgataatctaacagttcaaacacagcattctcaccctgtgcttttcaattaactgtatggaacaagggtaaaggaacaaccatagttctctaaaaaaaaaagctccagacatgacgattagcttctaatgataaaatctgagagaagcaacaaaagaaaggtcggtatgcaaggtgctacatgatgatcaccaatcatcactcattcgtgctgctcgtatatttgcatgtaggcttctgaaagagctaccatctgaggaagagtctcggtaacatgaagatcttgcatttcatacctaaaataaggaatggaaaatgatttacaaggccctctcaactgcaggcacaaaataaatacccatgctaggaataagctgaggagcataccaagcctcttctgatttccgctgtacaaatactctgtaacatccctcgcctggcttgccatcatggacaacgttggctatgagatcatactt

SEQ ID NO: 39543 - DNA, 1368 bp, Oryza sativa
ccacagtctggtgcgatccaactccaacctgagtgatcgccatcgccatcagtttggtgttgctaccacgtggacggtggatctcctcgccgtcatcgtccgcacctcctcctactcgtcgattcgatgaggtgcggcgagcgaagccctcttggcatggacgaaggccacagcgccacccatcaactagagaacgaggctcccacgtacgcggcacgcgcgactgattcctcttctcgttttacttttttttattctccttttttttttcctgtattgattatcgtagcaaccaatcagaggcgagcaactgcaccagatggacgtggtaccttacagcgtccttgtctgagacgctcttttttacttagcgtccatcctattcttgtaattctactctatgattttactggatatttaattcatttgttaataattattatacaaaaaaaattcggtgaataatgtagaggcatgtgaaaaaatttgttaagcatgctgccagtagcagatggaatgtgaaaaaaatgctgtccgaaaaaaaaaaggaggaaatattacactatacaaattagtatcgatctacggtacgatttagtaacgggtgattgtttacctctgccagctcaaccatcggtgccctaggaagtaggaacatcataattacattatactaaggatagagttacgtgcaaggggttatccacatacccagcaaaacgaacatttagtcaaaaatcgttaattttccaattaactgaaagcaaagataaaatagtaagtttccgaggtaaaattcaacggcagcaacaataaagaaaactgtaataagctagcattggtcagcagcagcacatccacaaggaccacatcacagcaagcatgaagcagagcaaagcagtacagcacagagggaccgaggaggattattgcctcgaggcgaccgagttgtccatgaagtctgggatagcatccatgtagatttaatctgcctagcttaccaactatttttttttttaaagcagcttaccaactatttaattcaggcgccattgatctgcaggcaacggtagggtaagtaatgcattaagtcccccaagcaaatagacatcggaaatcgcttatatggctcgagatgagcgcacaaccattgtagcaggaatacagccaacaaaaaaaaaacagatgggaggagagagaactctaaacaaaataccaaaatgcaattaggatagcaaccttaggtggagaaaactctaaaccctaaacccttcgtagttctgatatgggagccaatacggctgccgccggtgtgaagcgcctctaccagcgccttgcacccacacaccatgcccggcggcggtggcc

SEQ ID NO: 39544 - DNA, 1201 bp, Oryza sativa
tgacgctggtggcgaaagtggcgtgggatggtcgggagatggagctgcacgttgtctcgtggggaggaagaggcagctcgtcgtcttgccagaagcccctcgcggattttctttttcttgtttttttggtttactaaaggatgtggaaggacctcgttgtaaaagaagctttaggaaggatctagaagatatttcgccattttgagcgatccgacggcttccatcatttgaacgaagaatcggacggctgatgttttcttaacgatgtggcgcagtcatatctaaaaaaaatctaactgtataggggtaaatatggaaaaggcagcaccggtgcccgaaataaaaatcggagaaaaactcacgcccccattccctcccctctcccctctccgccctagagctcgacggcggcggcaacaagggctgggggatgaagatatccgtgaagacactcaagggatccaccttccagatcgaggtggactccgcgcagaaggtatgctctggtctccgcgctctcgatctgtcggtcgcgagcgccgatttcgtttctttctttttctttttcttttgtggggggcgatctaggaggtggtgaccggattggggttaggtttgtttctacggctacgcaaggctatagctgtggatccaatctgattgtgtgattcgtgttactatatgtgattgatttctttgatggttggataactggattggttattataggtagtagtagtagtagtagaacagattaagttaaccagattgagtcatagttgtttcattctacgtgctatttataactgatctaatttcttaaagcaggttgctgatgtgaaaaggataatcgagactactcaaggacagcacatttacccagctgagcaacagatgctcattcatcaggggaaggtgctcaaggatgacaccacattggatgaaaacaaagttcttgaaaacagcttccttgttataatgcttagacaggtgggtacagcacctgtttgatgttatatggctattacctggcgcaaaatcatgaatatcatacttatcgtacaataatccatggaatgtcaaggtattcaactgcatgatcactatgcattttaagcatttgttcagggtatctgcagctctcagaatgtagtgagctatgttatgtattggaattgctttaaaagatgtagggcttcat

SEQ ID NO: 39545 - DNA, 12735 bp, Oryza sativa
tagcgagtaacgtggcatattcaccatagatgtcctcgacatttacttctcctttgctctatgtcacgcccggaaattcactagtaatttccgaacttatttgtgcataaaatcctcgtccaggaatcagccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaatcttaatcaacactgaacagcacacccatgctgctcaggcccaaccatcctgaacaaccattcccggctgtacagatctaactccaaaccaggagctaagcaaatcattaccagttataaccatcaataattattgtgagaggtgtgagactaatcatgaaaaacattgctcaactcgcccataaccgcgggcacggctattcgaatagattaaactctggccagaggtgtaccactgtacccacaagacacaaccccacatcatgtcaccatgtgcctcagtaccaccacggtacctcggaaaggagttgtgacaataccccttgcacaacataacccattacagcgcacctttcctggatcataatcactcccttataaaacaaggcatggactccccagcgacccccgtggacttctcgccagttctcagtctggcgcactataatgaatcacgctatacaaaagataaagccgttgcccatgctggcttgtggttggcacggtaaatgtttcacaacagtagctcgcgaaccggtccttaattgccatgagcacgaccttcaaaaccatatgctcacaacccaccattaatcatattttaattaccaattaattatcataacacgattaaccatcgtgagctaccattaaatataaccatgaataataatgtagtatatatgattcatcccattagtgagctaatgtttctaagcattgctaagcaattatatatataacatttagctgaaccaaaccaatacataaggttcaagctaatcaatttattacccaaggtatcaaggaatagggcattcaatgcaaattggccttaacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcgcgaaccttcgcaacgacggaaacaacaagctaacacgcaaaacgaagtaaaagactaataaaaaccaaataaacaatacatataaagtaaacaaacacgtagatcataattttagatgaattatgagacttgaacagcctcattctgacttcaaatgaatttattatgagttttacaagattaaatctaattaaagcccatttaaaaagaattaaataaatttaattcaatttatggacaattttaatatgtatatctttattttatacaacttttgcaacttgaaccacattaaactgagttacgatgatttagttatgattttcagaagatttaatctattaggaaaaaaaaaaagaaaggatgatgacgtcagcatgacgtcacccaaggcagccacaggtcggccgactcggacggcgacctcgccggagctagggaccttggccgggtgattggaggacacctacgcgtagaggacgacgaggcgaacccaacggtactcaccacaacgtctaccgatgaccgacgacggccggcgacgaagaggacggtggcggcggttcgggttgacggcgacggcggagctccggtggtcggcggcgaagagggacaggcggccgaggttctcctcaccacggtgcacctaacggcggcggcggcaagcggcggcgacggcgcaaacggcggcgcgacgcggctgaagacggccggcggcggcggcgggctaaaaggcggcggcgcggcggctaggaggcacgggagaccacgggagagggggcaaacgaaagagggcgacgaggtggtcctatatatagcattggattgaagagatcggactccaaacgagagaaatcgatccaagaaaatcaaaactcggttttggagataaactcgaaaacgagtttgattcggataggatactcaacggattgctccgtttcttgaggggaaagatagaggagaacgagaggatcaaaacccctcaatcaatcggacacgaggagaccggattggggtggatttggaggcggaaggcggctcggtcgggctcggcatggcagccggccggaggttgaagagaggtccgacatgtgggccccacatgtcggcggctggaggaggagagggcgggcggctcggctgggccggcttgggccgcgcgggagagagagagagttgggccgaattcggcccaacggcttaggaaggggttttttgaactttcttcaattaaaataatttgtgaaatgttgtttcatttattaaaaatacttcccttgctcaaataattcccagaaaattctagaaaatagaggaacaagcaaagtatttaataaaattttatctagctcaattttatattgagatttagcaaattaaaattagatcttctcttttaagcttttaaaattatttctaataattccttttaaacaacaatttataatttaaggattttaaacaagaaaaactcttaacaattataattagatcattattgatcaaataattactgaaatgttctttgtatcatttaggaattgagctccgaaaaatccgagaaaattccagagagtataattaatcatggagaatttaataaaaattaaatccatccatgctttaaatttaggaaattttatttcccacaattaacttcacttgcaaattattgaacatttcatataaattctattaataatttattaaataatttataaatcctaagacgaaaatcagggtgtgacactctatacgctctaaggctgcctttttggcatccggagaaaaaaatccctcgttcgccgcgcgcacgcttctcgaactgctaaacggtgtgtttttcgcaagacaattcgatacaaaagttggttaaaaaatcctactaatccatttttaaggtataaaataattaacactcaactaatcatacgctgatgactcacccttttttgcgtatattctcttttcccctcctcacaaacacaccgtaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgtgttataagccattaacatcttgcgtacatataaatttcatatcggggttgtggaagtccagatttggatcctgcaggctcagtcaggacaagagatagcatgcactgcggaccgaacacttggcacacatgcatgcaaccaatcaattttggaccatgaagctctcttggcctttggttatcatggtacatgtttccctatttaaagccccgatgatccctacaaactcacacagcaaatccgcacgctgtagcaacatcttccaacattgaaagatccctgtccagttcattagcaatggccaaagccgtcgccctactccttgcagccatcgcggcatcggccgtgttagtgcaagtggaatgcgacgcccccgtcgagaagagcttcaacaaggccctcctcgcccctgtcgataagcgcttggatgaggcagctcaggccatcaacgaggccgccgactccgttgtggctgctgccccaccagcaaaaaaggatgaagttgaagctgccacgtggaagcggagaatcttcgccataactgctctcgggatggcccaaggagatgagaagaaagttgctgcaacttcacttgcctacaagaaagcagctaaagctgtcctcgatgccgccccagctgacaagtttaagttgatggatgaatccttcaaagtggctgttatgcaggtaatcgcatcatgagccacacgccaaccatcaataaaggtctactactacatcgccgacattggtagacgaccggacacgtaccgagtatcaacggttatttatgtaataaatgtcgtgcaatcactcattccattctctccatttgtaagagcacaaggtggaaaaaaaataatccggtgccatctaacatttctagttcaaaatgtcgatccttggcacttggcggaactttttttttccatgaaatcctttgaatgattctttaaataaaagtatggagtaaaaatatcttttgtaagaaataacataaaccggaccagcttgcgtgcatcaacgcttcgatatatgcacacatataagactgttgttgggcgactgttatttgccgagattccatgtaaaataaccataggacttgtgacgagatctttcggtttgcccaaaacctccatgttaaatatcccgcttcctaggcatcttgcatttagataggttgcaaagcgccttgaatcaatagcacaactgcgctagcctccttgtttcagccgctggacctattcaaagagttagccaaaaaaatatttatgtacgtagctccctattcggcgtgcccttcagtaaaacgggcatgaatttttcatccgaattctttttaggacttacgacaacccgccatgtctttttttccgccataagtaccatatgagcggctaaaactagaacaagagcatcatacccggcgccgtccaattgcaaagcacttcctatctccaatacgactgcttcatcgtaacccttagcgagtaacgtggcatattcaccatagatgtccacgacatttacttctcgtttgctctatacgctctaaggctgcctttttggcatccggagaaaaaaatccctcgttcgctgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaaaccctaaaagaagtcttctttcccccccttcctctcttgggccggctcggcccaactctccctccctctctctcctctcctccgcggcccatcggcctcccccgcgcgcgcgcgccgctgacaggcgggcccgcccgccactctcgctgacgggtgggacccacctgtcatcgccttcctcccgccgcgcccgccgccgcgcccgtgccctagcgccgccgccgccgcggattccgccgcatcccgccttccccgcgcgccttaatgagaggggaatcattccccgcgattccctctcccgatcccccctcttttccctctctctctccctcggattcgttcgaaatcgcgcccgcaatcgtcgccggcgtcttcaatggagccgagatccccgcggccgtttcctccctctccggccgcgttctccccctctcggtgctatataattgctccccgagctccgctcttccgtttccgccgctcgccgctcgctctcgccgtcggattcgtgctcgcgccgtgctcctctctctccttcgtcgccgccgagctccgattccgccgccgccgtcgctccgcacttcctccttactcggcgtcaccaccatcggcttcgccgcgttgtcgccgaccccgtccgccccttcgcttcgcccgccgaccgccggagcaccgtcgccctcgccgtcccgaaccgcgccgccgcgtttctccactccggccgtcgtttccgccgtcctcgttgtcccggggtgagccgtggaccgtcccttccgttccccctcctctccgctctctcgggcgctgctccgccgcgccgatggtcgccggcggtgaccatcggggcgcgggcgcgccgctcccgtcggccgtgccggcgaggccgccttcgggcgcgccctcgcggctgccaggtggggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctcccggctgacgcaataaatgagttttttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtgaaagccttttcttttccgttggtcgtgtagacgctgcagcttcggaagatccgctcttcgtggaagttgaagccgacgtttgggaaatcgagcaaggcaagtcacatcatctttgaacatattgaatcccagtttgtaaaattatgttgatttaaattattgcattatcgctttatttaaattcccgcgttatcactgttttatttagccatgcctatttacccttgttatgaccttattattattgttattgttattattaccttgttcaccctagaataaacaaaacctcaactagtggacactctactcatggcaccactagtttaattttaggtagatgcttcgcaatttaattaggtaacattaggtggtttttcaactttagactttgggaaatattcatatcacctggatactttggaatggtctggttattgtggaaatgggattcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatggattggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattctttaaacctgcttatcaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctagaatcgtctttacaaaatagctttgagcaactaaatatctttaaatgctgtttactgcaaccctaaccctttatagtataactccttgtactcccttgcatttattctgcacttgtgggtgtgtcttgttgagtacggtggttgtactcagtcttgctcaatttttcccaaccccagaagaggagttccttgaagatgaaggcttcggtgtctagctcgtgcctgccgtcaagcgcctgtggtcgtcgccctagtcttccgctgtttctcgtttgtctctgtgtgtgctgggccttcgttgcccatgtaataagttaactatatacgcttccgcttgttaaactctgaattgtatcaacttttggtgtaccttgcctcctgggacaaggattaatgcacgcacgtcaggaacgcccgttgggttatttccggtcatgacaagttggtatcagagccacccttgaccctaggacgagccgtagatcccaagccttagctatattttcaaaaataaaaatcctttgttatttgtgaaaactgtctagtctctccctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatgtgcgtggtcttggggtatccacatggagtggactaccaggcccggccgcttccggagcaggagggtgacgatgcagagccccacgctggttgggaggtcactgcagtgatcctctctggctctcccgagcggacttcgctggcagtcaccgcgggtggagattctttccccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcatacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagaggactgccgccccaagcgtcgctgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttggagtcgtgtggggcatggttatgccggtttgtggtataactatgtcggagcctgtctttattttgtttgcctaagcaacttgaactttaatgaaccaatttaatcgcagtaataaattcaagaattatggtagtcgtgggtggttagctttaattgttagctctctctgtttgctggttctgtgtggggttttcagatggtgacgaccaggagaaatgctaataccggtgatggcaaccaacctgaaggcagcaaccacaaccaccaaggcaacccacctccacctcctcctccgcctccacctccaccaccagataccaacgccattctcacccaaatcctcgcccagcaagccaacatgatgactgctttcctccaccacctccaaaatccgccacaacataatgctcccccaccacctccccaacactctaaactcgccgagttcctccgcatccgtccacccaccttctctagctccaacaaccctgtggatgcgttggattggttgcatgccgtggggaagaagctagacacggtgcggtgcagtgatgaggagaaagtcgtcttcgccgcccaccagctgcagggacccgcatctctatggtgggaccacttccaggctacgcagcccgaggggcaaccgattacttgggcccgcttcaccgccgctttccggagaacccatgtgcccgctggagtcgtggctcttaagaaaagagaattccgagagttgaagcaaggcaaccgctccgtgatggagtatttgcacgagttcaacaacttggcccgttatgctccggaggatgtgcgggaagatgaggagaagcaagagaagttcttggcaggaatggaccccgaactgtctgttcgtctagtctctggggactatcctgatttccaacgtctggtggacaagagcatccgcttggaggccaagcacaaggagctggagtcgcacaagcgccgcttggcgaacttccgcaatcagcagggtgctaaccagagggtccgctacaccaatccctacccagggggaacctcctcgcagcagcagcagcagcagcaacctcgcccagcgccccgacctcaattcgtggtgcgcgtcccacagccgcagcagcagcagaatcagcaagggactcgtgcgccccgtcctcctacgccaactgtgcagcccgttcaaggccgcagggacgctcaaggtccgcagcggctgtgcttcaactgcttcgagcccggacactttgcggataaatgtccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccccgctacaattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgattcttgggatgaattggttggctcaattccaaggagtagtggattgcgcgcggcgcactgtcactctgtaccgagggccagaacaaccggttgttttctttgcacctccaacctctgtcagaagttcagaactgcatcagataggtctgtcagaaatccccatagtcagagagttcggagacgtgtttccggaagaactacccggaatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtatcctcttccccggatcgatgacctgttcgatcagcttaaaggtgccactgtattctccaagatcgatcttcgttccggatatcaccaattacgtattcgtgaagaagatattccgaagaccgcattcaccacgcgatacggactgtatgaattcacggtgatgtcgttcggtttaaccaatgcacctgccttcttcatgaacttaatgaacaaagtgttcatggaatacttggacaagtttgttgtggttttcattgatgacattctgatatactcacaatcagaggaagaccatcagcaccatctctgtcacatcctgatttttgtttcaggatttataaattatttaataaattaataatagaatttatattaagtgttctttaatttacaagtgaagtaaaatgtgggaaataaaatttcctaaatataaagcatggatggatttaatttttattaaattctccacgattaagtcaactctctgaaatattctcggatttttcagagctcaattcttaaatgatacaaagaacagttcagtaattatttgatcattaataatctaattatttttgttaagagcttttcttgtttaaaaatccttaaattataaattgttgtttaaaagtaattattagaaatgattttaaaagtctagaagagaagatctaattttaatttgttaaatctcaacataaaattgggctagataaaattttgttaaatactttgcttaattctataattcctagatttttctgggatttatttgagctaaggaagtatttttaataaatggaattgcatttaagaaataatttaaattgaaaaaggttttaaaagttctcttctggctttgggccgaaagtcggcccaaaacctctcttctctctcttcccggcccaagtcagcccagtccgccgcgcgcgcgcgccttcgctcgctgacaggtggggcccgtctgtcagacccgtcgtcctcctcgcgccgccgccgccgcccaaaccctagcgcaagccgccgccgtctccttccaaatccggccgcgcctttccttctccggccaaatcgattgag

SEQ ID NO: 39546 - DNA, 846 bp, Oryza sativa
gaccatttccaggctacgcagccagcggggcaacctattacttgggctcgcttcaccgccgctttccggagaacccatgtgcccgccggagtcgtggctcttaagaagagggagttccgagagttgaagcaaggcaaccgctccgtgatggagtatttgcatgagttcaacaaccttgcccgttacgccccggaggatgtgcgggaagatgaggagaagcaagagaagttcttggcgggaatggaccctgagctgtccgtttgtctagtctccagggactacccggacttccaacgtctggtggacaagagcatccgcttggaagccaagcacaaggagctggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacacacaaggtcagcagcgttgtcacgtcctgataaattcatcccgaaataaaagtcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattgagaagaaataaacaaagttgaaaaggttt

SEQ ID NO: 39547 - DNA, 2614 bp, Oryza sativa
aagtatctattcctgtcttccacaaattaagctcagtcttatacagtcctttgtcttacaaatacctcactatgtcacacatgtttttctgaagctatatgtaccagtatttccatgctcttccagaaactaattgcaactctgaaagttaataccgtggtagtggctggttgcagcaaactagaaccttaacttgctttaaaagattttcttttttccttttaggagagtattggagtacttccttgtcatgatcaactgatgcaaagtatgttgttatctaacaatgtatgcactgtagtcttgtcatgctctgattgcctggaggacctcctcatatttgaatatgccattgaagtgtgcatattttccaagtttagtatgttatgccccatatttctcttttttgtcatgctgcatagatagaatatcgcacacccatcttatgtggaaataatggacttattggtggcataaacttcatttgatcaatttttcttactttatgtaattgttttcaactttagagggcgtaaggatgcgaaagggagacgacccggaaaccccaactatgatcctagaactctttccttgccttcccagttcttgaatagcttgacaggcggacaggtattagttccttgttaattatacatctcacttctactctggacttgcatctcttgctaactcttagaatggatttaatagaggcaatggtgggaatttaaatcacagcacatggataaagttctgttcttcaaggtacaactatattttgtaacagttgtggaatactaaagttaaggctaccttgtttagtaaatattctatgaatttgaaatagatgggcaaattctatgaattatttgaaatggatgcacatgttggggcaaaggagcttgatcttcagtatatgaaggtagtaaattctcttctgcttattcagtatactgctgtcactgcacaatccagcttttgttttaattcttatggcataacggttagtatttactcattttggatcatatcatgttagggtgacaagcctcactgtggattcccggagaagaattttgaattgaatttggagaaattagctaagaaggtcagatcatgtttgatatgattttattcttccatggaaaataattacatttttaataagctaacagagttggttgcatcacagggttatcgagttctggttatcgagcagactgaaacaccggagcagcttgacctccgccgtaaagaaactggtgtaaaagacaaggtttattttaagtctcatggtctcaccagtgctacctctttttgttccaatatgcaaatacattgtcattacagaactatgacatcgatttaaatctggaactttttagttatattcagtttacatatgattattcttttcgggaaacatgagtaatgttgttcttgtggttggtgtgctttactttgaaggttgtgaggcgtgaaatatgtgcaatggtcacaaaaggaacattgacagaaggggagtctctgctggcaaatccagatccatcatatctattttctgtggctgaaagttatcagtgtggttcagagaaggatcaagatggtcatacaattggtgtttgcatagttgatgtttcaacaagcaaatttattgtagtacaggttagtgactctaggagactagggttcattttcatttgcattaagtggataaatttcttgaaatcgatgctattgattgggtacccttgtgtcaatgtacacttgttgctttcagttccaagatgatgctgaacgccatgggctatgttctattttatctgagattaggcctgcagaaatcataaaaccagctaaaatgttgagtccagaaactgagaaagcactgaagagcaatacgagagaccctttaataaacaatttgcttccatccatggagttctgggatgcagagaaaactattcatgaaataaagcaatactattgctcattggacacacctggtgccggtgcacaaatcagttctgcctatctgcctgagctattgagtgagctaattgaagcgggagacaaaacatatgcactttctgctcttggtggttctttgttttatttaaggcaatcccttctggatgagaaattgcttccatgtgctgagtttgagcgccttacatgctcagggctcaccaaccctatccgcaagcatatgatacttgatgcggcagcattggaaaatctggaaattttagaaaatgcaagaaatggtggtctctcagggtatttcctgctttgctctgttagttttctctagaaactatattcttatctcattatctcaagatactcttgctttcttgcaggacattgtatgcgcagttaaatcattgtgttactggatttggaaaaaggttgcttaaaaggtggattgcaaggccattgtatgaacgccaggcaatactacagcgtcaaagtgccatcgctactttcaaggtttctgtttgtggaaagaaatttcctacaaataaaattttcttttgttatttggaaaggagtctttaaaatgccttttgcaaaattgcacaaataaatcaaaaatcagacctgtacatga

SEQ ID NO: 39548 - DNA, 2002 bp, Oryza sativa
tctgtgaatatctacatggacgggaacttcacgaaatatcttcatctggttattttattttaatgaaatgcttctataatatggaagtaataaagcactgcttctgtcaaaataaaataaagcattatattttgcttgtgttccttcaatgtgatcacaatgacttctttttctttcttttgtgcgattaaattgtttccacaattttggattttgtcaagcatgatattatctgatatctttcagtatgttatattagtttgaattttactcttggcatttacttgttatggtcaaggcatcaagtgctattttacacatacctccatgtacttggcagtggttctttatcttattgcttaggaaacgtcacatgatgatgctaagtaacttgaatgaaacactcccatcacaacgtgaatcttattttttagccttggggacaatcactgtttaatgacctttgtgaagtacaatgtgtctattcacagttggataatatcaattaaactgtaaaatcattcatgttgaaaacagaatttatgaaattactcgctgtatatacaaagtatcagtcttctgtacataacgtttattttgtgtaccccatgtttatcatgcaactgctcgtttttatttatagggatctgggcatgaatgtgctatccaattccgtaaggatctgtctcggcttccagacatggagcgcctacttgcacgccttttttctagctggtaatttagtattatatgatatgcttaataattagttgaaatatctcaatgtaataagctggatttatgtgccttttggtttgatcattcattgcaatcttactttttctactctctctctcggtgtcttactttttctactctccgtgtcattctagcaattttcaaacaaaatatgtagctatggttaattaccaagctacccctattaattacagcagtactaatactcctttgagttgaaggtgtggattacaatgagtggtgtagatgcattgatgaggggtagagagggaagatttagccaaaaaatgctttggaatgtgagattgacagtattttgacataaagaaaaaaactagaaagacaagtaatttgaaacagagggagcacttaaactctgcaatctgctagctcattgtttaatctgaatgcttaaggctacaacttatttgcagtgataagaatggaagaagttcaaagtcagttgttctttatgaagatgcatcaaagagactgcttcatcagtttactgctgctcttcgtggttgccagcagatgttccaagcatgctcttctattagtatgttgacaagcacagatggatcttctctattaaatgatttgttatcactaggtatgagctgagtaactgaattctctcactagtttctcagtgcacccatatgtgactcttttgatcttcaatatcatttccgttggtctggttgcttattacattgtttcaattacatttattgtgtaatgtgaggttgcatgtgttaactgtttacaggcaaagggctaccacatgtttcttctattctggaccacttcagagatgcatttgattggtcagaagcagacaggaatggtcggatcatacctcatgaaggttgtgatcctcaatatgatgctgcttgcattgcaattgaggagattgaatccagtcttcaaaaatacctgaaggaacaaagaaagctattgagtgattcatcggtagtgcatgtcatgcttttcaaagtttccatagtttaatactcattggcaatttttaataactagtgagcaacggtgcaggtaaaatatgtagatgttggaaaggatacgtacctccttgaagtgtctgagaacctgcgaggttctgttccccataactatgagttgcagtctacaaaaaaggtaatgaaaaggtgttttcctgtacttgtgcctagcctttcagcctgtccattttttttggttatttattttctttagttggatg

SEQ ID NO: 39549 - DNA, 715 bp, Oryza sativa
gtttgtagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctctggctctcccgagcggacttcgctggcagtcaccgcgggtggagattccttccccgccgcttgccagaacgccgctctcctcgccatcggcaccctccaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcagtggaggcgcagctgcaccagctcaagatcgcccagggagagatctgccgccccaagcgtcgccgcgtctgccgcagccagaagatcaccgccgtaagagcacctccaggcctgagcttgttcgtcagtccctggcgtggacttgcttcgtcgagacccctcgtgcc

SEQ ID NO: 39550 - DNA, 2792 bp, Oryza sativa
agccctgccgtccctatagaaattcaggggataccttttccctcggatctgattctgctagacaccaagaacttggatgtgatccttgggatgaattggttggctcaattccaaggggtagtggattgcgcgaggcgcactgtcactctgtaccgagggccggaacaaccggttgttttctttgcacccccaacctctgtcagaagttcagaactgcatcagatagggctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgaactagccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatctccgttccggatatcaccaattacgtattcgtgaagaagatattccgaagaccgcattcactacgcgatatggactgtatgaattcacggtgatgtcgttcggcttgaccaatgctcctgccttcttcatgaacttgatgaacaaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacggtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgtttcaaactctcaaggaaaagctggtttcctcgccagtgttaatcttgccgaatactcgcaaggacttcatggtgtattgtgacgcttcgcgccaaggattggggtgcgtgctcatgcaggacggtcatgtggtagcctatgcttcacgtcagctacgacctcatgaaggcaactaccctacgcatgacttggagttagcagcggtggttcatgctctaaaaatctggcggcactatctcattgggaatcgctgtgaaatctataccgaccataagagcttgaaatacatcttcacccagtcggatctgaatcttcggcaaaggagatggttagaactcatcaaggattatgatgtgggaatacactatcatcctggtaaggccaacgtggttgccgacgctctaagtcggaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaaccttatggaacggaaagcgggtatgcgttccagatagcagagaacttaaacagctgatacttcaggaagctcacgaaagcccttattccattcacccgggcagtacaaagatgtatttagacttgaaggagaaatactggtgggttagcatgaagcgggaaattgcagagtttgtggccctatgtgatgtgtgccagcgtgtcaaggcagagcaccaacgaccggccggacttctccaatctctccaagtaccagaatggaaatgggatgaaattgggatggatttctcaccggacttccaaaaacccaaggcagatatgattctatatgggtagttgtggatcgattaaccaaggtagctcgatttattcctgtgaagaccacctatggagggaacaaactagccgagctctacttcgccaggatcgtgagtctccatggcgttcccaagaaaatcgtatctgataggggaagccaattcacctctcatttctggaagaaactccaagaagagttgggaacccgattaaatttcagcaccgcgtatcacccgcagacagatgggcagaccgagcgtctaaatcagatcctagaagatatgcttcgcgcatgtgtcctagatttcgggaagacctgggataagagtctcccctatgccgagttctcctacaataacagttatcaagccagcatacaaatggcaccttataaagcgttgtacgggcgcaaatgccggacaccactattgtgggaccaagttggagaaagccaagtgttcgggactgatatcctgagagaagctgaagctaaagtcagaaccattcgggataatctaaaggggcacagtctcggcagaaaagttatgcagataaccgacgccggatctggaattcgcagtggatgactttgtgtatcttcgggtcacgccattgcgaggtgtgcacaggtttcagacaaaagggaagctcgcacctcggtatgtggg

SEQ ID NO: 39551 - DNA, 1280 bp, Oryza sativa
taaatgttacagtaacagaaatcttgagaagattgtccaaataattcttacgactcatgctgcagagttaagcctttactgctatcaaagttctgagcaaactgtaataatcatttagttggttttcacattatcatcaaaagaacctcaccgaacatcatcatactagtatcacttatacatgcaaaacgtgtgctgcgaaattttaaccagaagatactaatatatatatttgggatataacaaacctgtggaatgatatttttctccatggcgtccttgaaaagaggtggaggtggtaggtcaaggccaagcatcaaaaatgggaccctagatgtttcagtaacaatatctgaacctgcatcaccattctgttcatcgccgtcctctttcttttccacaatatgcttcttgtgaaattccttaactacttcaagttctccctaacaaaaacaatgctgtaagaagttgcacgcaattttattaatcaaattgttggtatagacaaaaactatacctgaaagcaatcatgtatgatgcttctgtttctcttcctactttttagtttcgagtgcattgtgttcaagagccatgacataaattccactggatcagactgaacaccaatctggaacctcttatcactggccttcataactgcttgcagaaactcatgtggactaacctgcacaaaaagcaacatgttaacttttgagtatttgtggaggtagaggaacagcacaaatatgctggcatgcagctatctcactaaaaaaccaacctggcccttgaagttccttgcatgccagattttgcgagttagttctccaaatcgatgaaccaatggggatttgctatgccgataattttcagggatgagaaagaaatttcttaaaggagtaattctcattaatgactgtattgtgacattcacaaaatctgtctccttgatgttgtttagaccaacctgcaaatttaagcatagagaagtgactactgccataggataataatggtcaaagcagagagaattgcaaatattgaggtgcaataggaaatctgcaatgtttttaagttgtgacatggtgatggtcatataacaccattataataataacttaatatagaatgaaataacctggctaaaaaaagctcatgaccaagttggctgcttctattcaagtccacaattttttaggctttcactgtcattgtgatttttttccagaagatgctttttcatttttgtaatttctccagatagaccaactaaacaaaac

SEQ ID NO: 39552 - DNA, 2730 bp, Oryza sativa
  unsure (1)..(2730): unsure at all n locations
gttttatgcatgtgacttcaagcctcttccttggtaatactttccacaaaccaaacatgcatacacgttcaagtttgataaggagattgagcagaacttctcaaaatcaaaatcaaggacctacaatgtagacaaaatatatacaacaatcaatgaacatgtgaaatagcccatcaatgatacagtccagcacacattctgccagaagagtgtaaaacatatatagaatatagcgtggaagtgattccatagattttaattgtacaaacaatcacatcacactggccatctaaaacagaaggatagatttaaagatcctacaagagcttacaattgtttagtttaaagctattttaaggatctattttagaaaaaagccaaccacagctcacaagatactgtttagtttaattaaagcttttatgtaccggccagtgagaacgaggaaataaagggatacacaagttgaacggataagaacttgaagggaaaagcctacagttctttttaaaattgcagcaaacataagaggctttctgatatgtcctaagggaccgtgtctcagttaagaaacagtccatagtggaatggaccagcgttcaacccaatacacccataaacccaatagccaccagagcaaggaagaactaaacataattatttgataaatatgttccgttcagttattatagtaatgtacacagtagagtagcagtagaacagtgctctcgaacaaaaaaaaaaaaaagataaagtaccaagacagacatatgacaaaaaaataatatattacttcaaatgaacaggctcacatgttgcacactacaacaaaaataaaatcaattggaattcactatgaagatataataacaccatgaacattaagtttccctttagcatctgtatatgttgttcagctctattaaatcaaacatacacacaaaaaaaggaacttctatcacaataccagcaattgataatcaaaatactaggcgtaaatggtggatcccaagtaaattggagatcgtgaacataatgaaaaactatatttcatcgaggttattcacatcaatcgaatcacacagaatgtctaaaaaattggcacctgaaacgctgctgctgctaaaagccatacctggcggttcacggtgtcgaggtaagggcagtcccggcgcagctccacttgcctcggcctccgctccggagccctcctcacgtcgttgtcaacctcgtcgtcgtcgtcgtcctcctcctcctcttcctcgtgtcggccattcgcgcggcgcctccccgcagcagccgccgcctcctcgtcctcctcgtcctcctcgtagttggcgagccccagcagcgccccgccctccggatcctccccgcgcgcgcgcttctgggcggcctccccgtcgatgacctcctcctcctcctcctcctcctcgtcgcggccgcgcttccgcgccggggatgagagatcgtccgcggccatcgtcgtcgtgcgccggaaccctagctagctagctagctagcccctgcgcggggaagccgggaaatgacggcgagcgaagggcggagctgcgcccgcgcggcgagattctagggtttggggaaggaggagaggtgggcgaggatggagcgacggttaggccgtgaggatcgccgtgccgtgcgtgtggacggagacggggtttgggcccggatggggatgtcggttcttctttgtgggtttcgtcgggccaggccggtatgccaggttcgtcgcacaaagtttaacggcctttgatgtttctaggaaaaggcgaaacaaattcgaaggacttcaatcgtatgaaaataattcctatagaattgttcattctgataagggattttagagagatagttagccaaaggtcctttgagcctatatctcttgtccgattgcagcgttttctgggatccaatcaaatggttatttatacgttctttttttattttgtgatcatccgttttacacttgtatgaatgagatgaatcctacgttttcctatttactacatttttacattctttcgattcaaaggggccatatctatgctttgataattatttgaactttgttctcctgacatttttgcttcatgaaaaggttaatactgttaatttaagcactaaaccaaaataattttttcaattcatatactacaagtaaaataagttgatgataaaaaaaaacttgcaatgatagagccagcatcatcgttgaacccggacaattaatagtgtttcatggcggtcgaccaaactttatacttattaaccacaatcagtaatggaggcggctgtggcgaagcttgggcaatcgccccgacctacccaggagctgcccctaccactacaaacttgtttcggatttgtcctgcaatagcttctttctctaaaacataagacattgaaatgtatcttccttcgctactccaaggtagcaactatcatgaacaaatttcaatcggtgctaaaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39553 - DNA, 730 bp, Oryza sativa
gacgatcctgagcgttggatttacacagagatgatctataccgttccacgaggaatgaaagaatgagtgaaacaacttatttaagtatagggtaggtagatagaagatagatggagaggcagcgtgcgaaatcttacctccattaatcttcttgttagtggagtgggcgcacgtgctggctgagcagggcccaggtggcttccgcggcccagaagccgcgtggcccgtcagtggagccggcccgatgcggagagaatccgagtcgtccgaatgatggacggctcagattgttcctgttctggtaaaagtcgccgacggggaaggggtaaacctaatcctcctcttctccggcgagccagaggggcgagagcggcggcggggtcgtaggcggcggtgtgtggcgatccggcgaagggaatctcgcacggcggcgcggctgctgagggggaacaccctaatccccttctctccccgacccctctcccggcgacgcgagtgagtggctggcggcaagcgccgagcggctccagcttcactggctggggggcgcacccgaagacggcgccaagccatcggcggtccggcaaagcaccgagccgacgggggagggggggaggtgccaaaagtggcagcccaagccgatgcttcccgtctccggtgaggcggcgacggtggggaagctccaagacggcgcgagcggtggtgaaccggcgcgaccccgaggacgccg

SEQ ID NO: 39554 - DNA, 1481 bp, Oryza sativa
attcctgtgaagaccacctatggggggaataaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagattctagaagatatgcttcgcgcatgtgtcctagacttcgggaagacttgggataagagtctcccctatgccgagttctcctacaataacagctatcaagccagcatacaaatggcaccctatgaagcgttgtatgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtacacaggtttcagacaaaggggaagctcgcacctcggtatgtgggtcccttccgtatcattgctcggcgcggagaagtcgcttaccagctggagctgcccgcctccttgggcaacgtgcatgatgtgttccatgtgtcgcaactcaagaaatgtcttcgagtgccatcagagcaggctgactcagagcaaattgaagttcgcgaagacttgacctacgtggagaggccagtgaaaatcctggacaccatggagcgcaggaccaggaaccgagtaatccgttttgcaaggtccagtggagcaaccacgccgaagaagaagccacttgggagcgtgaagacgagctgaaggcagcccatcccggtctcttcgctagttcttccgaatctcggggtcgagattccgtttaaggggggtaggtttgtcgcgtcccaaatcgactctaaaatctatcctcgaaattgtgcaaagaataagtaaaaattcatgtgaaagcccccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggtttataaaaagaaaaatcctaaaagaagttctctttcccccccctcccctcttgggccggctcggcccattccctccctctctctctctctctccctcccggcccatcggctccccgcgcgcgcgcgcgccgctgacaggcgggcccgcccgccgctctcgctgacgggtgggacccacctgtcatctccctcctcgcgccgcgtccgccgccgcgcccgtgccctagcgccgccgccgccgcggattgcgccgcatcccg

SEQ ID NO: 39555 - DNA, 1749 bp, Oryza sativa
acaaaacctcaactagtggacactctactcatggcaccactagtttaattttaggtagatgcttcgctatttaattagataacattaggcggttttacaactctagactttgggatattctcatcacctggacactctggaattgttggattattgtggaattggattcaccccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggtgttccggccgtaggcaggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagtcagtgttttaattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttataattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgctgggccttcgctgcccatgtaataattttatatacgcttccgcttgttaaactctgaattgtatcaacttttggtgtaccttgcctcctgggacaaggaataatacacgcacgtcagggtcgcctgttgggtgatttccggtcgtgacatctcgtcacaagtcctatggttattttatatggaatctcggcaaataacagccgcccaacaacagtcttatatgtgtgcatatatcgaagcgttgatgcacgcaagctggtccggtttatgttatttcttacataagatatttttactccatacttttgtttaaagaatcattcaaaggatttcatggaaaaaaaaagttccgccaagtgccaaggatcgacattttgaactagaaatgttagatggcaccggattattttttttccacctggtgctcttacaaatggagagaatggaatgagtagaattgattgcacgacatttattacataaataaccgttgatactcggtacgtgtccggtcgtctaccaatgtcggcggtgtagtagtagacctttat

SEQ ID NO: 39556 - DNA, 1883 bp, Oryza sativa
ctcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccatcgcagcgcaccattcctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctatcattaaatataaccataagtgatagtgaaacattagttatcccaattgtgtgctaatgtttctaagcatggctaagcaattatatctaatatctagttgaaccaatatataaagctcaactagtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttacacaacttttgcaacttgaaccacattaaactgatttaagatgaattagttatgaatttttaaagattaaatcggattaaaacctttatatggattttaattaaattatgacgcaataatgaattatttttgaaaaggaaaagaaggattattgcgtcagcggctagggtttgcggtggaccgggtgcatggcggcggttcacgcgaacggacggccgagatcaaccctatccaaaacggacggccgagatcgatcggtccacgcccggctcacgggagagggcgacgatgacgtcagcgacgacgtcagcaccggcggcggctcggcggctcggacggctcggacggcgcatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggcggcggagaagatcgggtcgacggcggcgacggtgctccggcggtcttcggcggcggcgaagcggtggacggggacggcggcgaccttgcgaacccgatggtggcgacggcgactgacgacggcggctgcaacggcggcgcggcgcggctgaaccgacggcaacgacggcggcgactagggctacgcggaggcggcgctagagacgacggcgggctaaggcaaaggtggcggcgggtagaagagacactgggggtccttataaaggggctagcgagcggcgacggaggcccacggctgc

SEQ ID NO: 39557 - DNA, 1849 bp, Oryza sativa
aagtgggcccggccgtcagccgcccgcgcccgcgggtgcggctgacgcgcgggacccacggcgtcgaccgccgccagccgcgtgcgcccggtccaccgtggaccgtggggctgacgcgtgggccccactccccgtggacccggtccgcgcgtcccctccctcggctgacgcaataatccgtttttttttaattaaaatttaaatgaagaaattcgcaaatattcatttaaagagcatataaacttcaaatggccatatcttggccatttgaactcggaattggaccgttcaagtccctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagttgaagccgtcgtttgggaaagcgagcaaggcaagacacatcatcttgatcatattgaatcccagtttgtaaaattatgttgatttaaattattgcattatcgctttatttaaattcccgcgttatcactgttttatttagccatgcctatttacctttgttatgaccatattattattgttattgttagtattattaccttgttcaccctagattaaacaaaacctcaactagtggacactctactcgtggtatccctagtttaaatttaggtagatgcttcgcaatttaatcaggtaacattaggtggttttataaccttagacttgggaaattctcatatcacctggacactatggaattgttggagtattgtggaattggcttcaccccgccccctctattcaaaatcccctaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctggaacccaggtcgggttgccagttcggtccaaatcatcgtaggccttgggttaaggcaggttcgtgagggttcacggccttgtttaataatactgtgtagctctaagatcgtctttacaaaatggctttgggcaactaagtgacttttaaatgctgtttactgcaaaacctaacccctattattatccccttgtactcccttgcattaatcatgcattctccggtgtgtcttgctgagtactgtggttgtactcattcttgctcaatccttcccctcttcagtaagagaagctttggagaagaagtcttaggtggagtcctggcttataccccagttgagcgcctgtgcagatggagccgtaggcccgctagtccgctgctgtttatt

SEQ ID NO: 39558 - DNA, 873 bp, Oryza sativa
taggcttgtgccagatgttctattgcttacgacattgttgacaatgtatgccaagtgtggggtgatggagactgcaagggagatcttcaattcaatgggtgaaaagagtgtcccctcgtggaattcaatgatcatcgggtatgggttgcatgggcaaagcgaaaaggctcttgagttgttcttggagatggagagagatggacctaggccaaatgaaacgactttcatctgtgtcttgagctcatgtgctcatggtggtttggtgcttgaaggttggtggtgttttgacaggatggtcaggttctacagtattgagccaaagtctgagcattttggctgtatgatggaccttcttggtcgcgccggactgcttgaacaatcagagaatctcattgagaatttgcaaggtaaggtgtcagaagcattgtggggcatactaatgtcagcctctcaaactcagaacaacatcaaacttggagagtttgtcggaaagaaattgatcgagatgaggccaacagaagtcggtccatacatccttctatcaaacatttatgcggcagaaggaagatgggatgatgttgagaaagtaaggaaggtgatggaggagaagggggtggagaaggatgcagggttgagcctggtaggatcaagggaaggtggtcatttcattaatgaaagtggagcttcagctccaaggaatgatgtgatgctgtgcatgctgggtgagatgagtgtgcatatgaagcaaccatctgaagggtccaactgcaggaaaagaagcccctctgctccttgaaacttgaacatacagggcacattattttgctgtgtgactgtcaaaggagaacacaaagatgggatgtttatgcctca

SEQ ID NO: 39559 - DNA, 1431 bp, Oryza sativa
aatattggcaccagtttctagtgttagtatagatctacaaacaagactataatagattagcaacaactcaaattagtcggcacaaatttgcatcaagtagattaaagccgcatcaactaccacagctaaccgcaacacggctaaccgcgagcagaagccaacgctgcaacagcgagagaactaactccaattcttttcggcttattcaccgaaatattaaaacaaaacaaattatttgctctatgcttcagaaaaatatatttttcacacaaaaaaaactttatactggtgtgttgtttggatcactgattttattttaagctatttgtttagtttatttcttaaaatacttaatctatcactataatcaattagataatctacaacaataattcattcgcttgtggtagaatcagtccacctagtttaaattctagacttgacatgggtgtttatttttacggctaattattttttttaaaggtaagtcggtctagtctttcaagtgtgctcataaggatagggtatttgtaggggtgctcattcttaggatagggtgtaattgtgtgcatttgtatggatgctcattctttcggatacgtccgtccagtttttttagaggtgctcataagaatacaatgtacttatgtgcatttgtaaggtgagtatgtacgttatggatgcctacatttatactgtttttctaaataataataataataataataattcgctcaataatctaaagcaaattgggctggttcagctcgctcaataatctaaagcaaattattagcagtgttcacagaagactatattcacgcaagccgggctgctcaggatgttgcagcaaaagccagaacccagaagctctattactagcacagtgttcacagaagactatattgaaattgcattttacatatcataattcagaggtttgtgcccaagatataagagtctacttctgagatcctgctgggactataagaatttatgctactgtggttcgaacatgagttgcaaaatttgcaatcctatgctcataagcagctactgttctatattaggcactatgcaaaaacaatgtcaatttccaaaatgatgcgagcctaacaccaatagtttgttagcatccagtatgttgttcatccatcgaaagcattgcctgttgcaggatcaatgccaattcgaaaataaaatcagtcatcatctgaaatatcaattatgccagaagtaatggttggatcatcagttaaaccgggtggatctgctgactgaagtggaaccatatcatgagcagcgtcgaaaggaacgatcgccaagtatggagctggtgactgggactggcatccgggggattgatttaccacctgctcagaaggggtgctaacaacaatctccaagcatggagctgcagcttttgcttga

SEQ ID NO: 39560 - DNA, 894 bp, Oryza sativa
taccgacccatttttacctacggccgggatacccgggacaggcaggtagaactgagcccctagcattgggcaccaaccctccgccgtatgacatctcgactaccgggccgcagctcgtgtagccttcatttgccctggagaatgtccatcgaagcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccaccataatccaacaattccatagtgtccaaatgagatgagaattcccaaagtctaaaattataaaaccacctaatgttgcctaattaaattgcgaagcatctacctaaagtcaaactagggataccatgagtagagtgtccactagttgaggttttgtttgtctagggtgaacaaggtaataataataacaatgacaataataatatggtcataacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttctta

SEQ ID NO: 39561 - DNA, 2741 bp, Oryza sativa
agtgttgaaaagaaaatctaagtttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaaaggttttaaaagttctcttttggctttgggccgaaagtcggcccaaaactctctctctctctcccccggcccaagtcggcccagtccgcagccgagccgcccgcgcgcgcgtgcgttcggtcgctgacaggtgggtcccacctgtcaggcccgtcgtcttcctcgggccgaaaccctagcgcgccgccgccgagccgccgccgccgttcctttccaaattcggccgttcctttccttctccggccgaattgataggggggaaatgatcgccgggatctcctctaccttttctcctttggaatcatcggctaaaacgttttggaagctcgtggaatcgagttcgattcggatcggtttctttctctccaagcccgaggtttccttcgccgtcgccggtcgccgtgggccttcgtcgccgcctccgagcccctttaaaaggacccccggagtctcctctacccgtcgccaccttcgcctttgcctctcgtcgccggaagagctctagcgccgtgtgccctagctttgccgtcgtcgccgccgctccagccgtgcgccgccgccgttccagacgtcgccgtcgctcgggaaggacgtcatcgtggtcgccgtcgcgtcgccgtcctcgttcgccccttcgccgtcgccggagatcaccggagcagcgtcgccgtcgacaacccgaaggtttccgccgcttccttctcgtcgctgttgtcgtccgttgttcgtccgccgccgttttggtcaccggtgtgttcgccgcgtcgtcctatacgtgctggtgctcttcgttagcgtcctcgcgccgccgttcgtcggcgagcgtgcgccgcccaagccgtccgctccgccgagccgccgccgctgtcggtgacgtcaccgctgacgtcatcagggtcgtccgccgtgagccgccgtggacccgatcgatctcggccgtccgtttggattggatcgaatctcggccgtccgttcgcgtgaaccgccgcccgtgcgcccggtccaccgaaaccctagcccgctgacgcaataaatccctttttccttttcaaaaataattcattattgcgtcataattcaatttaaaccgatataagtgtttttaatccgatttaatctttaaaaattcataactaattcatcttagctccgatttagttggttcaagtctctaaatttttctaaaattgagatctacacattaaaaatatccacacgtactgttcatgcttgtttatgtgttgttttggtaattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattatttcttttcaactattgcatttattttcgaatgtcattgggtggaaataacctattgtttgttatagcccttttgttcttgtttaccttattccttgataccttgggttataataatttgactggttgaactttatttatattggttcaactagatattaggtataattgcttagccctgcttagaaacattagctcacttttgggataacttatgattcactattatttcatgatggcttattgatagttcacgatggtcaatcgtggttagttaattaattaatgtgccaactaaagcctgataatggtgggttgtgagcacatggttttgctggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagctcacgggggtcgctggggagtccatgccttgtttataagggggtgattatgatccaggaaggtgcgctgcaatggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacccttctcaccataatagaagatgctataactggtaataatttgattagctcctggtttggaatggtatattcctggtttggagatagaactgtgcagccgggatggttgttcagaatggatgggcctatacaacagggtatgttgtatagtgttggattaatattgtttaaatacttaactgttttaaattctcaaatgtttgctaaatgctgcttttgcaaatggagccctattatgccatcctttgttaccctgtgcacttgcatatttgctgcgtggcttgctgagtatgtcatatactcaccttgcaatcattcatcagaggaagagttcttcaatgaggctgatggtgtggaggagtaggtgtagccttggtcaagctgcctgtggagtggagccgtctgcgcc

SEQ ID NO: 39562 - DNA, 1279 bp, Oryza sativa
atataccaggagtatttctgcgtcattgctgggaattatatttctagtaatgtcgttaagaaatactaacaggcggggtgtctcagcatcccgtactgttgacgttcttctgcgtgccatcgcatcaatcttgcatgctctttgttgctgaacaaacgtctgagccatggtattatagggcaaataccacattaccttagcaggaattctcttcctcgaaggctgtccgtcaacaccacctggatcgtctcttctaatcttgtatcgtagtgtattacagaccgggcatgcttctaggttctcatactcctcaccacgatagaggatacaatcgttcgaacatgcgtgaatcttttgaacctcaagtcctagagggcagactatcttctttgcttcgtatgttgtttcgggcaatttgttttcctccggaagaatgttcttcactagtttcaatagctcgccaaatgccttgtcattgacaccatttttgtccttccattgcaacaattccagagttgtacccaattttttgtgcccctattcatagcctgggtacaacggcgtcttgtgatccgctaacatacactctaatttctgagcctccttttcactttcgcagtcctccttgatgtcttgcagcatctgaccaagatcatcgtcaacgtcaatatcttcaacagccccttccacctcgcacgttgtatctccttcaaatccatcgtactgagcccagtccggaatgttctcgtcttctacttcatcttcttccatttgaaccccttgctccccgtgcgaggtccaaacattatagctcggcataaagcccgtctcaaacaagtgaatatgaatagttctaactgcagaatactctctctagtatttgcaattagtgcatggacaacggataaaaccattattctgcttgttagcttctgccactttcagaaaattatgcaagccatcaataaactcttttgaccgtcggtctgcccgcatccattgccaatccatctacataaaaagcacaaaaatcatgaaaaaataatccacgaaattcaaaccaattaaacaatattaacaatagttatatatattattataaaataataccacaaattattcatgttttcattccacataaaaattgtaaataaatatttattttgttgtacttattttaatttaaattaacttactgcactattcttttacaataattttctatcattttctttctcatctttttatcacaagtttttttcttccaaattctaaataa

SEQ ID NO: 39563 - DNA, 2638 bp, Oryza sativa
aaaaaagataaaaaacttgccaaggacatgtgcgctgcatcggattttctgagaaattataaagtactttttcaagttttcacctaagatcatctacctgttaattataagccataacaaaatttaaatttcaaaagttgattttgaagtttttttttattgtgatcattttctatcatcggttttagaaccataaacaatagatataagcacttttaaaagataatttttcacgcttattttttcttgcttaatatgtcaaattgacacgttataaaaaaaaatatggttcaaaacttcaaatcatgtccattgttttgtttaaacactagataaggctaaaaatatatgttgtgtccatttcctcatatggacctataatcccacatgtcggtagggtggtggcagaaccaccaccatcaccattactatagatgtgctacatggtatagttaaaagaaacaataatcatttaaaagtgcatataaaaaacattttaatttatgaattcgcactctatgaaacatgttttaaaaaaatgaagcatatattttatcttatttgattaatgtaattacctttttttaacaagcgtatattatatcatatattataaatgtacgtcttttataggattttttaagggaattgaacttattctttataaaagatatacacagtaatttcttttgatccaaatatactttatgtagtatgcaccaggtaaaaatagcgagcgcgccttctagttttgtttagtccgtgaataatatcccaccctaaatatctactcctatattcctagagaggtactccagcgaccagcctgtaagcctgccacgcagctgctagtacctctaatgttgcactgttcatagttttagtacaaagtagtactactcctacatgcttttactcaaccatcggttttgccctctccacagatgcagactctttgactgttgcataactccatactccataaaaggggtccaccatcggttggaccaatcattagtgatacaagcggaccaatcattagtgataagaggcaaactgttggtttgtagcttgggccatttgtcagtgagatataaaatactgcaatgcatgttactgggtgtttgcattttgtaaaagagccattctcttccttttaagtagtgtaataatatgttggtcttataaacattgagatttgtttacctgtaaattaggggatctgccaatgaggtatttgggctttccaattgataaagaaatacttctgaacaaagattggaagaagcctgaggaaacaattgaaaaaaaaagttggttgctggcaaggaaatcttcagtcaattggagggagggtgagtttaattaatgcttgtcttagtaatactcctttgtacatgttatccttctttagggtgcctattggggttagagagaacggatctttataggaggttcttatggcaggatgatcagggtattaggaagtatcatttggttaattggaatacggtttgttctcccagggagacagggcgtttgggcattttggacttagaaatcatgaacattgctttgctggggaaatggctctggaaccttgaaaattctgaaggtttatggcagcagatgtatcagacaaaagtatttatccaaaaacattttggctgctgcaaaaacaaaatctggggcctcccatttttggcaaggggtgatggaggttagaaaaagtttcttcaatttttgttccaagagaccaggaaatggagataacatccttttttgggaagataactggttaggaggaaaacctttggcagaacaatttcctttttttgtatagagtaactcagaaccaattcattactttggcaaaagttaaaaaaaaaagggtggggttgcatgactttcagaagaaatgtgattggagatgcacttgctgactggaacaaagttaagtcttcttgtgatgagataactctgaacaatcaaagagatgtgacagtttggactctggcaaagaaatggaatgtttagtgttaaatccttttatagagctctaaagttgcaggggactgtttccatgattgggagttcacacaaattttttttttggaaaattaaagtccccttgaagtgaggatttttctgtggttgctgcttaaagagaatgttttaacaaaagataatttgataaaaaggggttggaggaagggtaatgatctgtgtcagttttgtgaacagaaagaaacaattcaacatttattttttgactgtcctctggtgagattcacctggactgttgtgatttgtgcttttggtatgaaccagattaaagacatgagacatatgttaagttcctggattcaaccttgtgacaaattacaaaacaactaatgctagttggtgtggcagctgtactttgggccacttggaaagcaagaaatggcttgttttgatcaaaggcctgtgcactgaggtctagctggctttcgtttgtctttgtttcttttgtgagcacctaggggttctatccttctggttctaagactctgtttttgtaagaacttctgcgtttctttaatgaaaattggagggttctgccctttgctcaaaaaaaaaaaaacattgagatttg

SEQ ID NO: 39564 - DNA, 1996 bp, Oryza sativa
ttcctgcagccctgccagtttcacacaaaataacaaaaaatagtgggacccacgtgggacccacatgtcatccttacatgtctcttctctctatctccccactgcactgcagtctgcaaggagaaggcgggagtggcggtgcgcgaaaccaacgccgaagcggcagaaatctgccgccgacaccgatctccacagcggaggtgtgcatcctcctcaaacccgtcaccatcagcggtggtggggaagggggggggggggagcaagtggggaaccaggagctcgccctccgccacccatggcgaggtcgccgtcgaggtcggagggtggcgcagaggacggtggaaccgggggcgggggccgcggtggtgaggtgcgcgccctcctcctcgaacccgtcgccgtcgccgtcgtcttcgatgacggagacgacggcgggagaggaagcaaagggagccgggcggaaaggacacgcgagcggcggcaagccggagagcaacaggcgattgtggtggcgcttatcccacgcttgtcccatagccctcgctcgttgcacgagttcctctcgcagatgcggtacacggcaaggacaaggagatcgacgacgcgcgtcagagtccgttagatcagattcgcacgaggccattgatccatcctttgctttgctccttgtgcgttgcttagcagtaacacagggcaagcggaaaacgtagtactactatcctaaggtggctcgcaaggctttggagactgaggaagagctgggcaacggccgagcgcgacctctgcgccaccgccccgccagctttgcgcgccatcgctccggccttctccttgcagactacagtgcaggggggagagaaatgagatagagagaagagagaggagtaaggatgacatgtggagcccacatgggtctgaccatttttttttattattttgtgtgtgaaactgacatctgggttccacgggttttatttttttaatcaaatttccacgtccatgccccgtgggacaaagacctagtcaaaggagcgcgccacgtcagccaaaaccaggcacaatactgccgagggatctcgtttgcacggttttataagttgaaggatgtgttgtactcggttttgtactcagcgacaaatttcggactcggcgacaaattgagagacctaagatgaacttattccctctcacttctctctttttctctatgtgtggccggactgccggaggcacggcgaggcggagggtgcgcgaccgctcgccgctagggtttggggcaagttgggcgatagggatgaggaggaaggaggaagggatgagggagtgattctcaggttgcttgtttcttcaccgattctcaggtatgggtcgtttgtgggattggatcccttgctggtatgatgagataattgaaatgtttcagtttgtggagagtttgtggtagttgtatgtcctcaattagtcttagatgtacaaaagaaaaaatattctaatttctagattgtgcaagtttaagcaatatctcgtgcaacttcacttatttagttgtaagttttttgggactaaaaatttgatgttctttgtcacgctatcagcatgaaaggcggtagcccggccaacttagatttaaggttttgatcttatctttgcattttcgctgttgattaatgttttatgtaaaaactccaatccatgtcttgtggggagtgtgggctaattgaaaccatgggaacatgccttttcttcctttttttttttggacttttaagtctgtgtgaattagtctgtactctgtgaagttgtgcacggttttgaaacctatcagtctgaactttaagcgctctgtatctctaacacagtccagtgcttttgaaatctctgtgtgcgtgcactttttttgttatgctatgagatgaatacaaagttgttttgacggggataaagttgtgtttggtagactgtacatatactagcaatttttactgggaatgaacac

SEQ ID NO: 39565 - DNA, 2742 bp, Oryza sativa
agatcgaaaagacaggggaagacggatcctgaaagcttcacattgaaaaggttagatcgcatttgatcgaaatgccagggggcgatcaaatgacaactctagtggtgcgaatcctgtgtttggtcgctccgtgcaagaaattgcactgtaaccgctggaagaaatgctctgcatgcaccttattaaaagaaaaaaaaatatatcagtttttgcctctgtagtttgccacctgtgtcaggtagtaccactccaatatgtgcacttaccaacaatagtttctcaaatgctcagtgacaaaaaggaaaggaatgatatacgacaatcaatctccaaaagtactatcataaagttatcaatatttttaaacttattctaatataaaattggttttcggaatttctaaagttcaaccgagtctattaaacgtcgtattgaccagagggagtagcaatctgtgataaacaagaggaacagaaaaattaaattgtctgtcaggcttggccttctgtgtgttctttttggtacaaacaccatgaaaaaaaattaggtggataggacgttaaagtgattatctgattccaatttttgtggatgggacatcaggtggataggacactgttctatgatcagattcaccatctagagttttaggcaattgtgccttgtgaatgattatcggttccaattctttcagacctctggcttcatcagttccaattgaggcagttctgttcgacattgatgggaccttgtgcgactcagatcctcttcatcatgtggccttccaagaaatgcttcttgaggtatggaattcttatacttcttgttttccattaacttttgtagaaagctaattgagaagatgtctttttacagattgggtataacaacggtgtgccaatagacgaggagtttttcataaacaatattgctggaaggagtgatgttgaagctgctcagaatttgttccctgattggccccttgagaaggggctgaaattcctcgaggacaaggaagctaaatacagaaggtacactgcagttaatgacaacatctattgtgtctagtttcagtatactccacagttgtattaagggtgttttcttttgggtggtgagaaacggtaactaccaaccgttgttaacattactgaatcagtatattttcccagactgaatatttataatttttaacttttgcagtttggcaaaggagcgtttggaacctgtaaagggccttgctaaagtggttcagtgggtcaaagatcatggatacaagcgtgcggctgtaaccaatgcccccaggattaattccgagctcatgatctcccttcttggcctcacagatttcttccaggccgtcatcgttggaggcgaatgtgagaagccgaaacccgccccattcccctacctgaaggctctcaaggagcttcaggtgtctgcggaccacaccttcatctttgaggtaaaccacttcttcttcatttgcatctgttgcaaacttgtcatctggttttatttgcagttgaaaaatgtgtgcttttgttgcaggattctgcttcaggcacacgtgcaggcgttgctgctggaattcctgttgttgctgtggcaacaaggaacccagagaagtccctactggatgcaggagccacgttgatcatcaaggattatgaagaccccaagctttggagcgcacttgaagagatagacagagaggaagccaagctaaagaaagctgatgcatgagatgagggttctcgattagatgatatattgcaggtttagctccttttgcatttgcagtaatattgtagccgaagtgatggcgcacagagctcatctttgcacttttgagcttctgtggttttattattctttgttgctactcagcctattgagttggtacagagaaataaagacccaaaactcccattgagttattctttatggatggatgttacttctgagaagtttcaggggtgatcttgttcatcctgccaaaactattgcatttgcttggcttcttgttatctttatccaatggttaagttaaaaaaaaaagaagaagacatatttaaccaatacaggagctacaaaaggacgaaacttgcagacagattaaagtcaagaaaagacagaaatatatgaacatttctccactttaaaagggaggaatgcaggagcaaaaatataaatgagctgacaagaaccagtaatttccagtaaaatttgcacggttgatgtaccaaacattgcagccatctaccatgtagttacaaagtgggaaaatactggcagagctcagtttacaattaccaaacattgcaaccatctaccaagcatttcttccctcttatagtcatgcactcggtcagtagtcactacatagctaaacacccacctggtgatcatccttggggctgcagtagagagtgcggagaaatgttgcaaggaacatttacatgggcaatccatgtatccagacccagttcttcacttcttcatttgaacttggaaaaaaaaacagtagcagcagattcaagaaccttgaagattcctcaatgagtgcattaagcccacaacacagcactctcaaaatgaagccaatccagaaaaaaaggtcaccaaggtggcaaaaatggggcagccctcgattaaattgatgggcaaagcaattgcttattctccaatgacctgcaccttagcacgcttctgcacttcatggagcatgcctaaacttga

SEQ ID NO: 39566 - DNA, 746 bp, Oryza sativa
cgcaaaagagttgattttccacccatatttgggccagtaagaacaataaagctggcatttccaggcccacccatcttaatgtcattgggtacaaaagatccactgcctaaagaatcacttcggagggtggggtgccctaaatttcttgcatggagagtaggagtatcatctggaccatatgattctttgataattggacagcaagttggtccctcaaaaaaatcactggcaatagcaagactaatcaaaacatcaagctctgcatgttaaaaccaaaggtagcatttagagacccactaatataatgcatgtgaatgtgggccattgataagaacttttaactatgcatcacattacaagtcacagttatctactaatcttactcctcaagaaccaatcaaataatcaatacaatcatgtgtaaactattgtaaacatcactattgctattttcatactcatcatgttatcagttgaattacaaagtaatcttttttgtactaagcatgtccttagaaattgatatcatcattgctacctagcagctagtttttgttttcaaatacagtaccagcatcttcaatatctcttttcaaataagatggcagatcagagtaaagtgaaaaggataggtagcagtcagacaacagagaattagaagagtggcacagagtactgctcatctaagttaaaactacaattggttacagaaataaaataacattagatgaaggggctgcaggaat

SEQ ID NO: 39567 - DNA, 1810 bp, Oryza sativa
cagatttcaccaaggccaaactgaataagtcttctattaggttttgcccattgaaagccaggaggttttacaacataacagtggatgtttctggatattaaattcaaacaactaagtaactgaccattatggttccataattcaaatcaacactgccagttgtatttgagcagcacagagttcaacgtatttgggagaacggacatgtgaagcaacaacaacttatcaatctcatagcaggagcagagctatacattcagcccaaatactggagtagcaagcaggaggaaagatcgggtgaactcacatggagtcggcctcgagcaccttgatgaaagctttaccacggtcggctcggacggctgggtgtcctcacctgcatccatgctgccattgctctgggatgtgccatagagctttgaagctggctttcttggagctttgaagctggctttctgaagggagacgaggagaggagtaggaggaggaagcggcggcaacgtggggctaggggtggaggaaagggacgaggaggtgcaggcggcgcgacggtaccggtggggactaggaggaagaggcggtggcggggggctggaggtggagggcagggacgaggaggaggaagcggcgccagtggcggggtctaggaagaggtgatagtggagagcaggcgacggcacggcggggaagaggtggcagtgggcaggcggcggcggcggtgacgacgaggagatgaggcgcgagggcgattcggcttcgggagcggatgcggcgcgagcgtgacaactgacaaggagaagacgacacaaaggggaatcgcgatttcatcgtagggacgtggaaggacctctctgcaaaaaggagtttctcagagtatcacgaggaggttacaccaagtgaaggatcgaacggctcatgttgtctcgaggggaaatcggacggtccatatattttagatgacgtggcccaaccagattgcaagaaactttagttctttcaatactttagatatgtttatagctggcttatagcctgctattgtacctgctctaacatcttcttctgctgctcctctctctcttcctttatctcttttaaatatgtttatagctggcttatagcctgctattgtacctgctctaacatcttctcatcttcgatctgttcaggtgtggatcgtgtctaaacaaaacaattttatttgacctacgctggtccgtccattgacatattaactccgccgtcgccctcccggcctaagaggcaaggtagaaaatacgatgaggtggaagtcactgatatatggcttatagcctgctattgtacctgctctaacatcttctcatcttcgatctgttcaggtgtgggtcgtgtctaaacaaaacaattttatttgacctacactggtccgtccattgacatattaactccgccgtcgccctcccggcctaagaggcaaggtagaaaatacgatgaggtggaagtcactgatatatgggtcccacttgctagctctaaggaagaagatgctggctcagtgagtcaaaccgaaccgaaagagttgacttgcaccggttttctaaaatttttttagacttttaaattaggaacagcttagctctcaaataatccaatctggaattcacttctatggagatttgaactcaggaccttgggtgctactcaggtcactgcaaccactaggctacatgttctttcacaactgattttttaaaatggtggtgttataccggttttgcgatgagagagactattcaatcagcctcaagagatgagggaggagaaatag

SEQ ID NO: 39568 - DNA, 4739 bp, Oryza sativa
tcattatttccttgagttatttaatttatttctagttgaattgaaccttgtaactatcattagttgaatatcccttgtaactaccattagttgaatatagtggcttatccgtagttttgctccataggtgtggatagatctggtgtggagggtggtttgccgggttgccgtcgagtttaaaaggcaaatacatgatgaactaattgtgttattcatggatggtttgctttatctatttattaccgatatatttctatgtgataagtgattgcttacgttcaaattattgttcatgctatttaggtttcgagttcatcttatgtttacgatgttattcttattttaatattctatgcttgacatggatgtgcaatatgattttcaatttagttctttgttttcggttttaattattcatgttccatgtgagtcatggatgtgctatctgattttctattcatgtccctgtgggtaagcgccgatcacgtttactcggctttgccagaatgtattcactattgtctggaatagaaactaatatttcaattcatgcctatccaagatgggaactactatttttcttagcatgcgcccagcctccatccccctcctgtgagtgaaaagaaacagagacacagcaaaggaaaaagggaatagaaagacgtaagacagacagagcagagaaggatcgagagtaacagaaagaaaatagaaataaaggaaaaggaaaagaaaaataggactattcctacctgtgcgccatcttccctctaaaaagtctattcgatctcctctacttccatgttcaagcccagacattaatccttctatagaagtctagctgacctctatttctttctaggccagagaaattaatttctcggtaaaagtctatcgaagttccctatattttctgaccaggcccaagacttcaatcctctgtacaatcctccatgtttagacaaagttcatatcaggtccctctactaccccttagggaaaagtctgtacttaccccaacaattttctcagcccaacccgaaggaccaattcccacgagtccgcacacgccaaccatcagtaaaggtctactgctacatcgccgacattggtagacgaccggacacgtaccgagtatcaacggttatttatgtaataaatgtcgtgcaatcaattctactcattccattctctccatttgtaagagcaccagggggaaaaaaataatccggtgccatctaacatttctagttcaaaatgtcgatccttggcacttggcggaacttttttttttccatgaaatcctttgaatgattctttaaacaaaagtatggagtaaaaatatcttatgtaagaaataacataaaccggaccagcttgcgtgcatcaacgcttcgatatatgcacacatataagactgttgttgggcggctgttatttgccgagattccatgtaaaataaccataggacttgtgacgagatctttcggtttgcccaaaacctccatgtcaaatatcccgcttcctaggcatcttgcatttagataggttgcaaaccgccttgaatcaaaagcacaactgcgctagcctccttgtttcagccgctggacctattcaaagagttagccaaagaaatatttatgtacgtagctccctattcggcgtgcccttcagtaaaacgggcatgaatttttcatccgaattctttctaggacttacgacaacccgccatgtctttttttccgccataagtaccatatgagcggctaaaactagaacaagagcatcatacccggcgccgtccaagtgcaaagcacttcctatctcaaatacgactgcttcgtcgtaacccttagcgagtaacgtggcatattcaccatcgatgtcctcgacatttacttctcctttgctatatacgctctaaggctgcgtttttggcatccggagaaaaaaaatccctcgttcgccgcgcgcacgcttctcgaactgctaaacggtgtgtttttcgcaagacaattcggtacaaaagttggttaaaaaatcctactaatcaatttttaaggtataaaataattaacactcaactaatcatacgctgatgactcacccttttttgcgtatattctcttttcccctcctcacaaacacaccgtaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgggttttctgcccttaacatcttgcgtacatataaatttcatatcggggttgtggaagtccagatttggatcttgcaggctcagtcaagacaaaggatagcatgcactacggaccgaacacttggcacacatgcatgcaaccaatcaattttggaccatgaagctctcttggccttaggttatcatggtacgtgtttccctatttaaagccccgatgatccctacaaactcacacagcaaatccgcgcgcagtagcaacatcttccaacattgaaagatccctgtccagttcattagcaatggccaaagccgtcgccctactccttgcagccatcgcggcatcggccgtgttagtgcaagtggaatgcgacgcccccgtcgagaagagcttcaacaaggccctcctcgcccctgtcgataagcgcttggatgaggcaactcaggccatcaacgaggccgccgactccgttgtggctgctgccccaccagcaaaaaaggatgaagttgaagctgccacgtggaagcggagaatgttcgcctttgctgctctcgggatggcccaaggagatgagaagaaagttgctgcaacttcacttgcctacaagaaagcagctaaagctgtcctcgatgccgccccagctgacaagtttaagttgatggatgaatccttcaaagtggctgctatggaggtaatcgcatcatgagccacacgccaaccttcaataaaggtctactgctacaccgccgacattggtagacgaccggacacgtaccgagtatcaacggttatttatgtaataaatgtcgtgcaatcaattctactcattccattctctccatttgtaagagcaccaggtggaaaaaaaataatccggtgccatctaacatttctagttcaaaatgtcgatccttggcacttggcggaacttttttttttccatgaaatcctttgaatgattctttaaacaaaagtatggagtaaaaatatcttatgtaagaaataacataaaccggaccagcttgcgtgcatcaacgcttcgatatatgcacacatataagactgttgttgggcggctgttatttgccgagattccatgtaaaataaccataggacttgtgacgagatctttcggtttgcccaaaacctccatgtcaaatatcccgcttcctaggcatcttgcatttagataggttgcaaaccgccttgaatcaatagcacaactgcgctagcctccttgtttcagccgctggacctattcaaagagttagccaaagaaatatttatgtacgtagctccctattcggcgtgcccttcagtaaaacgggcatgattttttcatccgaattctttttaggacttacgacaacccgccatgtctttttttccgccataagtaccatatgagcggctaaaactagaacaagagcatcatacccggcgctgtccaagtgcaaagcacttcctatctcaaatacgactgcttcgtcgtaacccttagcgagtaacgtggcatattcaccatagatgtccacgacatttacttctcgtttgctctatacgctctaaggctgcctttttggcatccggagaaaaaaatccctcgttcgccgcgcgcacgcttctcgaactgctaaacggtgtgtttttcgcaagacaattcaacacaaaagttggttaaaaaatcctactaatccatttttaaggtataaaataattaacactcaactaatcatacgctgatgactcacccttttttgcgtatattctcttttcccctcctcacaaacacaccctaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgtgttataagccattaacatcttgcgtacatataaatttcatatcggggttgtggaagtccagatttggatcctgcaggctcagtcaagacaagagatagcatgcactgcggaccgaacacttggcacacatgcatgcaaccaatcaattttggaccatgaagctctcttggcctttggttatcatggtacatgtttccctatttaaagccccgatgatccctacaaactcacacagcaaatccgcacgctgtagcaacatcttccaacattgaaagatccctgtccagttcattagcaatggccaaagccgtcgccctactccttgcagccatcgcggcatcgcccgtgt

SEQ ID NO: 39569 - DNA, 7150 bp, Oryza sativa
agccggaactaggtatgcactggcatgccgaggctcaccgccaccctagccgccatcgccaatgactccggccatctcatcccgccaagatcaccaccgatggcctgtcgccgtcgttccctcttacttttctcttttggctgccaagcctagttcgccgccgttccccgctggcaacggcgacaagttcaccggccgccctgcctctgctccctccagtacctcctcactgacatgcgggacccacatgattaggccctaagaactcacactagtaaatgcttaaaacttgtgaggttgtattgttaaatacctagagaatgacatgtggacccaaggacatgcatgtaaatagattaaagctcaagaactcttaataaagatacttttaacatgtgctaaggacttcggattatatttcttagaactctagggacttttctacaaaagatctctcactgaccagtgggccctatgtgtttaaaatctggaaaaatataaggaaaatgactagagtagatattttacaattgaaaacttgcccaaactagtaaaatacatataaaatccattttagctcatttttagatgaatcaaatttctgtgaactcatcaaattatgaactttaatttagaaacataaaacttggcacttacagtagaagaaatagctctaaaaattcatataagaaacaatgaacatagagcaccctccaacttataaaatttgtagaaaattcaccttaactgtttttaaatgaattaagttccagaatgttcacaaaatcatactctcatttgtcatgaactaaaacttagcactctctgtaataaaaatgtcaccaaatgtttatttaataaaatctataagtaattcattttaactccaaatgtgcaaaactaaaatttattagttttatagaggcatgtacattagtctgtaaataagtcttagaagaaaacatatctagaaacatcactaaaatttgaataatgagttaatattaaagaacggtttagaaatttctgaaattcgtatcaaaatgaatacaactccaaatgaggtgattcagttctgttagattggcaaaatcatgtacttagtttttataaaataaaatatggcacttacggtacccaaaacatatctaaaatttgaaataactaataactactatagcatatcacttagcttgaaaaatttataataaacatatcacttagcttgaaaaatttataataaaatcattttaactctaaaagttatgaaaccaattttgttgtacacctaagaacattaccttcactgcagcaagccaacaattcataaatcatggacctaaaatgcacctaaaggataatagagcttaattaatctagtgctagtattaaactttgaaaattaataactctcaaatgcaaaatgataaaataaaaattctttcacctaaattcatcttagaccagcactaaccacactagtaaactcatacattttagagcattttagatttttgcatgttttggcatttatcgttaccgttatttcttttagatggcaaaatcgttatcgatgaggggtccgacatgaactttatctgaacaaggaggatgataatgggctctgccgaaagatgaaggaccctaaatggacttgtacagagggttgaagtattgggcctggtcagaaaataggggaacttcgatagacttttactgagaaattaatttctctggcctagaaagaaaaggcaggtaagctagacttctatagaaggattaatgtctgggcttgaacagggaagtagagggggtcgaatatactttttagagggaagatggtgcacaggtaggaatagtcctatttttatttttcttttcctttactagcaaaatgcccgtgcttcgctacggtgtattgaactaaaaatatttgtttttaagcgaagttattttcccactgttttggtatttttttgctcgctagaaaaagtctcaaatgatagagagaaatatagtacctcataataaattattattcaatagtgcgttgcaacgggaaaaattaatattattaacttagtaaagtaataaaaaaagagcatccacgttagctcttatagtctagaaattctcatattaatattatttaattttagtctaaatttaaattctatatcatgacaaataaacaattacatttttagtcgaaaaataaatcaatatcttgagaaaactctagccaaatttttagttaattcagtttagttggaattaaattaataagcagtaataaataattaaaatggtactaatgctatttctgaaaatacaaagatgcttaaaattactgagagagaaaacactaattttatcccatcccaaacttacaggcccatttggaggcccaatagtgcggcggcccaatgtgagaggagccgaaggcgtccgatcgaatggacggtctagattgatcccaacctataaaaatatctgcagccaaaaccctaaccctaaatttcatttcctccctgcccccgatcccctctctctctctctcgatcgaaaagcgacgacggcgccccgaccccccacgagcgactgtggcggtgcccttcccccactctccacgagccgctgcggcggtggcctccccccaacgagcggctgccacggcgtcctccgccccgtctcacctccctcaccggtagccgctccctccggcccatctcgcctccctctccctctcgtctcctctcgcagtggcggcgggttggcggcggatttgaggatggtggtggcgtcgacggcaggtgtgggcagatctagcggcggcggctccctccgccccctctcaactccctctcgcggcaaatccggcggcggtggctggatccgtcggtggtggcggcaaccgtgggcggattcggctactatattttcctctatcatttgagactttttctagcaagcaaaagtaccaaatcagtgtacaaataacttcggttaaaaatatatatttttagttttaatacaccgtagcgaagcatggatattttgctagtaagataaaatgcacggtagatgaagagtcgatttggccaattaaaaacctacttattcatctgctttgctgcattgagatttgtgaagatagagctgatttctgtaatttcttacgtgggtccaacaggtgatgctagcggtgcacttcgtttttctgctgcacacgcgtccacccgagccgagagcccgagagagcggcgcctcgaattcctcgattcttccgccccgctcttatcctttccctttccttctccaatctccaccgcccgcttatttccttatctcttccgcacgcgctcctctcagccggcgacgccatccctctccctccaccaacgacgccgctccccctcctgcttccctcaccaatgacgccgctccccataccccttagccgccctttcccggcggccggcgccctatccttatctcctcgtttttcccgatcaatttctcttcctctcactctcggtctttctctcctccgctgctagtcctctcctcattgcgccttctttcctttccctctttttcttcttctctccacacttccacagtcgacgacaccctccatctccgtccctcccactccccccacggcggcgtcgctccctgtacccctcagccacggcgccctctccccagccgacggcgcccttcccctggtagcggcgccctacccttggcggccagtgcctccgccgctgcgccctgcccccggccggcggcgtctttcacccggcgagcagcggtgcgcaacgggccggggagcggcggcccgcgaccaactcctcggtgtcggcggctctctcctcccgcgagcggcaacgtgcgtcggcgcctctccgcccctcacctcctctcccttgccataatgccacgggagggctcgacggtggcgggcggtggcaggctgcggcgccggcccttccggcgggtagggaggcggtgggcaggggcggtgccctcccctccgccggatccagcgggagggaaggggcggcggccgggcatcccggatccagcgtgaggggaggggatgggaggagaggcggtggcgacccggcggacggcgtcccagcggcggcggcgccctcccctcgccggatccagcgggaggggagccagcggcggcccgacggcgacggcggcaccctccccttcctgtgtcggcattttttttgtttttttagggaaagtgtcggtattttcttgtgttcttgttgataaaaatctgttcaatctgttcttgtcttcttgtagtagtgttttttctaggatttgggtccaaatttgatgcgtactcggattaaggcgcacgggggtaggctgtgaaggccagtaccgaggttgccaccgtgacctttttctttcttcgttttttttttaccatcggataagggttgaagcgggatagatcgcacgcgcgcgtaggaaggattttttttgtgacggacgaaacggacgatcggaaaccttacgaattttttaagtaggtatagatttctattttctttctgttactctcgatccttctctgctctgtctctgtctctgtctcacttctttctctgcctttttcctttgctctgtctctgtttcttttcactcacaggagggggatggaggcttggcacatggtggcagtgggttgaggccggtcggctcagtagggaaggggagagaaaatccaccgggagaaataaaattgattcctaaaagaaggggctgattaataggtagttttaattatttgggtgatgtgtttcatacgcttggtgagcataacagggaagggaaatgggcaactaaatatcctaaaggctactgcacaatcaacgcaatcaatacaacgctgcctcatataatgaaaattcgtaacatgaagcggatcatgctcaatacatcgtctacagcatgcatctaaggtctttgatcggttagtatttgggttgactctattatattatctatctcttcattcttaatccttataggctgcataggattatttgaatattgaggtgagttgagatttgataaatacatttttcaaaaatacttgggatagggaagagcagtaagaatctatgcttttatcaaaataatttttcgcaaataattgtctaaagggtaatgggctatactaaaccaatcctagatcttaatggtggtcgcaagggtccttaggtcctgtagtcgtctagctcaagtaccatgtctgtagggacccccggttttatacaccggtaatcccatgtgttaggtagggaaaactccctggatcagtaggtggtacacgcatagcacataataacatcacaactgacatcgtttacaaatgtttctacaataataatataagggtaacctcattgggtcccgaaatagaccaagcatggtcacttacaatccaaaataccaaagcaatagataagagtggaagcgaagcagcggcggtccatcgaactccataagcaacaactggtgaacctatggtccctaatccatcatcttcaacacgtacttgacaacagcatggcataaatctaatcgacgccaactcctttctaaaagatttaattaagcaagggtgagtacatacgtactcagcaagtcaccactacaagatgaatttaatgcacacaggggtccaaggatggcttggtttatttgcataaagctagttttcacaattcatttcacaaacctattgacctagcagtttgaactgaaaaacatcgttattgttgaagttgtaattatccagggttcatccacctccccaagcctcgcttggctcagtttaccctcacatttcatcttataccaactccaccatatatataaaattatagggttcgttttaagtttatatctaggcctttacctttccaacactgcactcatcatcacattcatacaaaacctacccgacttaggtgccgccccacgagatcttcctaatccgccggtctatacccactaaagaaatgcggtcgtactctgttcgtttcctgtatagcttcctaagtcaatccttaactgaccagggtcggcgactaaccgtttccagacccacccatattctattcatgccgcctaagtcgaaatagttttgttgtattaagttttagttttcgcaaaaggtttgtgtgtggtgggtggcgctcatgtctcaacccgtaaatcatcaatcactcacatcgagtgatctcacatccatagtcatctagcataaatatggagtgtaagtatgtctacaatagcattaataagcattgtcaataattgaccacatataaataaatgactcaggtattcaaaggcatacaatatgtataaaggtaatcaatatcaagggcaggctacattcaattgtaggtacgcaatttataaatagcatgcgatttatttgtaagcaaaacatttagatcaatatgtttaaggtagggagcgtaatgacttgcctttttttttttgagagggcgtaatgacttgccttgctatcggtactaatggtcttcgaggtatccgcaacagttagacaattagaaaactccatatgcgatcagcaatagaaaaccatatagaatcctcctaatgcagtactgaatacctcaaactaattgtgccatttggtagatcaagatttgagatgaattccagaagttgaacgggtctaatcggagttacggtttgaatttccaaagtctaaaggtttataaaccgaggagggagtaccatcgggaagggaggtgatttagactttctgagaggactctgggttgcataaaggaggtagtgtggactctggtggatgtgggtggaggctatggtgggctctatctggttatttcacctatagactttcataaaggggacatcctcatgggttcggcctagggaagtataaggaacttgttcggagggatgaaggatctagtagaaggtacatgtaagtgactcctaataagtctaaaagttggtttaataagggattaaggatggctggcccacatgtcattgagctactataaaagggactaggaagatcgtcactatgcatgagggattgattaat

SEQ ID NO: 39570 - DNA, 1333 bp, Oryza sativa
cataaatttgcctcctgcgcgaggacttaaataagaaccactacacagaggtaccacctttgctagataacttaatcagctaggtctatgcccatacaagattgcggtcgtactcgtatgttcttcacatgtacttggcagtcttatatcggttggaacagtactagccacccggaaatcaaccatttctaccgtactgttccaatctaagttcattatattttatgcagtctaactaagcatggctaaacaaaatctagcatatatctggtttgctatatattcaggttatgcattcaaaatcatatatggctaatgcataagatactagagatatagaatataggattattatgctcaaaggggaggaataataacttgccttgctccaacgcaaataaatccaagatagacaacctgattatccgatcctcgaaataccacaggttgtcatccaaaatacaatagactctacttgaagaagagaaagaactaaattcaataaaagccatgaaatgtcaaaagaacaataaacggctagaagggctagggtttagggtataaatatctcctttataaggtatataggttatcgggcttatattagttatatgatttctaaagggtttgaggctaaggtgaagggaggatcaagcaactaatgttgcttatattttatgtgaaagctttgattggttggaaggatgggaagtagctagtttggatagttgtcttggttaggcgggtatgtggctagctaggatttggtggtggtaggttcaggtagtatcatatctagggtttggttatatgggagttaattgtggtgtaagacaatatatcggctaggttctatattttatgtatgggttctggtgggtgtagagtaggtggctgagagtatggtggataggcgatactggtgggtgtgggacttatcagacggttggaatttaactaacaaggtgtccgctagagtttggttgtatactagtcgatgctagagcataacgactagatttggtgtcttctatagccggtgtcagcagacagcatatcggctagagggaataggaggtgggtgcaggtttagtagggcggaagtgttactccgacaaccgtgagtggcggcggagcggctaggatcacacagagctcgagagctaactgtgcggcgtgctgtggaggtcgatgggatagtgaagctccgaccgctatacgcatcgaggcgtggggtgccaggagcagcacttcgaccttgggtttggtttatgccggactttacaaccaacggttcgacgtcggggatagaaaagcgcgaacgtccccatga

SEQ ID NO: 39571 - DNA, 705 bp, Oryza sativa
tgcacccctttccctctctctttacatcggattcgctcggatttattcccgcaaagctcgccggcgcatcaatggcggccggatcttccgcggccgattccccctcatccggccgacctttctcactcccgacgctatataaacgtttcccgtgcctccctcctccgtttccgccactcgccactctctctccccgtcggattcgagctcgcgccgtcgccctctctctccgccgtcgccgccgagctccggttcgccgccgtcgtcgccccggacctcctcccgcttcggcatcgcctccttcggcttcgccgcattctcgtcgacctcgtccacccctccgtttcgcccgccgaccgccggaacgccgccgtcctcgtcgacccgagccgcgccgccgtcttcctccgctccggtcgtcgtttccgccgccctcgtcgtcccggggtgagccgtggaccgcccctttcgcttcccccttccctcctctccctcgggtgccgctccgccgcgccgttggtcgccggcggcgaccatcggggcgcgggcgcgccgcatcccgtcggccgtgccggcgaggtcaccttcgggtgcgccccgcggctgccaggtgggcccggcccgtcagccgcccgcgcccgcgggtgcggctgacgcgtgggacccacggcgccggccggcgcacgccgcgtgcgcccggtccac

SEQ ID NO: 39572 - DNA, 711 bp, Oryza sativa
gccgtgctcgcagttatcgagcattgggactcacaatggcatcttggttagaaacataattccaaattttattaaataatgttgcattataaacatcatagactttctacttctacattttcagcctttctgcaagtaaacctagctctatacaaatattaccatttcatgcattcattattgattaatataatagcttgctgagtacgttgtactcacccttgcttcaaccccactttttcagagtctatttgatgttcttaccgaagctgggagttcaatcatacaagttagtctcattctaacttagttctcaagtatagattagatagatggtttaagtctatagccaaacattagagttaagtcattctatagcttttgctgtaatagttagccacaaccttgtaaatacccttatattttataaagaaatctcctttgaaaccttaatcaaatgtatgtaatgaagatatagattgttgaacctgtatcaatctaccgatccagggcttgatacagttaaacatgtcggtttccaaatcattagttctgggacccgacacgctgccgctaggccaccgccacacgccgccgtgccagcctcgccaccctcgctggtgtgtttggataatgggaaatgaagggtgggattgggattgggattgggaaatgaataaagggttacggttaaatggaagagaatgaatg

SEQ ID NO: 39573 - DNA, 15809 bp, Oryza sativa
ctacttattgttgctgcagaaacctgattaatatactggcggaggtatcccagtctggaaaacaaaggcatcatattccttatcgagattcgaaattaacctttcttttgcaagaatcacttggtggtaatgctaagctcgcaatgatttgtgcggtttcaccatcacagaagtactgtttgagactgacatgctattttcttttgccattcttgcttcttcatgtgcttataatttgttttttcttctgcagctgtaagagtgaaacactaagcactctaagatttgctcaccgtgcaaaagatataaaaaacaatgctgttgtcaatgaacaaagagaggatgatgtcaatgttctccgtgagcaaatcaggcagctgaaggtattattttaatttctttttggtaatcatgattttcaattaattggctctatcgttattgcaggaggagcttcaacacgtgagatcaaatgggagcttgccaggaagcaatggcagcccttccactgggtggaattctcaaaatagctttcttttgaaaatgagcttgagtcgtccaactgcattccccaccatcaaagatgatagtgatgaggagatggagattgatgacaatgatgttgaaaagccttgtaatttagaaaacaagtcttcatttcctcacggggatgttgaaacaagtagatgcaagtcaaacttggcagcaagcattcagaagggccttcaagtcattgaaagccatcggaatagtgttacttggaggagatcatcattaggtcttaacactagacttatggacgctcatctttcagttccagtttgcaaagttgatgtggctattcaaaccgaccccgaagaatctgaaccaagacaaaacactatggctctaattcctagcaatcagcctgaagcaactacagatggaaacagagaaatctctgattgcataaatctacagttagtaacagttgatggatcaataccctctaatgatctaaagcaacaggaacaagtctttaaagtaggttactaacttactatgcagatgtgtgcaccatttatctgcaatatcagcatgacaacttatgcaagggtttgttttattcctataggctgtggagaaggtccttgctggagccatcagacgagagatgttacgtgatgaacagtgtgcaaagcaagctgctgaaattcaacagctaaaacgtttggttggtgccttgcccatgctatcagattttaggatcttttattcgtcgatctgaagtgttttccttttgcaggtgcaacaatataagcatgaacgtgaatgcaatgctgcaattgcacaaatacgagaagaaaaaattgcaaggcttgaaacacttgtggatgggattttaccaactgaagaacttatgcatgcagagaatctctctctccaagacgaaaacaaggtcttctgcttttccatttattttctatgttgccaaatatctacttggttcttttgaactgagcaaagctatattcttaaacatgtctctgtatcaacaaaaacagattctccatcagaagtatgagaaccatcctgaagttttgagtgctaaaatcgagcttgaaagaatccaagaagaattggagaggtacagaaacttcaaggatgagaaggaagttttactggaggaaatccaacacctgaaaaatcagttgcattacatgctgtcatcatcaatggcattgtgtaggcctccagttgaacttgtccaggcaattagtactgtctcagatcgtccaaccatttcggctttggaagaagctggtgatgacggccacagcattgtcgatgctgctgagagtagatggattactcttacagaagagcttagagttgagcttgagaagagtaaatctctatctgaacgtttgcagcttgaagtggaatcagaaaagcaatgctcagaggaattaaagggggcattggaaatggcaatgcaggggcatgctagaattttagaacagtattgtgaattacaggaaaaacatgcatccttgctctcaatgtgtcgcaccatcaatgatgggattgaagatgtgaaaaaggaagctgcaaaagctggtgtgcgaggggctgaatctaagttcattaatgctcttgctaggcaagtatcaattttaagagctgagcgagagaaggagcgtcggttttggatggatgaaaataaaggccttcagcaacagctaagtgatactgctgaagctgtgcaagctgctggtgagcttcttgtacggttaaatgatgctgaggaagctgcatcacttgcgcaggtaacattttctgctttgcatacatagatatgcttggaaccttggtacgtagttatcgcatactccctctgtattcgtaaaggaagtcgttttggacagcgacacggtctccaaaacacaactttaacttcttgtttctataaaaatatttattgaaaagtgatatatgtatacttttatgaaaatatttttcaagacaaatctattcatataatttttaaattttcaaactcaacaacttgagagttatttatgatttatattcccaagatttgacttaaacattgtcgtaaacgacttcctttacgagtacggagggagtactgtacattaagtttgattctataatttataaagctatttatcacatgctaaattcctcgagtaagtgatcctgagtgtaagcatcttttttatatgctctgctttagactccagtacaaagccaatctgatgatgtttgcatcgatactcccagttaaaaccgaacacctaattcttcccttgttctgtttttttatggttccatgccttcacttctgcgtccaaatgaaattctgttcaaatcaactcttgtgagccaattgcacccttgtctcaggctaatatccattgatgcatcttaatttcccattcggaaataatgtactaccaattattttgcctttcatgatttgcattgtttttttatctggttctcgttacttatcttaaacctgtgcagtatcaactaaaatttaagtaacctgaaaaattagaacaatgataattgagttgatgtcactatttcatcaaaactaagaacaatattttcctttgctgcagaagcgggctgagttagcagagcaggagatgaacaaggcctttgcagaaatcgacaacttgaaaagggatcatgaccaagaagttcttgtgctaaaccagcggctcgctgaatccaaactgcccagcaatgttgtacagtcacctgagcctagtgagaccggccccgctagatacgacacaggtgggagcttcggcgatgagcaatggcgagaggagttcaagcccttccagtcggtcgaggtctccaaaagcagtgatcccagctcatggttttatgggtacgacaaatgcaacatttgatgaggcattctggagccatttatattgatttatttttggattctttcacctagaaaggtataatatgttgtacaccttgccattgaggaaaagaattttcccaacgttggctttgccatggcccatataccaaaccgcagcatccctcgctgcctagtgcctgcctgcccctatcagcaggactttcacaggttgtatgttgtgtcgcaaactgaaaactgtaaggtgtatgtttagatggattgatgatgcatgtaaaaatggcggacttattttttgggcagttggagagttgatgagtcgaaacttacagttaaaatttatcagaattatcttttttttcttacagttaaaatataatgaatttgaagataaaatttacatacaagtgtaattagaaatttatgtataatttttttttctaaaattttcggttatatttgctaattgatatgcaaaacatatattaaaagcttatgtgaataggatatgtttatgttattacaagtttgtttagtatcatctaagtcggctctatctccatgcatcgatactgttttgccgttgtcgcctctgttgtgcactcaaaacttttttctcgtttgccagcttggcaagtttttgttgcagtaatgtaagagcgagtacaatagcgaattaataatctaatctaattattatatagtaggattttagcatattagcagagaaatactccctccgttccaaaaaagccaacctaggaagggatgcgaatataaacaaagggatgtccagattcattatactaggtaggttgactttttttttgacggagggagtaaactgtatagagaaaagcccgtgactaattagacgcgcttatgcaaatctgcacatacgtgggctctctacatgtcacggcgcacaatagaaaaatagaacatgcagcaatgcccaactccttggaacaagggactgttacgattaaaagtttaaaacattgaaaccttgaattggtgaaagcaagttaatagtctgttgttgtatgtatggtagtttagctatctcttagatgtcgttggttgcacgtttattgaaggaataagttcacctgtcattcctcaactttacaccgagtttgtttgacatcccttatccataatatcataaatcttcaccccataaattatacaaaactgtgcaatttaggtcccatagcagcatagatgcctggttttgccgacgtggcatcatagagaaaacaaaaggtatgtggggcccatgtgtaagtgagacaaaataatgtgggccccacatctcttctttcttttctttattctcttctctccttctcttcttgggggctcgacctctcatcctccttgccggcggcagatggggaagaggtgaccggcaagcctgggcgagctccgccatctcaagaggctttgtcgtcaccactgccgctaccgcacctaacgatgacgatgacgacgcacacgcgccagggcggcgcccatgttcgccgccgctgcacccgacgacgacgacatgtgcgtgtgctccaccgcctgaccaagcaccccgcctttctcaccgccagcgactggtatcatctcgccaccaacgatgttttgttgttgaccatcatccatgcgccactgttggagccagccccattgacgccgccggacgccatgcctcttcccgaagactgcactgccaaagttgccgccgattgccacagctggctttgcggcaacaacaacttcatcatcgctgccgcccgccagatctactctcctcctcttcctccacctcctcctccgccgccgttgactctcaccgaattgattagtcgctcgcgtgaatgggtggatatggatattgttagtgtttgatggggaggtgggggtggtaggtgggtgaggtgtggcaagatcactggcatgatgcctccctaggtgagcggtgggatccatacggcggcggcgaggacgaggagaggccgagaggggatccatctgcactggcacgacgccttcctaggccagtgacgggatccatgcggcggcggctgaggagtaggagcggccgataggggacccgcccgcgctggcacgacgccttccctaggccgcggcgggatccatgcggcggtgaggaggaggagaggtcgtcgtcgttgggggtggcggcggcggaacctctcgaggtggcggagctcgggcgggcttggcggccacctcccccccatctactgctagcgaggaggacgagaggccgagcgcccgagaagagaagtaaggagagaggagaataaagaaaagaaaaaagagatgtggggcccacattattctctcacttacacatgggccctacatactttttgtttcgctctatgctgccacgtttatgggactaaactgcacagttttatatagtttatgggtgaagatttttggtacagaggataagggatgtcaaagagggatggcaggtgaacttattcctttatttaacattctctaagtgcagttagcgggaaattccggccagatttattgggcttatatggcctagagggctagatgtctctagaatctagatcggcggccgggctcccaccactccacactccacaggaatgctaccaccactcgtgtctgcgctttcgccacggtctccgtcgcgtgggcgcgaggaggatgcaaacggaggaggcagccggcgaggtggtgggaggcgttgtctccggcggtggcgcttggcgagtgaggctggtgcgggcgctcggtgcctcggtgctgaccgcgaagagagggggcttgcgggcaaggcatgcagctcaggtgctcgacgaaatgccgcacgaggggaaggcgctgttccagctgcggccttcggggatgagcgcgcggcagggtcaaccgccgtgaacgtacagtgggatctgggccaggatgctcggtttgaccgggttgccgcgatggcgtggcggaggcagagcactgttgccatggacatgatggctcccaattgggcaccttctgctttcatgtgtcactggggcagatgtcttgacacgatgacaaccgggcagtggagattgaagagatctagatgtgtgatcgatgtcgcctatgcggggttgcgctcaggctcagctacacggctcatacttgctgacatacgaattgatcttgatcagagtggttgttctagtagcaatatctgatggcagcaagatcaatttcccagatagcaagaaccatcgatccattctatgcgtcttcctgtcaagacctcagatcagtgttcatcagttgatgatcaagtgacaccatgatgcagagttacatgtttcactcaaggcaaaccagaaatctcgtcagaagcttcacgtcctacatctgcacaggggcagcaaaaccagaaatctcctggtcatcaagtcctcaactcaaggcttataaatagaaaggccccaggcttctttgtatccaaacacctcttcacatttttccctccaagaaaccgacccgctccactccaccccgcaacgcaagaaaccaagaactcctcgaccgccggctcgaggccacggccacccacccaccgccgccgggaagcagcgattcttcctcgggaaggaggacaccgccggccatggatccggaggcggaggaagcgcagcttcgcctcgagatggagttggcaaagaaggccaaggcggacatgtctgggttgcaacgctccagcagcctcggcttggaccacgccggcttgtatccgctgccattgccgccagggtggcggtccgccccaacctcgcccctgaggacaccatcgagcccgcccccgctccagttcccgccggcgtgggcggctgatgttgccggcacgtcgggctcggcggcgcccgaggacgatggcccagcaagaaatgccggcgctgatgaagccacggctgggtctgcgcccaagaacgaggacccagcaagagctgcgggcgccgatgatggccccacgaggtctgactacgccgcgatgatgcggatggcattggccaagttccaagacgacgatgctgctgccgacgacgaggaggcggcgtccgcggtgatggagcaggcgatgaccggcctcatggacctcacctaccgcaaagcgaagcctccagagctgccttacgagttcgccacaagatggcctattcctattgctcatgtaagtgcctgctccttggtctcttgactctgaattcttggcatttcttgtcgaggcttccagctctgttcatgttcttgtcatctttgcctctttgcaaacccgcctccttgttctgtttcttgtttgtttttgctgctggtgggtagtaggaatttctttgttcctgtttgttttaggacgaggaatttcctaaggagatcaattgcatttctttctgcatctattttgtttgttgttgtgcaagaactgcctgctgtttgattctttccctgcatcgtgatcagtgatcaccaatgggaaacatcttgtgctatttatgatcaatgaagaattccctttcctttagttgggcattattaattagcatctggttgaatttccttacacgcgctcgaattcgatcatttgtgcaagtcccatggcatcttgcctgacagttgcattcagtcaaatcgattgacccatctctgcttcttcatacgtatgatagttgcatcgaatcaaaagtttgatccatttcttacccacctacactaatcctacaattatgtgtgttcacaggatggtacgcttcaagcggaagtaatgcgtgatcctgttatcttgccttctggatatgtaagtgacaagattgcccctttgctaggattttatccaattttgttttagataatggaggtttttatccagttggaattctgtataattatctgctgggtgttttcagttttgtttgttgtagctaatgttctgccaaaaagctaagattgtcagaaaccaggcaaattatctatcaccaattgacaaaacattgattcgttgtacttatacacttgttacactggatggtagtaattagtgtccttgtttaaatattgttatttacaatgcacttctagtttttaggcttcacttgccgaacactaaaatgcaaatcctcttggattagatttactcttgagtttgcatcatcttaaatcttagattcctattttttaatctttcaaatcaaatgctaaccttctcttggttctgttaaaattaacacccgcttcctgctttctgtagtagtttgaattgtcaaatgctgcttaggtttgatactttattcatgcacgttatgatggttcataagttcatcttatgatataatgactagaatgtatagtgatcctgaaggatagaacacgggacaaaataataattttaccctagtttctttcatttccattcatgcatagtcttttgcccctttttctataatatcctgtaccataacttatgaacattttggcgatttagcattctattgcttgatatattgattagtaaaactttttttttttgccacaataagttactgtgtgctgtttttctgaagttagctatggtggttatgttctgcaaatccaccatgatttggattatcccagtaaccatattttgcttgtttggttgcagtctgttgatcaaacataccaaaacaaccaaaaacggcagaatccatggacaaataccagcacatttactgatcactccttgccctactctctctctgttccaaaccaccttctccgtgacatgatttctgcatggtgcctcgatcactcggacctttccccatctaccacttctgatacaccttccactcccttggaaccttcagaggaggaacaaattcaacgcatcctaaaactattctcagggaattctgcatcgcaacgagaggctttgaaactgatccagctactcactaaaaccaccaaaggggtgcaaccttgccttgccaagtatgcggacattatcccagtgctgataaatcttaggaggaaatataaatcgagttggacacaagatcttgaggaagagaggctcacaataatcctcaatctgaccatgcacaggcaaaacagggagatcctagctggacagaatgaattagcaggtgctataaaaaaaattgttaagaaggctggcaatcgtggtaagcgaacatcatccttggcgaaggtagcttctatagttgctgtcctgtcagagtttgacatgttcaggaaaagaatgctggatgctggtggaatgaaaatgcttcgaggtatgctcaagataaaggatactgaagtgataacggaggctgccactgcgatccttgcactctacgcagatggtgaaggcgagcaaccagccagatttcatgaggtgcctcagatgctgctggaatgccacatgttcactgatgggatcctgcttcttcttgaccgtctgccaaaatccccacgtgttttcagaaaaatctgtgatcaggctttgcaattggtgaatatcgtcatggctgaagatgcaagtgggccggtgacacgtaagggcatcctctcagcaatttccttgatctacgagattgttgaaagggatgtgggtaagatgaatgcggtgaagaacatggaggatttcatcgagcggttgcgtcagctatcatcagatagattgccgatgcagaaaatgctccaggtggagagaataatcaggactctgtcagatgcgtttccagctcctacggtgcgagggcgatgccaagaacccagtggaagccgtcttctagcttgaatcttatactgttcttctgtacagatctcaaaaggctcgagattttacttctgctcgcttaactttctggagaagtttgaatttgttgactgtgcagcaatgtgatggatcacacgaacaattcaaagcatagacagaataactttgtttcacttcctggtgagagattgtaacaaatgattggtgttagtaactgaccgaattgaatattattgtgattctgtgtagtactcctgtatgaagagaaaaatcttgtatcaactggtgaccattcgtttcttttctcgagtgttacaattggtatataatcccttgttaataattttgtttggagcaatatttcttatatatagaacatcttctatgagcatcaaacttgggagtcaaatgcaacagcataggactcggacaagaaggtaaattatttattttttttaggggctgtctatatatcatgtgacagaaaatcccacctcctatcattcgaattttggaccattggatgtgctttaagattcgtgcagccccttaaccctaactcctcctcctccccccggtttctagatcatgccgccaccctcctcccgtcccacgcgcgatccgctgccgccaccaccgccaccgccccaccgcgccgccgcccgcctcgctggctggccggaaaaggtcaacggcgccggtgaggcccccccggcgagcccctccccctcccccttccccctccccttcccccctcactttctcctcatggcgcaacgacgaggtgcccccgccccgccgtcttccccgtctccggcagctccccgccgccggatccgccaccaccggccgccgcctcctaatcccacccttgatttgccctcgccgccgacgccggcccaccgccctcctccatccccacggcttcggcgccgccgccgcctcgctgcccgctggagtccaccgcccaccgcggtcctccgctgcccacggtcatccctctaagctccgaggaaacccccctcttccccctcccccaaccctcctcctaccctcaccccaacctcaaaccctaacccgccggagttggggtgtcgccggcgccggagaagaagaggagcccgccggagttggaggagagaagccgatgcacgaatcttggcatagatccaatggtctaaaatctgtaagatttcatccctaaatttcattcgaatgccatatagcaatcccggtaaactatttctagttccgtataaatgtttgtgtagaagaagatctaacgaaagtcaagccagggcagagcagaagaggatcggtcgtccgggcggaaccaaaacatcggacaaacttgcaagatgctgattccagaaatgcttataattagccgtctgatgaaagtttaaccacatcatcagcgttagttgtgcggcatgacgtcatggaccatgaccatacagtctgaagaagcagtcggccactcatttaaatcccaaaattcaaatgattttgtctattcaactattcatccgatctataatctaattacacggttggatttattacgattatatctttataataagatctcacttgataatattttgatgggtttttagtttgttgcagtcttaaatgttgcacgtagtgttaattagatgttgcaataaatatttcgtggtgttcactatgtaatttgtaaatgttgcacatgttggcgttttgaatgtttcagcaatattttttatttttcaacaactacaacttgatgattgatgcatgctataacatagaacttaatgtttcgtctaattgttatcatggttgcagacaatatcttttaaatgttgcattctataaaatatttattaaatgagttgaaacatttttttttgcatgcgatgaaacaattttatataaataatgaaacaattcttttaaatgttgcatctctataaaatatttattaagtgagttgaaacattttttttcatgcgatgaaacaattttatataaatagtgaaacaatggttgactatatatataatttcatcaatgtgatatattattctaacgatttaattaagacaaatataatattctaatttgatcgtgcatcatatatgtatttttaaaagaaaatattgtgtaaagatatgtaatgaataagtacgtatatataagaaaatggggagagaaaaaaaaatagcaatgatggtcaaacaacactgcatgtgagcaagaggcatgctagttgctatgtggcagtggctacttgccagctagcagcgcatgcaacacaacagcagggcgtttttttgacaaattggtccttgcagaaaacttatttcgaaactagtccctaccaaaaactatatccagaaataggccgtcggatcagcgccaaagcggttggtgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcggcaatgaattaacggtgtcgctcgtggtgcaacggtaagtttctttcttgctatatctgaggactagggttcgaatcccaggtcagccatttttgtttttttttaaaatcatcaatctacgtgcgtatatattaatgatgatctccattttcgtttttgtcttcaaatcttcaatgtacttttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagtttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatatatatatatatatatatatatatatatatatatatatatatttaaaaaacagagagcatcattaatcatttatatgtactaatgtacgcacgtagattgaagatttgaagaaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctctagatatagtttttggtatggactagtttcgaaataagttttctataaggaccaatttgtcaaaaaaacggcaacagcaggggtagaggggcatgcggagcatcgtctgatatttcgcaaattttcggacgtccgacgtatatataagacatgttgatgccgaatcgctctgattagcccaattgcaccagtgtgggctgtgaactattattgtaacggtttaaacatcttatatgtttatatattgtaaactagcaaggtgtcccgcgtaaattgcgcggatagtatcattatattttctctcatataatagcatatacgttttgtcattatattattaaaatatattacaatgacaacataattttaaattttgcaataactttacgaaactactgatgtgtaatatttatattgtattttatatacgtgttagttattaattatttttaatatcaaattttagttatttgtaaatcatatatattcctttatggactttagacttgtcttttaatatttttttttaattttgaatttttattatttctaattgtatttctacgtggactctaaactcatctttcaatattctttaatttttaattttaatttcagttacttctaaattgtattcctatcttaactttaaactcttcttcccatgttttttttaatttcgaattttagttatttgtaaattatatttttatacggactctaaacactacttttcattttattatgtttattctgaattttagttagttttaaattcctatatggactctatactctacttctaatatttcttattttttaattccgaatttctattttttttcttaattgtatttctatatggactctatactctacttctaatattccttatttttaatatcgaatttccattatttcctaattgtatttctatatgaactctatattctacttctaatattccttatttttaattccgaatttcagttatttcctaattgtatttctatatggactctagtctgctcttctaatattctttattttttaattccgaatttcagctatttataaatctttttcttttctccaattaatgtgagaattttaggtcatgagagcgaacgtggaggctcctttttattccgaattttagttagttttaaattcttatatggaccctatactctacttctaatattccttattttttaattctgaatttcagctatttctaaattgtatttctgtatggactctgctttttttctttttctccgattaatgtgagaatttctcggtcataagagcgaacgtggaggctctttttattccgaactttagttagttttaaattcctatatggactctatactctacttctaatattccttattttttaattccgaatttctattttttttcttaattgtatttctgcatgaactctatgctctacttctaatattccttatttttaattctgaatttctattatttcctaattgtatttctatatggactctatactctacttttaatattccttatttttaattccgaatttcagttatttcctaattgtatttttatatagactctagtctcctcttctaatattctttattttttaattccgaatttcaactatttctaaattgtatttctatatggactctagtctcctcttctaatattttttattttttaattccgaatttcagctatttctaaattgtatttttatatggactctactttttttatttttctccgattaatgtgagaatttctaggctataagagcgaacgtggaggctcctttttctattcctttaatctatatctatctatatctatataactaattaaaaaataagtaaggcttccggttaatcttttcgtccgtcattaag

SEQ ID NO: 39574 - DNA, 16938 bp, Oryza sativa
  unsure (1)..(16938): unsure at all n locations
ataaaggagagaagaaaaataaaaagagaaaaccttgtttgtggagcagtccatccaaagcagcccggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtaaagaagagatcttattacttaaaacatgtagtcaccaataaaatgaattatttaccgacaaaataaattcttttttaaaaataaaaataatcacatgtgtctttcttttttttaaaaaaaaagtaatcaccaacaaattgaatcgtgtttacatttggattttttttccctcatcaattgctcattcgccacaggacacctaatcacatcactttttttcattcatcgtataatttcttctattatttagagtgaaagttattctgcgatataccacatttttttctttccttctgattatttaagtgagtggttatgcaattggagtgcagtgaggttaatctgatagctagcaaaaaatatatcttatattatggttactctttacaatatgaaaaaaagtgcttatcaatatcgagtaaaaaaaataacaaagtactgcaattgactcataataatacatgacaaaaaagtaaatatttttttgtggtttcaaagtttagtatccatgtcagtggatttagagcaacaaataattatatcatgttagcgtcttatttgcactagaaagattcgattcgactataaagacctcaatgaacctggtgtttatgctcccacacactaattactatttttttcttcccccagtacaacgcatgggcattttgctagtaatataatagatagattgcatctatatcgtaagtttatgcacggcaagcaccagtgtggaaattctcggatttgtaatgccgttttttttccggctgaaaccaaatagtgtcgacatccaacaacacacacatccagatgaaacaaagattaatgttctagcttggaatatatatatatatatatatatatatatatatatatatatatatatatatatatatatatatatattactttggtgtgggtccttccaaaaagactaaaaaaacctatattctaaataagcataaaacagatataagttaactcgggaagtagaaacaaagcaaactactccctccgttccacaatataagaagttttagagttgaacacggttattaagaaaataagtagaagtgaatagtggagtccgttccataatataagaagttttaaagttgaacacggttattaagaaaataagtagaagtgaatagtggagtccgttccataatataagaagttttagagttgaacacggttattaagaaagtaggtagaagtgaatagtggagaattgtgattggttgggaagagaatattggtgaagaagttgttatattttgggataaatcctaagggctaaaagttgttatattttgggacggagggagtattatattattatgaaatttacattaccacacaaccatcaatcccgaccaccacagcattcctagttatttaaaaccatcactaaaaataatattggtatcacttttggtttttaaagtgaactggtactgaaagtctgaaactggtcgagcatgttggagtttaattcaatttaatcactgaagaagggaaaatatataagaaaagggagagaatctaataggtgtggctcattgatttttttaataaaaaaataatgaccagattgtgacgcgaatgccacgtagaaccaaaaccacttcagattaagtggggggatcgttatttgtcaagtttgaatagttaaatctgaaaatttggagacaaacatttagaataataaaacctttttcaaattgcatcacgctggtatttattggattttccctttctgtgccagtgcaaaaaaataaaataaataaatccagaggataattaaaaaacatatttaaattctaaattaaaatatgaaattcatacaacatttattaaaaacatgattacgaattaatttaaatcaataaattatattaaaaaaaggaaataaatattatttattttctaaaaccttaacatgaactaaaatatttaagaaactaattttcaaacttagaattaaaagtctattagcctaacccaactcacctaatccaaaccctaaaattcataagggctattttgaatagcaggattgaaaaaaaaaaaggaataggaaaaatgcagaattttgataggaatgcaagttcaaaatagaggattgcaaaacacacaaaaaaaacacagaaataatcttttgattagaccgcaggaaaaacaaaagaattatatgagagagatagactcaaagaaaaatttccaagaggttagagcacttgttaaatttcctttaaaatctcgataggattgtccatttaatagaaatttcaaagaatagcatatgattcaatcttttgtttcaaacactttcataggaaaattttcctgtagaattgaaatccttcgagacctatttaaagtctaatttggcttcttattcttctcaattcctttcattttctctcccaccaggccaaccaaaccaggctggcctgaccttcctacctccagttggcaagcccaagaagacagaccgcccctaaagcccatgccatgccctttctccctttccaccttgggcctttaacgatggggagttggggacctaagctagcaggacaacttcgaccttgagttctaacacatttcctcgggacgcttcagcgtctatggccgagggaggcgacagtggcctactagacggtttcgaggaagatggatggtggcggtgcaaggtatagtgaaaaccctaaccgatcctaacatctttatcctgcttccatggtagacaaatctcatggaaaaaatttgaaatacagacaaggaagaggaatggagccctcaccacggtgaagaaccaacaaggatcgagcgggaggtggattgatggccgctactataaagaaattatagatatttgcacatttatatagccaccttttctcttcttgccatatatatctcctctatttgggcatatgttataactggtgtatattggctatatatatatcagttccccctctctcacattgagtacgtgacatctcgtaattctctatctagatttaaatccagaagtggttttcttttaacggagggagcacatgatatcggagtctgcatttctcatgtctttccatgccctagcagcgccatactggtcatgcaccctctctttcaggcttggctagtttgcgcgcatatcctagctacgcaagttgcacagccacgcgcgccttacgccgatgagcatattaacactaatgacaatagttagtattattatttttaaaaaacaatacataaataatttagttaaaagtttttaaggaatagtttgaagttttaaatttgtggtagaaagattttaaaaatctagtcgaaagtttttgaaattggggtttaaagttttgaacattgagtttaaagttttgaaatttgatatgaaagttttaaaatttgatttgaaagttttaaattttgagttaaaatttatttttttttaaaaaattcagtagaatatttaaaatttaagttaatagtttcaaaatctagatgaaggttttaaattttgggcagaaagtttaaagttcaggttaaaagttttaaatctctatcaaaagtttacacaattttgacatactttgaaaataaattaaaaaataattcaaaagcataaaatcactaaacacttactatatatggttgatccaagccatcatgggtttcatccctgtgccatcatgatcatcggcttcatcctatgccatcttgggctttatgcgatggctcggtagaaaaccgtgtcgtgtgaggtagcctacccacgcatgtctgcaccaaatagagttttcactctcttccttgtcatgcaaactccatcgtgccacgcccatcctatccgtgacgtcctatttcgaggaccgctgccctaacgccgcacctccgccacgctcatcctccagcgccgcattctcgccgtgccgtagcatcacgccatgttgatcgagtccaccccagtccttcgcgattgcatcgtccatgtcggctaagatggccaactgatccctccttccaccaccggcagatccatcagagctgtcttcgtcaacccctatgctaccgtcgttgtcaagtcacacgtccttttttttttggaacgactcgtacgagaagtgcgaagttctattgatagagcagaaaaaaattataagattacaaccctgaagggtcgtaattatcgtaattaaccaggaaaaagaaaagtcacatgtcctaatcacaccataaagcttaagcacccaaacttcaacaaatggaaggcttttatctcaattaatgtgcggcaagtttggcctctcctcaactacggccctgtttggagaactagccaagagttattttgagagctattttttagcacaagaaaataactctccaataaaatagctctaagttgtttggatcgaagggctattttgagagctatctggcttttaatgtaccttctcatggagagagatagagagaaaagccactttttcagtgggccccacctaaaatagccccaattagcaccccttgggtgggatagttttttgggtgggctatttccaaatagctcacccttttagatctttttgagttatttaggctatttgagggagggctaaaaaatatcccttagatccaaacagggcctacattgccatcaccgcccccgcacgccaagacgactcagcctaggaacaagccagctgcctactgcaagaaatcggtgagacggaggtgcgagaaaatagacaatatcaaaggttaccgaatatggaggggcagcaagaaagtgataacgaacgagtcagtaaattgaggcccactggaatgaacagtgcatattattcagcactgaaaaagattgtgcgacttgtgctccggaccaaccagttattgttcgaggcacacatgacttgtcccttaaagatgtggactgtactgaaaaagagacgtattacctactgctgagcaagtttaatagtatagcctactaccggctttaatttatttatagccaatttaatagccgcttactatactattaatatatggtcccacctatcatacacattgcgtcttatagttcgtgttgaagctggctacagatctgtagcccgctgtttttctcttatcgtttatctcattaaaatatgtttatagctggctaatagtatgctattgtacctgctctaatgagtgtgtgttagcggccagctcagccctcgacctgcctgcacgttcgcggttaggtgggcttttctgtcatgttagcagcgacttgtttggttgggttgggtgcaaagatgaaagatgaaagagctggaagatggaaccagacctcgatcaagctacagcggcggttatacagtaacagccacatgactaaatatttaatatttttagaaacacagtataaatataaatgtacacaacacgcacacaattatctctataaacgtaaatacacacacatatctctatgagtatctttgaaagagtagaattaggatgtgtcatattttaagattggcaaatattgatgaagtatccatgcacatctcgatatcgatatcgataggtacgttgcctagcaccaacaaaataattagccgtaaaaatgagcacgtgtcaattttgggacttaaacttaggggagtaagttctgtcacttttaaaatagtatagagacatttgaataatatagacataactcgtaccataagtttttttttcacttagtggatttatataattaactattgttaaattgcagtttggatcactttattaccaagtttaactttagcccaccctttgttccatccttttttactttggactagttaattttatcattatatagtaatttggaccatcccaaaccatttcttaaccacatgaacgaccttgagtacattatctccaacacaccatgacccctctcttgtgcgcaagccatatcttttgttggagggatgtggttaaatatggcaatagaagagaattatggtggttaaagtaaaaaaatgtaaatttaactggtctcgagtgaaaatattagttaattaaggtgatctaaaataaaacttttgaaacaaaaggtggcttaaatttcaattgagaatccatagtggtatatatttgctaattaacattaacaaacggcatcatccttctccactattttcctcctcctgatgtccttgtcatttaattaatttcaacatggcagatctccgtcgtgatggtaacatcagcatattttatatcatccatgctctaatatatttgaaaggtacatatattctcattaatatataggcatatatctagtagggaaaaaagaaacatgcacctagtcacctagactcctagagtatccgaataaatcctacctacaatactcacaagcttcacgccctagtatgttataacctgccactaaaagagaaggaaactatgcagatagtacaggtacgtactacctcattcgttccaaaaatatcaggattttatctatataattatatgaataaaatcccttatattttaacatgtaaatactagaaaacttattgaaacagtactgtcagtaaaaatgagggggatcaagtgaccagtcgaggaagcaaagctgagttttccacaacgcaattaatagcaaagagaccgacgatctgaagatatgatagcagagaatgactttaatttcctggaccatttgtccaccaaccgctgccaacggttttgtcgacaaataaccgagcagtcattaataaaaccagtgaaattcatataaaatttaccaaaaatttgaattcagttcatcttgtgcttaccaaaattttgaaactcagctagtttatctgcagccccatcgtttcacttatacttatcgttcgacttataaacaaccaaaatgagataatctatccaatgtcatctcattttaacaatttgacattaatattgtctcttaatataatataccagcgagtttatcgattgttctaactttttctttcaaaattacccaaaatatctcaaagacatataaggttaacaatctatttattacaataaaaatttcaaaaaaaaatatgatttttatatagcctccttatacaacatggaaagtagtttgtatataactttcaagataatttttggtattttatttttttaagaaagttattttttgtttggtatataatagaaaaaatgtgttgtctaggtttttaaagatttgcattgaaaacaacaacacatacagcatatagcagataaattgtattatgaaaaaaatagaaaagcaaaaatactgaaacttatatattgtgtaaagaggctaaaaatttcatatttttctgaaagtttttgatagaataaatcaattgttaacttgtatgtttataagggtgttctaggtatttttaaaaaagaaacaagcatagtggcatattatagaataattagtaaactcgctggtttattatagaagggacaattaatgtcaatagtaaattattgaactaggacaaatttagtggtacatagtaaattttctccaaaataatttttgggtaaaacttccatatacgtgtccttagagattcaaaagcaaatggtgtgaaataaactatgataagaaaaaccataaaatcaaatctaaattaagtgttgaaatttaaattttggcttataaatatacgcataagcgaaacaatggagtggctagtgttttctaaatgcagatcgagtaataaccggggtaatgcattttgaagccttgtaaaaatgttctgtagcaacattaatatcctgtttgattttagactattcagcggattattgcattggacaatctaggtgatcacatgcataaattaaatattttcagaaataaacttaacgaatatgttaaaacaatgatctaagtaatgcaatagaagaatttgttttagaaaagtatattttttgaagtgtggagcaaataatttgtttcagcaatctactagctagtacataagttggacaaaaaagggtctaaaccctccacaacttggtttaagtatcacataaaaattaaagaggaaaaaaaaatccaaataccccctacaagtcactagttttttcaatgtcctccctacaaattaattccatgcacaccatgctagagatccacagtatgcgaggaatcgctaagcgcgatgagaaatcaataaaagatagatataggtgagaagttggaagagaaaatggacttgtgagcaatgttttgcatgaaactaacttgcaggtgggagattagaaagatcactaatttgtaggggttattcatattttctcaaaaaaataattatttatttcatgcaaactgagcatacctcaattgatttagtttcttgtggtagatcctacctgcttggattccggtcctactcttggtattggtgttcgtatttaacgctaattatttttttagtggtatgtggcgtaccaactagggacttgtggactttggtgactatgttaatctaaagatagtagatgatgcaccgcgcttcgcggtggaatacaagagtgaatataagttaaatgttgtagaaataattgaccaatttgggctgaaatattgtaaaaaaaatgatgtaaggaatatattacaacacatgcttatatgtttagctttagaatataataaattgtatatgtaatggctatgcttacatattgagttttatagatacttggtgggttgatatgtcatgcttgaatgttatgctttaggatgtactatcgataactatgtttgcatgcatgttgagttttaaatgcttaatatgctttgtaactatatagaaagagtagatattgatccaatatatcaggaggggcgagtttatatgggtgtgtacttacatgagtgtctacgttatgaatacgtactttgtgataaaactattattgctattttgcttttgtaatacactacaactttggtactgctattaattgtctgtgttaattagtatctacattaaatagagataatttagaaaacaatatgacatgtatacatatgaaagataattatatgatatccaatatcatctatctctcctttttctcgtaactaagttatcccaagctgtctaaagaaacgataactcatttttctctctcgctctccactctcatcgacgtcaaaaaaaagtattaacttacttatagtgtcccactaattgctgttgtatatatcctaatccaccaaactgtaggagttgaatcatttttttaatgtgagttaggttggttatgcacaaatatgactagatgtgtgtattgtaacaaccaaatcttcatgggctgtactctaactcgccacaggtacaatttatcattatattttaaaaagcagatatcaatcatacccgttaattaaagattacacttatatttaaaaaagaaaagtcaattttactccctttaactctttcatccactacactggataatgtcacctgtgacgggcccaaaccctcacctttgacgggtttgggcttggtcagtgatcagtggtcactggcaagtccaatcacctttgatgggtgaccggcccgtcagaggcacactcacctctgacgggtccgtattttccggcctgtcaaaggtgaggatctccacaagccaatgtgtagttgcaacccatcaaaggtagacacctgagactcacctccaacgagttcaagatatgaacctgtcggtgaaatgggcctgggggtacgcacagtagagggaagtgtccttcccgtctagtcgcgcggccacgcggcctcgcgtcctcctgccccttggatagcgctaaggtggccatgggggcctcggggtgccacgtcatacccctcgggctttcggggcgtgctaccccgaggccctcgcacggccaccacgtggcgaggagagcgggcggtgcgaaggacgcctcttaggatctttaatgcgtggcgccccaaccgtccctcaccgcattttaacgcggtgtgggtggatgtacggcgccgcccgattgacccatgtcaatcgggagtgactggtctgtgaccggtcacaggtgattgggcgggcggcagcgcccccacgtcccgccctgtgtcaggcggaatgggggcaggtacgccccgtcccgtcagtatgctgccaggggtgccctccggacgtggtgagccaccaaagtctccatgcatttaaagggggaatgacagggatgtcccccgtgtcaggcgggggacggcgctgggccccacccaaggacgcacagccaccttgcttccggttgaaggcacgaatggcggtctaatcgaggcagggtgggttcctctcccctggaggagtaggtatggacggtgcatgtggtatccccttgaactataaaaggaggacctcgcccaccgaaaaaagtgacgactctcagatagttttgagttcgagaggaagaacggctagggtcccctccagagctcaagacatcctgtaaaagttgatcataatcccatgcacaggagtagggtattacgctcgatagcggcccgaacctgtataatcctttgtcttccacacagccccgagagcgatttagtagttaaacgccaagccgaagtaggcccttgatcatcgcgctgtatcccccggtcgaactcacaaaggggggggggggtctcacgaccacccgctagagagggttgctcctcgacagaacccatcactggaatggaaagtcatcttaaaaaaatggtgcccagttgcaaccatagaaaattggtaatagaagccgaagaactaataattaaccccaaacatttcaaactaattcctttcaaaagatggcaagaagccggagaacttacaagttttacaataggaaccgaaaaacaaactacaaaactaaaaactactgggaaactgcatttcagggaaattgttaagattctaattttctagctacatcacaacgaaaaaatctctagtatcttcaagaaaaacaagacaaaagttcacaggtcttcttctaacatcaattaatctccagcggcaacacatcatggggcttcaacaagaccacacccgaatcaaaaacttggaatcgatgacttgcaagatctgaaaccaaatcgtaagcacataaacacattaatcagtacttgggaatggtggaggaagctatggcggtggccgcgcgaggatgcaggaggaggtgactagctctcggaggagggcgcttggggacggaagaggagaaggctgtccagtgccggatctggcgtcccccgacctctaggaggctggatccagcgtcccccgacctcagtggtggcggtggcggtcggtgcttgaaacggtgaggacgacggccggtgctcgcgcgtggagttggaggccgccgccggatccggtcaaccccgacctctaggaggcgaccgcatctgcacgccgtcaagccctcctcaccgccgccatgcaccgcgcactgagccacgcaccagatcgagaaaataagagaagggggaggagggaagaaagaagggggaggaggatggggtaccgccgaaccaccactgccgcctctcccgagggccgtcgggtcctccgccgccgcctctcccgagggccgcccggtccccttttgtttctgtgagtgtggataagggagagagagaggtccccttttgtttcttggataagggagagatactatatataaaaaatttgaatttaaattcaaatttgaatcgggtatgtaaacttttgacttataaactttgggtctatagtttttaggtgtataaactttagatgtatagaagtactatatatagaaaatatttgaattcaaattcaaatttgaatcgggtacgtaaacttttgtcttataaactttggatctataaactttaggtgtataaactttaggtgtataaactttagatgtatagaaatactatatatagaaaatatttgaattcaaattcaaatttgattcagatataattcaaattcaaatttgaaacgggtatataaactttaggtctataaactttaggtgtataaactttagatgtatagaaatactatatataaaaaattatttgaattcaaattcaaatttgaatcggatatataaacttttgacttataaacttttggtctctaaactttagatgtgtaaacttgaggtgtataaactttaggtttataaatttactaaaataggaaagtaatgcggtgccaaaaaaggaaaccgggtggaggggtggagggagggaggggggaggggatcgatcgctgccccatccccagggcgatcgatcgccgaacaacatttccgcccgtccatcactctctcccctctcagtctccctccgtcgctctccctgtctcctctccctctctcctcgatggtgccaatgctcctccccaccgcttcacaatcacctggagattaggggttgcagtggtagcccctctctagtgggcaggccactggatctggtcgtctggaggttagggtcaccggatcacatcccctcgttatttgcatgtcatctaaatagttatgaaaaaaaattgagaagattattaatatgtgatatatcattcccacaaccatacaagttgaaattcaacttctataagtgttggtatttcttaacgacattactagaaatataattcacagcaatggcgcagaaatactcatggtatattatggctacagagttcatccgcgagcgcacggatataccattttagcatttcacccgagagtattccaagggtatcgtatttatttaatcccgtgggaagatcatagtagagagaacctgactagtaatttagatgttacttgtaataatcatagtttaagcaggagttaacataattcaagggtagaatgacacacaagcatggaactactcattctcatactaaattacctaagctaagttgaaagaaaatagaaagataatctattcctatacttctagtatatatagtatacatacattctagttatctgacatactagctaataccctctatccgatgctctcctggtacttcaagaagccatccctgactgccgagttccttacgacagcccgtcatgaccatacaaccggggctaaatacggaggagtagcctccctaggaaattaacttagaactatatacactcacggaggaatacccgtactgagctgtcaccatcagcggccgacctctcatccgcagcatataaccccaaataatgatacaccgtaatctagacactacgcctaaactaccagatactactctaatatcattgtcatgacatagagtaattgcataagcaaacactatacccgtaccaatgcatctcccagataagctagcagtataatcagtataacacgaacataatgtaaagttggcatttatatatttagaaagtatttcaataccataaatgtataaagaagagtattctaataaaagtacaaagcttacgaaagagaagagaagagctactagagccatacccgaactcttccgaaggcttccggactccgatttctactctattcctactccactagcttaagactactaaactaacttgagagaatatgagagagctcttgcttgaggtgtgtgagtgaagtgaggatgagagctccttttatatgcaggtaatgacggttatgatggttggaaatgtcagtaatatcctccaatcgtcattggggatcaatcccagccgtccatcaagaccctgcatccattggcgccacgggaggttcggccaaaccaggggccggcccaacctggcctaaacttggcatgtggcctcctcctttgctcttatacgtagacttatgaattttggcccagttcatcatgtcaattatgagttcttggcccattcatgtataattttgattctcgacatcgtccgattgatctatcgtctgatttgatgtcgatgctcctccactttatgattattctctgcaaaaagttagtgaaccaaatactagtgaaatattattattctaacatggatatgcattgcaagcataattagttctctattttggtaatattgacggtcgaaactgatcgctaacgaccgtcaagaataagttaaaaaaaaataaaactaaactatagctagtcgacgtatatttacaattaaatttgtttttttcgttgtaacattttagaagttaaatttgaccatacgtattggtggaatgacctatcacatagtaatttgatttttttttcataatcatttaaatacatgtaaataaagagaagatgtcctctccataatagttcccatcatattcggcagccacgtgcattaaagtgactgtacaattgcagcatgcaaccactgtacgtacactcttaaattttaacctgtacacttgtaattttcaacggagaatgctagttgtcaggcctccgatgagaggggagaaaaatcagacgctgcatggtctgccatttgtatgcaaagaatctttccctacatgcttccatctctcatttcttcaaaagattttttctcataaactatttatctaatgtacgatctgattgcatcactaaattgttacaattaaatctttacaacaagaccacacatgattatattttaataaaaaaatattttaattttttattgatttttttaaatgttgcatatggtctcttttgatgtttcaaccagtagttttacaatgtttcagctagtgtactcataatgtttcactatgtacggatcaaatgttgcagtgaattttgatattatagaacacgctgttacaaaaaaaacccacgtattttggaaacccctattaagggaatttgttttatttttttgttccaccaaaaagtttcacctaatgtactcacaatgtttcactatttatatatctaatgttgcagtgatttgagatactctattgcaacaaaaaacccacatattttggaaaccctcagaattagttttattttttgttccatcgaaaaatgtttcgtttagtatacccgcaatgtttcactatgtatggatcaaatgttgcagtgaactgaaacattctttcgctatttgcccgtaatctagacactacgcctaaactactagatactactctaatatcattgtcatgacatagagtaattgcataagcaaacactatatccgtaccaatgcatctcccaaataagctagcagtataatcagtataacacgaacataatgtaaagttggcatttatatacttagaaagtatttcaataccataaatgtataaagaagagtattctaataaaagtacaaagcttacgaaagagaagagaagagctactagagccatacccacacgtctctgctgatcgtcaatctccaacagggcctcctcgtagaagtcgtccacagcctcagcccatcgtgacagtcgggtcattatcgggctgtagcagcaaggtgtgtcctgaactgtgcagacggagttgccctcctctcgaaacgggtggtgagcaaactcagtactcgccaactcagctcggtggatagagctaagtcggaggaaggcctcccgggcagcatcctgcatcgcgatctccggcaagtcgcgacggtggcgtgtcgggaagctgtagtctaactctgaaggaactctggtgtggacctcgacccgagcctcccaaacagatccacactgtctcactcggtagatcggaaatctggggtatcgcagacgccttatcagccggtgtagctcaatgacgtatccctctgagcggggtacgcccatctcccaggtggcgggtgaatccggatctgccatctaattttaagaaaaacccaaagtcagttgagagtaaaacttgttttgtaaagaaaatagttaagagtaagatgaaaatcgtaccgagttttgtaaacatagcatttttatttttgaaagtattactaaatgggaatttctcccttggccaacttagaaaaggggtggggtgccttttggtcttttcctacagtcgtatggctctgataccagctctgtagacccccgtttttataacaggaatcaatcgtgtaaaccgtaccatttccctggatcaagtagtctggtatacacgaactcatagctgaaatatcaagtgcacatacacgagagtctagtacgaattattacatcataagcccacaggcacagtcttaaatcatcggaccgagcggtccggaatacattccaaaaacagaagtaggtaaggcagcggagttaaggcagcggcacgccattgccacaggcaacgaccgtaactaagacctactgagcgccatcgtcctcatcaccctcctggtaataggcatagggatcctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39575 - DNA, 1220 bp, Oryza sativa
aacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacg

SEQ ID NO: 39576 - DNA, 972 bp, Oryza sativa
aaagaaattttgtggtttacattaaattgacaagtacataaggcaatcaacaggcatagtcactagtaaaacaaaataagtatatgttacaaccagcccatgtaatcattggcagccacgaataactatccaaatgcttgtacaaaagttcctcaccatacctccaatcgaagacccaacggtgttttggatggaccaagctcttgttgagcaccatctttacctgtgggcttcacctctgtcttaacttcaaccctcacaggattcctcaaccctgctttcgccagctccttaacagcctccgtctgagttgccgaaaaaagccctgttctcctcagctttggcaacttcgaaataatcgacgtaatctgcttctggaatcctaaatccaacagcctatcagcttcatccaggatcaaaatctgcttcgaaaacacatacacaacaacaatttatgtcagatttgcatttcaagcacaaaagaacaacacatgaattttcaattgcttccaaaaccacctcaagattcttgtagttcagagtgtctaagcgctccattacgtcgaacagcttccccggggtgccgaccagtatgtttgcaccctcttcttccagtttctttagctccgccttgatgtcgaacccaccaaccagtagcatggatgagacgcccttcagcgtcgcgaagaagggctgagccacattgtatatctgcgaagacagctctctcgtcggggagatgatgattccaagaaccttgcaaaattccatacatttttctgatcagaagtgaacaagagatgcaatgcaatccagcaactttgcaagcaacgcatgaacagaacaagagaggatggggtggagccgtgagcactgagcagacctcgtggggcttgggaggcgaggggcggcggctgaggatctcgacgacggggacgacgaaggcgagcgtcttgccggagccggtggcgg

SEQ ID NO: 39577 - DNA, 1453 bp, Oryza sativa
  unsure (1)..(1453): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagatctatcattgagcatgtgatatcaatataaataagagtatgaaattcctatagagtttttattggacaattatatttcatttgaagaaaaaaaatcatgtaatatattttctacagaaaaattttaggcttcgaataacataagattgtgaacaggtgatgatagccaatcatctagcaaaaccggtatgtgtaataagtccaaatactccctccgttctcgaataattgacattggcactattcaaatttcaactttgatcagttgtattttttgtgttaaatttatataacacttgaaaacatattatattatcgaagtgtgtagcatcataaatataaccatacatttctatttttatcataatataatcacctaaaagtaatccatggtcaaagtgagacggatgtaatcagcagtctcaattatttgaggacggaaggagaacagagggggtatttaaacagacttagcacagcagattagcaatccaaacagtactgatcagattcttgggcacttttgcttgtcttgtttaggcaaatcacccatacagatcaagagccgagacacagcaccatattagtaactcaacggctcggtgctcacccatctccagaaccagaaaagactcacaaccaatccatttcctaacaggtgtaagtctgacacagaacaccatcgagaatagcaggtttaccgagtgggtgaaacttgaaaaaggtgtaccatttctaacctagaataaaccatcagaaataagatggtcaataaaatagcctagaaccttttttgtcctcttgtttcaaggcggaaattagatagtctccaagttgcagttgttaaatctaagtaaaccaaagctacatatgcttccacaaattacgagagcacggaagtaacgaatcccccaactcctccgggatctctttttttctccccaaaaaaggagtagacccctctcccgaatctaatcaaatataggtactattcgcagtccacctccacccacaggaataaaagaaaagggaaagatcttagtagaaaacatccaagagcataacaataataagctactaataaaaggaatagtaaca

SEQ ID NO: 39578 - DNA, 12385 bp, Oryza sativa
agcatctccgcgggggcgggggtgcctcctccctaaggtgaggccgccgctcggccggccagatcgcccgggcagccgcaggcagcggcagatcgggcggagggggaaagcgggagggggttgcttcgagcgccttcgagaaggtgggggaagagagaggagagagagagcagtaaatgccgccgtgttgggaatcgggaatggaaaacggaagagaagctgcagctgctggctgctgcgggacggagagggcaggtgtgcgatatatacggcatcgaggtggaggagacctgcccctgtgcagacggagtggggaaaaaaaggaatttatttttgctcttttcttttttttatctactaaaagattgtccagattcgttgtattagactatattagcttttttttatgccaacatatataaacttttttagattggtacggatattatgaaaatatgtgtgaatgttttaagaaaatgagtgattggttaaaaaaaataagtagataaaagagtatagttacgattggttgagagggtaaggtaggtggagaaataactttattttgggacaagataatatactagaaatagctatattttaaaatagaggtagtagggctacgcggcaccaggaaaatattctttttattttgtgttcttgcagctctgattatcttcttaaacctcatttacttaaatgcaatataatatatactccctatgtttcgaatgtttcgaaatgtttgacaccgttgattttttagcacatgtttgaccgttcgtcttattaaaaacgtttgtgagatatgtaaaattatatgcctacataaaaatatatttaacaatgaatcaaatgatagaaaaataattaataattacttaaattttttgaataagacgaacggtcaaacatgtgataaaaagtcaacagcgtcaaacatttcgaaacggagcgagtataaaagatccgaagcaatttacggcaaaataatttagttaccgttagacaaaaacttcgttgagttgtaaacacgactttttaggctcagtcttgtaggagtataaccgttaggtttaatttactattaaactaaggtttttcttgcggaaaatattaaactaatgtttgataatatatatctccatcctaatataagtgcatcctaatataagtgcacctagtaccaatatgatatttcatggtacaacgaacctacacctacacatacagctatccaaattcattgtactataaaatatcacatccagtttcatgtgtatttatattgggaaggaggagccccatcggttggcctaataaaccaaagcaaaagctaaaatttgatttttgaactgaattttaacaagattttaaaatattttcaatgtaattttgctacaaataaaagtgtaaaagttttacctataaattaattttattccctaataagccaaaccgatggggctagtagtatcctcgcatgattctttcagtacattccaatattacaataacatggttgtaacacatgaaaacagtctagatccaaataatgcaatactttcttctatcataaatatttgatatctttgtataaaatttagaaaaaaaaacttcactcattaattttacattatgacaagatgataaaatttattaagtttatgttgctaggatagtactccaaaacattttgtgtgtatgagaattgggaccatatattaacgatgtagtatataattataagtaactattgtataaatgaactattaaattggttatagatgatttggagctagtagttggctatctctaagcactttcaacaaaatggcattatcataatccactatccaccataataccaagcaaaacatcagcacacagaaccaatattttgtgaccaagcttaaagcataagggagagaaaagtccctcgtttttcatgcgcacgcttcctaaattgtaaaaggtatgttttttaatatatatatatatacatacatatataatgttttttaaaatcgtattaatctaccttttaagtttgaaataattaatactcaattaatcatgcgctaatcactcacttaaatttatgtatctttttaatcttcctattttccctcctctcaaacacacccttagtagttaaggcatactctgtagcaaatcatcacaagaacattgctcgacgtaggaggacaacagtaatgtgacataataatataactaaaatataatatattcatttgttgcgtagagatgttattgttattgacccatatacgtgtaacccgccctcttgccctacctgaacctgccaactactcatccacctcagtttcatactactcgcatgctagtactaaggttggtattcaaggaaaagcgtgaatagtaggtcttcaaacgtaagaatgaggtcgtattagagaatatgtaagccagaagtcattggatgatggtaacccatggtggagacgatgggaggtgagcaggggcttggcctccctcataatttgaggtttgcaatgttaatcactattgcttaagtggttttgcgtaaaattactatctctctttgtcctctttagcagaaaaatgaaaatagaatttaggattcttgttgtgtcattggagccgatgaaggacccgatgaagagaactagggatgagcatagatggtgccttcaaaatggtgctgcaataaatgttcataattgaagtcaacagttgggaaatcaagcttctccaaatttccaaatttgtagtacattttttattttgaattccatcctaaaatataagacacgatccattttttcccgtgtctcataatataaggcgtgcatgtatgcatacattaactatcaccttttaggccgcgttcgttacctcccgttcccaacttcgctccctcgtttttcgcacgcacactttttaaactgctaaacgatgcgttttttgtaaaaaaaaattctatacgaaagttgcttaaaaaatcatattaatccatttttcaaaaaattagcaaatacttaattaatcacccgctaatcattgctccgttttccgtgccagggagtgagggttcccaacccttactcccgaacgcagccttagatctataaatttggtttattttaaatcatgtaccatcaagtattccaatcatattgcttgcatatatggatgtgattcaatcgaggaggtgattaatcttttcttggtttttgtgttagaagtggttgagccttatattttgggatgaagggtgtagtacacttcatattgaaaattcataattggttattccatgttccaccaaaactcagctaaccgctggttgaaaatactactccatccattccattttgatcaccttaaaatttttgaggtcttccgaaaacagtcattatctaacaagggtctctttatttatttgtgcagagagtacatgtgcataattgaatgtattgcatgcatccaaccaaaattaatttctattgatgcaatggcatacagtatttaaaacatgagaaatccgcaggacacaaagcgatgaagcaccttaaccgaggaggattaatttaagaatgataaatatttttgggatccatagtcttggtgtcatttgcttatgggatgatcaaactggtatggagggagtattactaaacactagacacttagggtccgtttgatgcataggagttatcaaaaacatattcacatgaacttcgtaggagtcaattcatattatctagatttcaagtgcctgaaatttcccaaaaaaaaatcatatgccttttctaatccatacttatcaactatcactccccagtagtttgaaatctaacatagaaaatgtcgacgtttgatgtcgtgattccggtatttgcataatatggggatcgttggtactaggatatatgcgagactgaggtaaaagagatggggacgaggatttttatataggttcgggcccctgaattgtcaggtaataaccctactcctgttggccgaaaccagtcgttgctcttattcatcataatcacaccagtacaatatttggggtagcctatctatctgttgtcgacttggcggccataaaaccatcccgtagccgacaacagagtagtcttcctcctcgaatctgtatccggcgagatcaaagacagcgctatgtctctcctgatagtatccgtagacaccgtaggggactagccatgcttatctctgaagtcgatatccggcgtcttgtcttggtgtatgttgacttgtatgttgatcttgtgtattgatctattgttccgtctcccctctcctcctagggggccttgtatttatacccataggtgtccccttgtccaagtagaactaaggaaactaatatggatacaatccgagtagttcttgttgtttccatgtagaactctagtcatcctcccttatgcggaactcctcctatatccgaaggttgtttccatataagacaaggtatgtggtgggtcctgccgagatttagtcaactactattaggtatgtgctatccataaccctgacagaaaaaaattacaaaattagatgaaaacaaacttaattataactcacaaacaatacaaagtcacataaaaatcaaacttagacaaaaaaaagaagtaaaactatctataacaacatatttgcttttgaaatgaataaaagttgcacattgcaacttagggttagtagtgtacaattttaggtgactagaaatttataaaatttcaggcacctaaatctgttatggttatggataccatatacctaatagtagttgactaaatctcggcaggatccaccacataccatgtcttatacggaaactgacctcgagggagttccggataaggaaagacaaccagagttctacatgaaaacgacaaggactactcggattgtatccatattagtttccctagttctacttagacaaggcgacacctataggtataaatacaagccccctaggaggacagcgggacacccaccatggggtgatcaacacagacaatcaacgacctcaatcaacacccaacacgttacacgggacaacatacaagcctacatacgccaagacaagacgccggatattgacttcagggataagcacggctattctcttacggtgtctcaggatactgtcaggagagacgaaggcgctatctctgatcttgccgggcacggattcgaggaggaagattaccctgttgtcgactacgagtcagaccttcagaccgccatgtcgacaacagttagataggctaccccacatattgtactggtattattatggtgaataaagagcaacaccggctccggccaacaggatgtagggctattacctgaccgctcagggacccgaacctgtataaaaatcctcgtctccatctcttttaccttagtctggcgtatatcttagcaccaacgatccccatattgtccaaataccgtagtcgagacatcaaacgtcgacaaaatctagcaattttcattcttgaaacaattgtttagttttatgaaatcatactgttatattcctaggacacgcgaaagttagggtttgattgactcattaccgagggcatgttggaaagagttgtgtggctgttgtgcttattcttgcacatgaaactgaacggatcatcactagcacatgattagttaaatatcagctattataaatttttaaaaatgtatttatttgatctttttttaaaaaaacttctatatagaaaatttttatacaaaacatcacaagtagcagttcggaaaatgtgtaaatgaaaatcgagtaagttgtcgtttggagttgttggaaataacagcctaagagtgtgcgaaggcacaagcctctggaatacatatctaaagttggtcataataattctttgtatataagcaattcttctttatcactgggtataaatcaaccgcggctctgataaacaaacgttttgaataatgtctaaatacaaagatgatatgcatatcttggtgagcaccaaacaatgctcgacatcatgagaaccttatcccttggaaaaaagggtgctgtgctatctttttcttattaagtatgggcgtgaagcatcagaaggggtttcattggttaggcggttgagcaccgcaaccttcttggctcttttccacggagagtgagacacatgcaaatggagaaagcgactgagagtcgatcgatccgttaatatgaacactgctctggctctcgatggagtctcctcgatctcctggagccgacaattcaagagccagcccaactgtgatggaggagggaagaatcatctccgccaggtctagccaaacacaccaattaagtgattaacctgacagattagcttgatcggatccagtgtgcagacgcgtgctgcgcctcctcttgcctaggtctagttcttttctttttaacttcaaacttcacatttctcgtattttattaacacgattttcaaactattaaatagtatattttttaaaaaaaatattagattgtttgaaaaaaattaaataaatcattaattgctacttaattaattatatgctaatgagttttatcttttgcgtgtgctgaaaatctttctctaacttgagagactcagcttagaataattagatatcactgctcgatcaatggtttgggttagcagtaaaattatcatggcaaaatccatactgtaggtgagagtgtgagaccatgcatgaaacctccttgcaaatggaaaagaatatagaaaagaaagtagatattcgatgttcatgtacacatagaccagtggttagtaaaacactgccacataggtgtttaacggttcataggaataacacaatgattttcggtatcgatgtaaatcggaagccttgaaatagcttttatacgaggatctcaattaattagaaatgctcaaatacatgcatatttgttagatcctgcgaaatttatctgaagttatcactcgttctaattaattaaggcctccttgaaacctataaatattccatatatgattcatgtgcaaaacaaagttgcattcttacaaaaccttacaaaattaagccctttgattcaaaggaaaatcatagaaattttagagaattttatttttataggattttctatataaaattatttgaatcaaaggaataaaccctatgaatcctaccaaattcatatggaatgtctcattccaatgtaagttttgaaggaaatttaacaagaggtagaacctcatgaaaagttttatttgagtctttatctctcctcaaatttctatgcttttgtgtgtgtctattgttagaaatttggtcataattcggcatattttaatccaaaatattaagataatacatatgacatttgtaatttgagtagatctagtgaaattgctagatgtgtacaacatgagcatgcttaatatagaataagtatcaacatagacaagagaacgcaataatattgcgacctacagttataggaaacgaagaacgaacggtaatagtgaaacgttatacaccgagaatggccatccgctggagtttgagacagtattgcctccgttggtgttgacgggaggctcctcctccttgtcaccagtgttgttgttgtcgccggttgtcgacatgttggtgaagatgatgcagagcagtcgcgcttgaagcgctacccaaaaacatgatcgcccgcctacccgtgcaggttctcaagcggacggagtttcggaggcacctgctcgttccgatcacctgtgtgcacgggatgaacagaaccggggaaacagagagacatcacaggaacataaggagagtatcaccaagaaacaatagcagaaggaagacacaatctttgagagcctctgttttgctttatatatagagagagatctccattaccatacaaataaatctcatttattgtgaaggttaccacaaaataaatctcatttgttgtgaaggttaccacacaatgaatctttcatttgttgtgaaggttacaacaaataaatctctcatttgttctggatgttacaacacaatgaatctcttatttattgtggaggttacaacacaaataatttcatttgttaatggtgactttattctcgtctgttacaaaacggaagagcagcaggcaggctcggctcggtcggccgcctcgtctcgctacgcccacggccgaggccgactcggcacgcgcgcatgcgtgtggcagtccaaccatcacctcaaccggtcaacaagaaatccccaatatcactctatttaagttgaggttcttccacctaaattttcaatgcagtattattgtctctaacattacttgtgggctattaagattttaatttaattaaattgggcctagcccatttattccaacatccattgctcctaatcaaaaggtcattccggtgttttattatgttttacaatcctatattttatacttatattttgtcaaaattctatatttttgttccttcttttttattcctacaattgaaaggggcatagtgtattctaaattcctctggaaaatactcaggacacttggcaagccaatcgagtcacggttgtccaagttaaaaaaaaaaaaagagccatggttggaagctgccgtagaagatcatttggtggcaaggaaagacaactgccgcgaagactacagacaagcctcgccgtgtcagtcaactccaccacactcatgtctccacgtttattattctgcaaacgattttccctccccaatttatattattccactcaaagagtacattagtaatttcgaacgaattggtctggtctagtttgaagactatatagtgtgaaaaatgtgttaccttaagaaaaaagaacttcactctagctaatcgataatacgatttatgtgtcgcgctcaaaaaaaaaaaaaagcccatcaatgccctcatgtacgcattgcatgcatatgctgttggaaatatggttatatatcggtatattttaatccaaaatattaagacaataattatggcatgaacaatgtggggtgatctagtgataaaatcaaacataaacaggagcacgcttaagatagaataagcatcatcatcatacatagaacgcaattgcattgcgactaacagagatatcaaaaaccgaaataacagtagagagttataccctgtgaatgtccctccgctggattgtgaagcagagctgcctccattggtattgtcgatcggtgcacctggtgcggcagctcttgctctggctcccggcgcgccatctccaggtgcagatgcggcagacatggttgatgcagacgtacggtcgacgacgaacagaggacgaggagcagtcatgcggaagcactccccaaaaacctgatcacccgcctacccggtgcagatctcaggcgaaggcgtggttccggaggccctgctcgttccgatctctcgtgcgcgcaagcgatcagaaccggggatgtagacagaagcagcacaggcagcggcggcggcacgcggaggaggaagaaccagcgtttggaaaataaccgagaggatctgatcgggttcccactttccttatgggcgcaggagagagatccgcccgtggaggaagaaccagcgtttggaaaataaccgagaggatatgattaggttccctctttccttatgggcgcaggagagagatccgcccgttaccgcagtaacgacgcgatcaatgggtattgaatcgggttccctctttccttatgggcgtaggagagagatccgcctgttgccgcagtaacgacgcgatcaatgggtattgaatcgccctctttccttatgggcgcaggagagagatccgtccgttgccgcagtaacgacgcgatcaatgggtattgaatcgcctacccgttgtcgcaacgccacgtctcgccctggccggctcggctcagcgtgcgcgcacgcgtgtggctttccgatccccacctcaaccggtcaacagggagcctccaataactccctatttaagttgagatactcctcgtttaattcccaaggtggtaatattattcttaacatttattatgggccttttgagatttaatagaaaaatcaggcctagcccatttattctaacatatgcctccatccacctgttacacaatgcacacttgaaaatattttttttcctacttatatagtttagccgaaaaacatagctatacataaatacaagagaattttctatttggcctccaaagttgatcgattttctcattttccccacgaaattgattgtccctctaatgccttgcattcgtaacttttgtcctccatggctccatcttttattttgtttgttttccatcaagtaggtgggtaaaaatgacagctttgcctcagcttgttttatgcatgtcagtagtttttatttttcttttgggtgggattatactttgttattatggaccaacggttattgaatatttctcacgaacctaaatgttattttgagtaatgaagcgttatgaaaaaccctttgaatttgataaataacttttgagaacgaagggggagccaatttcgtaaggacaataggggaaccgatcaactttggagcacagataaagaattttctcttcgtactacttgagtgaattgcagtttagaccacccttttatcgttgaagtttcactttagattatcccatatattaatcaatatttcttcactttgagctaggtaattttatttttattgcatatcaataatcttgagtacacctgtccctgtaggttgatgaactctatcacctatgcatgtacctttactaaaggagaggctagacatgattagagaagtgagttggagtggtccataatgcaaaagtataaagttacctaccccaaagtactccctctatccgtgaatataagggatttttttttacaagaatcaaggaagtagtaaaataacatgtgatgagacaaaaggtgatggataaaagaataaagtagtataaagttagtaggtgggagaataaattagtataaaagtaaatgatggagaaataaactagtatataagttggtacatagaaaatatagtactgtcttgggtcttaaaaccccttatgttgtaggacaaacttgatggagaaaattccttatattatagggtgaatagccgaagtggtccttcaagtttcatctgaggctcagtttaatccttgatgtttcaatctttccatattagtcctttaagtttttattttagtttaaacttatccttgaaccaacaactctcttgataaataacacttatacccccatcattcacatatataagagaaaaattgtatgcttgatttttttatagataatgtatagtaaattatgtaaaacgaaaataaattatgtactagcaagtgtatacgatagcaattgcttaagtttcatgtgcacatgtagaaataatgggaagtatatctacaatgttatttattcatcttggttttatcctttttatatatagttgtatataaattaagggcaaaagggacattttctaatagaaatattgactaaaaatagccatatggcatgttaagtgggcccaaggatgatgtcaagccaaaacaaatatttagaggagctatgtggacaaaataaaaagtgaaggaccaaattgagccttcgataaaacttggaggactaaattagctattcaccctatattataggatggatggagtagaaagattagtgtacaatatacaagctgaaaatttgataataaaagttgagtcaaaatggaattcactctagatactttgacgaagagtatctcattactgttgtttcaatgtgccaaattggaatgtgatgcatactccctccgtccaaaaaaagacaaaccctggtttccgtgcccaacgtttgatcgtccgtcttatttgaaaaaattatgaaaaaaattaaaaagacaagtcacgcataaaatattaatcatgttttatcatctaacaataataaaaatacgaattataaaaaaaattatataagacagacagttaaagttggacacggagaccaggttttgtctttttgttaagacggagggagtacatgcgtggccaagagttgttaaacccgctgaccacaattccagaagcatatgaaagctgaaattgtccatgcatgccagccgagctaaccatgcatgggttgacagctatcgcgttttatgtacggaaaggtcgtctcaatttaattggcatacggatcatccaacaaacgggagtcgaaatgaaggccccatacaaatattttataccctctcgtatcgaatg

SEQ ID NO: 39579 - DNA, 1636 bp, Oryza sativa
tctcaatgatatataggacccacatgagtcaatgacatgtgggtcaggatagtatatcttaaattttgtaaaatttataatggcatggttccaattttcccaaatttaatttaaaagctaaggtaaggagtaggcatcgtgagagatatggtacgtaggcccatctggcctttctaccaaatcgccaaccacgcaccttgattccgtatcacgcgacctccagcggttgacacctgtgccgcttctctgtcgcaggatcactggtcagatcggattcgacgacggggaaggagacactcgtcgcgggcagcagcacccgacagaagcacgcggggacgtctccccgtcggcgccagctgccttgcaaagccaaaactaaatgggggcatttgcaaatttgccaccgattttttcaatattgcaaggatgccactcgaatgatagttttaatggtatttttgtaattttctagtgacagttttataataacgattcaagatagtgataaatttacaattgccccaaactaaattaccccaccaacccgtaaaacggagcaatcactagtatatgattaactaaatattaattttttaaaaaaagtaaattaatatgattttttaaaaaactttctataatattttaaaaatacaccccgttcagccgtttgaaaaatgtgtgtgaaaaatgaataagatgagttgagaagtaagagtggtaagttgggaaaggagaaagatcggtgaataactccactattccatcttttcaaaaaatacattagattgaaaacccaatgtacatagccatagtgctcgactattccacgcagttagacgtaaaatgtgtcaatttcctgttcttgttcatattaaatgcctttaaacttagcatttctttcttaagaaaaaaaacttggcatttctttcatgttagaaactagcagcatttactaaggggtaaactcgtctaaaatgtccagcactatatggaacgatatacattttcgtccattctgtaaaacgctacaacaataggaaatatgattaatgaaatattcctggaaaaatcctttgtcttgacgaaataaagtgtgcattatatttttgttcatagattcatgtcaccgcttgtgtcgggaatactatgtgtatcactcaagtaaaacaaatgttttgtaggaaacatgaatcaaccgcatgtgttgggaatacatattttttcaaagaagatgaatggtcaatcatatcccgttatatattaaaaagttggagggagcaactattataaagttaaaaatatattttttttgatttttttaaacttgaatataacctttttcatatatcgtttagtagttaaaatatgctcacaataaatgaggaagtagcccaatgcaacagctcttcaagctctgttcgatgcggcgattggatttagttagttattagaacatgattaattaagtgtaaacaattatattttaaaacataaatatatttatgtttttctttagaaaatttatatagaaagtttttacgtgaaatacgcactgttagctgtgagcttacggtaaacaagagatgaatcgaacctaatctcagtttataacacgatcttaagtatcctaaggaag

SEQ ID NO: 39580 - DNA, 1560 bp, Oryza sativa
gcgtattatgtactccattttgtggtgtatggtatttgatcacttgatttgaacatccagtcacccatatatcaagttatcagaagaaaaaaaaaatctgtttttgcttgctttgttcactcaactctgttagtttacttgttcctgtgtgcctgaatttctaaataattttgttgttttagtagcaccatcctggttgatccaaatgaaatattattaatgtaatttgcttgaactctgtatgttcaaatgtgtggttttatgctttcctttatatttgccagatttattttgtgttatgctattattctatctgtgagaattcaattgataatttttttcttaaacaaacttctgtagctaagggttgcagaaaggaagctcttgcggctccagggctaagttacaccgatgttcccaatgcacaaataagaaaggtaatttcaatcatacgttctttctgttaagtcgttttttatgcgatgttattgatctgatagtgttttaacttcaattctgtccaggttactgcgaaccgcctgctaagctctaagcaaacaattccacattattacctgacagttgacacacgtgttgataatctcatcaagtatgttgaatgctaattgtgggtattaaatcacctatactttctggtagggaaacatatggtgactggatctaccttcaaaggtccattctctctgggattttggtagcttttcttttaaaagtagttctttttttttaatctaatgcaggttgcgaggggaactgaatccattgcaggagtcctccggtggtaagaagatatctattaatgatctagttataaaggtaattaccagtttctcgtgttaccgtggtttcttatgtctaccaagtgccaaccactggattgttgcagattcagcctatttatgttcgtggactgtccattttcttctgacctccaattctgaatttatcttaatttgatgtacaggctgcagctctggctcttcgaaaggtccctcagtgtaatagctcctggatgaatgattttatccgccagtaagttctgaccaggcatatcttgggactaaagttttggcaagaaaggagataatgaaaatttcatttcgcatgcagataccacaacgtgaacatcaatgttgctgtacagactgagcatggactgtttgttccagtaatcagggttagtaatctaaacttgtctaatctgtgtaagaaaatgtttctaacttttgcttgttgcaggatgcagacaagaaaggacttggtatgattgcggaggaggtgaagcagttggctcaaagagcaagggataacagtttgaaaccagatgattatgaggtatatggattgtatggtagttaatttttgcatgaaacaacagcatttttccatgagaacttttatgtggtgttttcagggaggcacattcaccatatcaaacttgggaggtccttttggaattaagcaattttgtgccatcataaatccttctcagtcggcaatcttggccattggttctggtaataagtcatgttgcacttt

SEQ ID NO: 39581 - DNA, 10942 bp, Oryza sativa
gcgcttactctaggtgcaatcggggcagaatttctgaaagcattcaagggctatatcgagaatccaacctcaatgttactgtgaagctaaagatcatcaaaactattcttcccttgttctcgaatgatgcacagaacggtgctgtctcattttgtatatttccatcatgatttcgaggaggacctgaaaaccaagagcacagagccaagggcaggatgacctggtttttggattaatttttctttttcctgtttgtttcgttccagttacactgggaattaggatcaatttacaagccttcttttagcccgtttttatgggtttactccgcaagttcgttgacagcagagtaaattcccgggaaaccatgcaggatagcctttatacgatttgccccctttttactttttttttcatctttgtgcaaaaccaagaggcgcagaggtaataagttgcaaatcttggggagtttggtttataccctttctccgcaaaattctaacgagaaattcacaattgttcagagtaaatgatgcattgcttaatccattttgatgcttggtgtgtgcttgttttcctttggccccttcatctcgttgatatctgacgttaaagctggtttatactagcataaataaagaaaagaatgttgttaataaaacatgtgctgtgttctccaaatcatcattttcccgtacgttgtaaagaggtcgtgcattgtctgtttgtttggtcgatgcatttgttattcttaacaagtgatgggcagtagggatccaaataagctactccatctatctcaaaatataagtatttttagctatgaatttagacaactaggtgtttagatttatagctaaaagttgttatatttaagtattttttagttatgaatcttgataactgggtttgataactgggtgtgggtgttcagatttatagctaaaagtagttatattttgggacggagataatagttcccttcactgcttaattcttgtggttagcgactctaagcagtctatactaatttgttcaaagatttttatgattatgtgttaatgtagctgcaaattaagatgaagagagagcaataatgtgtttattctaatcatatgcacatctaggtttgatcggaaaatattgagttgatacatttttattcgccaccgattaactttgcttgcttttttttatggcaaataaatagccaatcttaattttatcaaaagtgcaagcaataatgggatttttgtagcgaagcacgagcttcatgattccccatgtaacatccctttatatttagttttttttttcagtggttaacacctaatgtggctcatatagagtactttgcattcttttgcagcacgttgttgaatacgaaaaggttaaaaaatagtgaaatctgcaattagtttttctatgattccatttggcacccttgttaagcacgtgtgtactaaaaacattttttattgttccaattgaagaaagagaaaattgctctgtgcaagcaaacattttctccctatgcatctttgttttgctccctccaataaaaacacaaacaagtattgtttcgaatcttgtagttgaactttgctataaaacaacatgaataattatgtttgacatgtgagaatgataattttctaaatagagcaaatttatgtgctacatgttaagttttccaaaaggagcaatttctatgttatatcatgtctggtcttgaaaaataattttctgttaggtaatcttttaaaagtagggagaatttgaattttgaattttgataaacgttattttgaatagttatgggtataattttataaaataaatagttaagaaatccatatccgtcggttagcacgataagttggcataacatgaatttctatatgttaggtggctttaggccctcctcacgtctatatctatacctaattaaaaaatatgcaaggtttctgtaaaaaaaattttcgtccgtccttttttctgactcagttttacccgtaatttttcgctgtttttcttttttttccgttttcgtgttgttttgtccgtctctcttttttatttgcccaattcatttttttctcgtggcttctcgctccgttttttcccgctgttttctttttttttttccgattcgtttttttcgtgttttttttgttttttcatctggtttttacctaactaaaaaatacacaaggtttccgtaaaaaaaaattttcgtccgtcctttttttccgattcagtttttcccgtaattttttgcttcatttttttggctatttttctttttttttccattttcgtgttttttttgtccgtctcttttttgcccaattcagtttttcccgtggcttctcgctctgttttttcccgctgtttttccctttttttccgattcgttttttttcgtgttttttttgttggtattttcatccggtttttatcttatccaatctgttgcgcacttgtacttcaagctacttcctcttgtgttttctcctcccattgattgtaaaaatcgataccccactccactcttattatttttttttcacgatttcctcttttaattcactggatttaatctcattggttgatgatgctcggctggccatttttatcccaatcccaaattttatggatccgttccgattttggaaaaaacagaaagactagaccgagtggataaaacccctcaaccggtcaaaaaagatttagatttgatggagaggatcagctccgcatacgggcaaggtactacgccaccggatctacacgcgggtagccgccggatatgccgccgccgtcgtagccgacgtgggaagccaccatcgccggcggatcggtccgcgaaccagatctacacacggatagccgccggatccgccgcggggagccgtcggcgccatcggatccaccgcagaaaggcgccgccaccaccggatcaagccataggaagcgaccggtgccgtcggttccgctggatctacccacgggaagccaccacactccgccccccctctctccttatccgctcgtgaatagagtcgtgccctcgtcgtcttcacgccgcgccagcgtgacaggagggagaggaggagagggactggcgacgccggtgaggggaagggaagggggagcgggagcggcagagagagggaagggggaggaggttctcacgatggtggaatgggatgggaaagtgtgattagggttagtgtttttagcactgacggtttgatggatatagaatcgatccgacccgtccatcaaaatgaatggcacagatcgatcccacgtcaggccgacctccatctcgggccaccgcactgctgggccacgcatgcttcatgggcaaggagcgcaatagcaggccgatagggtccaatggaccttttctttttttttctttttttagcacttttttatttctaaggaatatatttttttgaaggctcatatcatgaaaaactaaaccgtaatcgtctaatatttttatatttattataatttcagtttacccgttgcaacgtacgggcattttttctagttaactctgaaaatgctacctgatgatcggtcactggaattaggcccacgtgatcggttcctgtttccctttttggcgtaggtgttttttttttcaaaaatccctgattcgtcacgcatcgtttgtttttttgtttttaggaaacgtggtcaggggcatttcgatttaattctaaacaatacgatttatcaccaaattttattgcataataaactttgtatgtataaacttttttcgaacacgcgtgaaatcattgtatcatttcaataagcaaagaataaaaggtcggacttacgaaaacaaaaacacgccaacacacccactggaaaacacacacacacacacccataaacacacctcccctcctcctagggcacaagagctattgtgttggccaacaactcttggaacctagaagctcctgccatacactatagtgtgccctcattactaatggatagaaccacacttgtcacgctaggagtaacaccattgaaaacataagcattttagtgtttccagatttcccacgcgactaagataataagagagttaagccctttttctcgttcttttgcaaccctttactgcctttgaccaccaacacgaaaacttgcgcgtgtcatgatttcggtagagtggagaaatagccaagcctttggagaactagtgacaaaccttgtctgctgaaaacacaagaaaccaaaatgtgttgcattgtctccttggcttgatcacaaaggggcaagcggctggatgaggcaagtaacgcttggcaagatgatcagccgtccaacaacagttgtgtattgccagccaccgaagaaacttgcatttaagatgtgcccaactcttccaaatccttctccaaggagcaaacttgactgcccccatgaagaaggtctcatatgcggatttggaagtgtaaactcctgactttgagaacttccaatagtgctggtctagaattccttcttgcagcaccaccctcatggactgcttcccaaatcctgatgtattctgcaagcacctgcaccgtcaaaggtcctctaatgtccatgatccacttttagttgtccaatgcttgagccactgtacaatgcttgattatccttttcaattcacataagttaggggccatttccaaaataattcttccatgcacccatctgtccacccaaaacaaattagattgcccattcccaatttgcgacaacaccgccgaactaaaaaggtcatgagaaacacggggaacttggacgagcaatccttgccaaacacgactattgtctatcttttggagccataaccaaccaatccaaagggcccaactcatatattccaaattaagaatactaaggccaccataagctagaggtcggcgcactctatcctaggccattaagcaattaccaccattggtgttttcttgtcctgaccaaagaaaccccctccttcttttgtcaattgcttttgcaacccactttggtagatccatagcaatcataagatatataggaatggcgaatagaacaacccgcaccgagatgagacgaccgatccgattcatgagggaagctttccacatggggagatcatccgctaccttgtcaaccaaagcatgcaagtcggtcttagacagtttcttaacatttaaaggaagacccaaataggaacaaggaaaatccttgatctcacacggtaacacattcacgatcacttccaactcttcttcattgcacctaattggagttattgagctcttttgcatgttggtcattaggcccaatgcatggacaaaaatatccaaaacattcttgataatggagagatcattcaccgttggtcttgaaaacataataacatcatcggcataaaaagaacacctttgctacatttgccgaacatcaagagtctgaatccaaccctcccgagctgcccggtccataagagagttgagaacgtccataacaagaataaactttcattgcaaaactttttgtatagaaacttttattgcataaacttttctcctgagaaacttttgttgcatcaactctctctagaaacttccattgcataaactctcttttgattttttttatagaaacttttacatacatatttttgtagagatgaagccataaacttttgggtacagataaacttttatagacatgagatttcaaaccaattaaaaaactcaaaaaacttcatattcaaaatcaagcattctcaatatctcaggaactattcactctaaattggaaactttccacaatcctactccaaatcatcaacattcaacttagcatggaaccgtgcagctcacccgagggcaatagcccacctccaaccccatcgtcaccaacgctcgcaaccgcaacaaggcacccacttcgccattcgctgcaccggcgctgacggcctttgccatgcatacaccatctgccttgctagggaagagaagaaataggggagggggagtggagggctcggcgcgttagtgaggatgatggtgcgcactgttgctcgttgatgcatcaaggagaagagacgacgtgaggggcagaggcgacattgcgtggttgaggcgtgagatgtggaggaatactcgatgaatcaatctatggtgggtggaaggcataagatgtggataaggtgttcgctagcttccactgcatatgatcggtcgcgaaataagccccctcgatcttgcccatttattaaaagagaatcttggtttcccatctctcctgcatatgtagaaaaatgttaagttggtaaggaaaatatatagtagaaacttaaaaataatcatatatataaaattctaggacaatggtagaaaattaaaacacaacgaagaaaaaacacaattcctttttttttctatctccttcttcactgttttgtcatttttatgtagtatcgtcttagttatatatttatataagtgttattttttaaattccccaaataactttttatgccgtgatttacatggtaaaccacacctaataatgaattttacatagagtcggtgtgcacatgacaatggctattgataggggagtgctattacaaaaatgcatatgacaatggttagtgatacatttggggagtgctattacaaaaatgcaaggtaatttagttggtaagggtaagaccatatatatagcttgtaattaattaggggcacacgacgccatagctgctttcaaaatcaaaaactcctccaaagagtctacctttttattctgattctgagaactatagttataaaatgtagaaaataaactagaatcgagatgctaggtgattctcaaaagctaactaataaatagttgcttcttagaagcataaactcccccaatcaggaccttagcctagtagcaataccaataacaagatcaaccaaacatggaaaatgaaaattaacagcaaacaaagtgacaccggaaaaataacatatgcaaaatacgtcgatcacaactttcagttaaacacacatgcaattaaacatggtgaatccgtactgtccccttggaaggttggattttaagcacatgaaaagaaattatatattactattccgactaaacaaagagacaattgatttgtgaacatgttatgaatatttcatattactcaccataccatgctaaatccaaaagtttacatgatgtgatgataattactacgaatatgaatactagcagtgttcatattaaaggtcaaagagatcaaaccgccgttcatgttccgaaattagattcggtcacctgcagtagtattgacttcaaacggccaccaaatgtccatacgagctctgtgctggatccatgagtacttgatgaaaagctcttggagttctctttccaacggatccagctcatcttcaaagtccacctcgatcatttgcagttgaagaaataaagagttgtgccacccgtcataggtctctggacttataactttgtttgtgaccccggtctaagtggatcccaagtgggatgcatcccaagctagtgtagcacgtccctagggactccttggtcatcctcccatcaacttaaatagctatgtaccccttcagggtttttgagtttttttaattaaagtctagctattgctacttttctagataaagccgtgatcggttagatcattgttttctcgctacgagacccaacttatcatgtatatttaattcctatttgcaatatcagattatttttattttttacttgttttttcgatttgcttgtataaataaggttgatctacacccgcaagatcaacaatccacggagagatgtggcgatcgctaaggcgcaacacaacaactcctcgtacagttgtagtcgggtcattaacttttctctcaaattgtagttattatcaacttaccgaaatattgaattaatcgtagctatgagcatatcgaggaagctcaaagcttatcaggtggtacagagcttatcattacaattgcatggtcaattgtctttttatgaaaaaaaataagaataccacaggaggctcatttcccttaaaattgcaacattggagggtatatctgcaaaatatattactcaactactccttccgttccaaaaaaaaaggcaaactctgggtttccgtgccaacgtttgactgtccgttttatatgaaatttttttataattagtatttttattattgttagatgataaaatatgattaatactttatgcgtgacttatatttttaatttttttttataatttttttaaataagatgaatggttaaacgttgggtacggaaattaggtttgtcttttttttttttttacggagagttagaaaactactacccccgcgtggccgcgtgtggccgccggaccagttcgcgtcctgtgccttttcctgcccatttcccaccaccaccacgtcacgtcgtcacccccacatccaaagctaccccaccgtcagccccacccactcccccaccgtctcgtaggacccacatccactggcccccacgtgtcatcagcataagaccgccaagcgcggtaaaggattcacgcccctttggtcccaccatttcttattacccttatattattaaaaaggaagaaggcgacgacgacatcggtgaggtctcctcactcctctcctctctctctctctgctctgctttgaccccaattcccaacacccctcccccttcgcttcgctgctcccgattccggcagcctcgcgccgccgccacattgatggtaatagttggatccgccgcctccgccgcagccgacgacgatgggactctgctcctcctccagcgcccgccgggacgccggcacacccggcggcggtaacggcgcggggaacaaggataacgcggggaggaaggggatcgtggcgtgcgggaagcggacggacttcgggtacgacaaggacttcgaggcgcggtacgcgctcgggaagctgctgggccacggccagttcggctacaccttcgccgccgtcgaccgccgctccagcgagcgcgtcgccgtcaagcgcatcgacaagaacaaggtatgggcccaaacgagcgtggtggtgtgcggctgacgcgtgggggccatgtgcccatgtgttgctcgattcgatcggccagttgggctagcctggacgacgaccacctttgcggggggcgtcgcgttttgcacgtggggttgggttgccgaggaaatgtgaaatgtgaatccggggcgatactgtagtggtagtggtacaaatcaaaaatgcactgccactacctaatgctgctgcatgttagtactagcgcaacttgcagattgccatggaggtgatccatctaaaccatcgaatctggtgggatgactccattcctcatttcttcactcagtatatgtacttttcagggatgaggtccattcctcaaaccaaggaaactattttggatcaagtggtcaatggacatctcaatcctcaaaccaaaataccaaactattttgggatgtttaaatcttcattcttgagcaaaataggaaccagtcaggatggaggcaacaagtggataatggactatacacatacgtaatggacacatgtggcgtatacaaatttgtttagttccaaaaccagtataaagactgcacaaatgcctcctaacagatacggcaaggcaattcctgaaagacactgatatgtactgaaacgtaacacattcgtatatgaccctacttctcctgtacatgaaggtcataaattcatgagcagagaaatgtaatatgtgtattcagaaaataggacgcactgattttctggactctgcattattgtaaagccttgtcagcatgtgctatgctgaattgaagcatcaacagaagtagagaactagcctctattttgaaaagaaatgatactgctctaacttctcaaatgggatgttttcgttgcagatggttcttcctgttgccgttgaagacgtaaagcgagaagttaaaatactgaaggccttacaaggccatgaaaatgttgtacatttttacaatgcatttgaagatgataattatgtgtatattgttatggagtaagtcatggaaaaactctcaaatgtttatgaaatcagtagaagtatatctaagtataaccataaaatgtctaagtgaacttttcatggccttagccaagttgaaggaaggttcatatgtgtgtttatgcttttttttagaaaccacccatattttaagtaattgatcttactgaggtctagtattttagtttgtgcccctccaaacaggactttggcaattcaggatctaattacatggaaaagaaacaccacatgcaaactggcataatattaataccctcgtaaaaatctagaaattgtaccgggtaaatatcaagttcaggataaatagttggcaaacactttcatgtttctcatctttgttctctttgtatcaaggaactgtgcaagctaatgaagatctgaccctgttacatgtatttgacagattatgtgaaggcggggagttacttgaccggatactagccaagtaagtcaatttttgaagtttgtcaaaaatttttactttaccacagaactgtggcatgcttttttggttgtgttgggattacttattctaaatatagggatgttgaaccggagagcatttcaattagtgcttcgtgccacaaagagcttggaatttaatatggatgtatggcatatagtcatatattgttttcctattaccataaaaccaaaatattacagggattgacataagtttatgtgagacatccactagccatcaactgtcaggaattgttcaaagattttttttcgactgaatgttcaaagatttttat

SEQ ID NO: 39582 - DNA, 16797 bp, Oryza sativa
gagaacactattagaaatttagaataggacaatcagattcaaatctcattcccaggattggagtttgttcttaagtaaaggagattatcatttagacatgtactaaaaagcagggagccagataggcatgattcaggggccttgcaaaatatgccagcgattttttttatggtgtatcttagccaacaacatgagacgcagtgatcaaatatcgctggttcatattctcttgtaagggtggttctctcatacaatatgtcccgacactgccacataagctaacaatatcatagcagaaaatgacacataccatgacaatgaaccattgagaccagtaatagtatttgggataaagttgttaggtgatctcctgcaagtgtagcttccattaagtcctagtgacaactgaaagagaaaatgacaaactagaaagtcaggacaagacaataatggtctcaataaagtgggatatatttcaaggacataaccttggaggtctcaagctcttttccaggttgcttgcgctgaggaaatctggcacctccaattcttttctcagcacctgtggaaaccaaaagcactaaaacttcaatggtgaaaattgcttaatgaggacattcaatcaagaaggtgaattctcactgtacaaataaattcccaaaggaaccaaataactactatctcaagacaaaatgagtgtgcctatactatgtcaatgagaaatcacgccttaattaaaaattatagtatcagctcaggaagccaacccatgcttagccaaaggtacaaaaattagtggagaggtaatgtgtcaagaaatgaaaaaatgaacatattggattgtacttctgttgcaacatattttttttgtacagatgtttgtaatcaattgacaatctgtctatattagactacagaccaccaacacacaatcaatgaatgcctctggaggatccaggattaccaacacctgtgaaaccaaacgttttataactaaattgcctatgtaaggctctatattggtttcagttatgatggcaggaccattttggtttgacgccaaaatgtgccctaccaaattgttgacccttcgaatagtactttggctagtgtttggtttgctaccaaaatatgccaataacacacataggttgccaagaaaaaaaaggctaaaattcacctaggttttggtattgctaatattttggtatggtaggaaacaaacaaacccataatacagaaataaaaagttattggaacagaacagaactgcatgattaaaagcagcagacacttatgaaagaaataaaggtatttgctaactatcacagcaattagtcatgtggaaggacatctccagttgagttggacaaacaggttgcttgcgtaccgtggtcaattagttgacaaatacacacaatcaaaataaaatgataaaagatgggtagcacataccatttcccttggtggggaacgaaccagaagcagtggagaagtagcgcacgaggccagaacgctcacagtctagagcattgtgtaaactccgcaactgcagtaaagcagattgaaatgtcaccgggaattgattgacgatggcgtaacattactagcgcagaaacatttctttcccgctgcagtaggcaatagatctcccgatcgaccgaaatcaggtgaattactagtcaattcgcacagacgggagcacaaggaaatccaggaacgatcgaaaattcaaccacatgcggcacgcaggctccacgcagcgggaaggcagatcagaacagatccgatggcttttccgacacgttgggatgggagacggatgcgcaggcagccacagagagaggaggcagagagagaaagagagagagagggagagagacgaaccttgcgagagtggcggaggagatgcgcggcggacatggcgacgggagaaggcaatgggcgtggctagggtttgtctcgatcggagatcgttggcggcggaccgacgagggggcggatctccttggccacggtcgccgtggcggcgctggatcggtcgaggcaggcgtacgagcgtctcccggactggctgcggctcctcccggcgtggtcgaggccgcgggacagatgaggacggaggggggtcgtggtggtgtattgggaattgggatgtcgagtcgagtcgcgtccgggaatcacgcgccgggagggggcgagagaacaagatcggtagcgagtaagcttaccggggggccgggcctgggaagggagatacagtccgatggtaaaaaaaaatatagagttaatttcattttggatgatactttttctttaggtttcacttaaaatcattctttgtttaaatttttcaatttggactaggtaattttatctttgttgcacaattgatcacccccaaaccgcatcttcatcacttcaatgacttcgagtaaattgttaaagacatgccggcaaacttttatatctatatgcatgttatccctttacccaaggagacgctagacatgactagcaaatagaattaggttggttcattatgtaacaaaggtaaagttacatagttcaaagtaagaatattggttatagggtagtttaaagtaaaactttggcaataaaatatggctcgaaatgcaattcactcaaaaaatatatactagatgagtgagtgagagtggggcaggggatagttgtaaaattctttaatgttttgtgtggagcggatactatatgaaacctccagtgttgcagcggatcgttcgtgtgtaatgtagttataaaaattttaatatatatgtatgaaaaaaacattaaaaaagcctgtaaaagcatcatctaagtactcccttcatcctaaaatatagcaaacttgtactggatgtgacacattatagtacaacgaatcaagtaaaaacaacaaggatagtatctgtactaattcatcgagtccaagaataatagtttatatcatcatgatataaggtcattcccaatccaatgactaggatagtgtccatagcattaaataagctgccacctaggataaaaaatgatatgtcaagtaaataaatgaggaaagagaagaaaaccatgtcttgagacatggtttctacacaacatccaagacatcatgtgagataagtagcattaaattgaagtatggaatagtggtgtttgcattagaagagtggtgtctaacactattttcttgatgatggggagtttatggaaattatgtctagtgtcataggttgagaatggtctaagtacacttaaaaagccacatggtccacagtagaacaatgaattcagaaataccataaaatattttgtgcttattaattgcttctgattatgcacaatcatcaacggttgactttacggagtcataatttggttgaaaatgtgaccttttcatccacattgccttgcacttgagccgattagtcaatgttgtacatcaagaataactcgatggacatgccgtgaggaatgaccatagtggcacaatgtactatgggcaatgtaagcggaagttcttattctttttatctttggaaagatcaaacataagatgctcctatttcttttatggagtgtaggtacctctaggtaacacccctcgaggtaggcagaaattggtccaatggcaagcatcaccgtgaagatatgtatgttcgggcttgtgttcattctcgttgtcccaacctcgatcgggctgtgggtatcgtatggataaggcaaacgctgcagagtggtactgtatttgaatatactatgctcctgattaaaggagatatgtctatgagtgaatcctaattagtggtatgagaagtctcttaatggaacatttgaatttaatgaggaaaaggcctgaaatgaaacaaccaatttttgaaatgtaaattgattacaaattggccattttgaactattactaaggtttacagttagttctagtttctatccttgtgataccttgcattagcacatgttttgtcatgcatcttttgggttctagtcgtccaaggaggttgttgaaggtcgttatcgatcagtttcaactgtcaatattatcaaaatagaggagaattagtgatgcttgctatgcatatatatgttagaataataatattccactagtattaggtctactaaccttttgcagagaatgacaataaagtagagaagaatcgacatcaactcagacgataatcaatcggacgatgtcgagaaccagacttatgtatgaatgggccaagaactcagaattaacacgacaaactgggccaaaattcacaagtctgcggagaaaaacaacagaggaggccaccagccaaaccatgggctagttgggttggccccaggttcggccgaacctccctcatcgtcgctggatgcagggtttcttctggacggtgtggattagctcccaatgacggttggagggtatttccgaccattccaaccgtcacaaccgtcattgggaggctatataaacccctcaccttcttacttcactcatacacctcaagcaagagctctctcatttttctcaagtttagtttagtagtatctagctggtggaataggaatagagtagaaatcaggagtccggaagtcttcagaagagttcaggtatggctctagtagcttttctcttctcttttgtaagctttgtacttttattagaatactcttctatatacatttatggtatgaaaatactttccgagtatatgaatgcctactttacattatgttcatgttatactgaatatacggctagcttatctgggagatgctttggtgcgggtataatgtttgcttatgcaattactctatgtcatgacgatgatattagagtagtatctggtagtttagacgtggtgtctagattacgagatatcgttatttggggttatatgctgcggatgagatgtgggccgctgatggtgacagctcagtacgggtattcctctgcgcctgtatataatcctaagttaatttcctggggatggtactcctccgtatttagccctagttgtatagacatgacgggctgtcgtaaggaactcagcagtcaggggtggcttctcgaagtaccaggagggcatcggataaagggtattaactagtatatcggttaactagaatatatgtatactatgtatattagaagtataggaatagattgtctttctcttttctttccacttagcttagataatatattatgagaatgagtagctaatgcttatgtgtcactctacccttgattatcttaacacctgcttaaaatatgattattacaggtaatatttaaattattagtcaagttctctcaacatgatctttccacgagataaaataaataagatacccttggaatactctcgggtgaaatgttataatgatatatccgtgcgcttgtggataaactctttaactataatataccaggagtatttctacgccattgctgaaaattatatttctattaatgtcgttaagaaataccaacaaagtgtaagtgaagctttataagaagattgatcctattaatgtcgttaaaaaataccaacaaagtgtaagtgaagctttataagaagattgatccgttcaagttgtatgaagatgaaggcggtggtgccaagttgcatcttttagttgtatgtatggtcgtaggtcgggatgaaaacggcttggaaatgaatggaaatcagatctactatttttgttttcttttttaactagaatcgaaagtggaaaccccagatacgaaaattacatagaatattatcaaacataaatatggagtaaatatgaatcggagcgtatacggtaacgaatatttatcggaataaaaaataattctaactaagattctaaaatcaacgaagagatgaaggccattatttttttatcacaataaatcagcatttctatttttatcaattaaataataatacacacgtacacttcacttccctaaaaaagtgcaataagcaaaactatattcatctggcattgcctaataaaagaaaataaattaatagtcattaggcaaaagagaaatagatctaaagcaccaaactataaaaaacatctccattcaactaaccacatcaacactcggtgcaaatctgaacatccggaagagaagggtaaagctaatcagctgtatattaaaagcaatttgtttccagttccgagaaaaaaaaattctaaattcgtttctagaaagtttctcatcaatttcggtttccgacaggtagtagcattaccatgtcaatttcagtttccaagaaaatattccgaaatcatttaagtttcctatattttctgaacaaattactcactactaaaaaaggcaaatagctggctgccaggtttttttttgctagcgggcggtggtgccaccagcgacctaaggccaatgaaaataatacatattcactagtggccggtcggccactagtgaaaatcgactttcatagataaccaagctaagatggtcaccgacaaaatacgattttagctgacaactgcgtaaagagacctgccatcgaaaatatttttcaaagcaaaaaaaaaaagaattgaaaatcaggatccaaaacagccagtacagaatcacaaattctcaaaatcccccatcacatacagtccttgcactgtggtcatcgttgtagttggcgagagagagcgtaggtcgtcatctttagatccatgctcgtgaggaatagcatggccgactggtagttgccaatctggcgtcgtcttgcatgcccaccaccgccggatgtggacgtgtgctcgcagtagaggtagtcgttgccaccattgtcactgagccgcaaccctagccaccatcaccactgagggtcagcgtcaccgaggctgcgtatcgagtcgtcgctaagcttgtgggcagagccatcactgaggacggccgccaccagatctagcggtccaaagcactaccgctggctatcttcttgctcctcatcgtagtcgtttcgtccgtttgtccgcgccggttagcaagggagcccgaggtcgccagaactagtgtccatggtctcattggttgtcaatgcggtggcggtatttgtagacggtggttttctcgttggggtatgtgatggtaatgatgcgattcggcggctgccgcctccatggtggtagaggaagggcggtaaaaaggtgatgtcctgaaaaattattttagttccggtcgatattttctgtttcggaaaatacttaaggcatctacaatgtaagacactcttagagtgccctcactaactgagggtactctaggggtactcacctctacaatgtaggccacttctagttagtcaaatgagtgtcccaacccaaaaaagcccctttctctcctcttcctctctttcctattctacccctctcttccctctctctctttctccctccgcacgaccgcacgcacgttcctctctccctccgcccgtcgttccactcgctgcctgcttccctctctctcgccgccacctactgcgcttgccgacgctgcctccctcctcgccctcccttcctctctccgacggcgagcggtcgtatcgaggagacggtggcggtggcctcatcgacgatggcgctgtcgccttcttcatcgcgctgccgccgccgcctccctcctcgccctcccttcttctctccggcggcgagcggcgcctccgcctcgcccttgacgcgtgggccggtaacagaggggagaggggtggaagaggaaatcgaagctatggggtacgtcgcctcaataacctacctatgcaatgggttgcttcactccgtccccttggaaaaagcgagcgagcaacacgttccccatcaggggcgcgcgttctgtcccagggggacgacgcagacagaaagcctaacggacggcgctagggggatgggccgaagcaccgcattggtgatgcccttatcgatatcggaaacatcccgaaccgggacagttggtgcgtgtgtcaagtttggagttttaacagaatcttgtcagttcgtataacgaacttcctgagcggatacgtgttggtggaatatttggaccatctcggtgcgttcccacgtacagttagctcctctgctaattgtatggacagtttgccaataccatcgagcaacaacagaggtaacaggccgcctggttacgcatgggctcagttgacccataatttaatttgttattatttttcccttttcaaacaaaactcttgtggatatttatgtttggtgcattattttttctataagtaatctaatgaccccacataaaattattactaccttaattgtttggaacttactccgctactaccattttaataattgtaagggtgagtgtcaaaattctttccatgcaccatttgactaaaaggcgctaattaattataattataattgttcgggagtgttattaaagttttctttgaggtggcactcacttcaagtgaattggtgtaataattagctgtagctcgttaagcaaaagtcaggatgatattctattacaagcaaaagtatggatgatattctattacattatctaaaaattgactaaaaggcgatagtcttttcacccatactatatcatttcagtgataacaacaccacaacactgccacacgctcctaattagtactccttccgtcctgttttaagtgcaaccatgagttttcgtatccaattttgatcgtctgtctaatttgaaaatttttttaattagtatttttgttgttatgagatgataaaatatgaataacaatttatacgtgatttatatttttaattttttttcaaaaaatttttaaataaggtgaacgattaactagttgagtacggaaaagcatgactgtacttaaaatgggacggatggagtatatattcttactctacagactgtattactgtacgtctgtaccctttatttacagatgcatgcatctagcatggctgcatggggaccatgtccactaattagtccatgcaatgcaatgccccagttcactgcaccagtaagatatacgggcaggtactatatactatacgctacaaatggtcaccaatttgctcacgtgtgcttttttgtctgaccttaattgtcactgtgcatgtgatgaaaggcaagcatgagtccaattttatgtcacgatttgaagcagttacgttgcagccttttttcacatggaatccactaccaactgatcggtcgagttcacacactgcattgcaaggcatggatgtgatcgagttgaagtattgaactcgcgatcgatcgcgcgcgagagctatgtttttgcaggttcgttcgcatcatcatcaatggctagtttgctcggacatccagaggagctcctctaggtagtcggcgccgaggtcctccagctcgaggacgatctgcttgtgctccccgccggtcgtggcggacgtcgtcgtcgtcgtcttgttcgccgtcgccgtggcaccggccagctctgatctcttccgccgctttcgcttggagtgccgccccttcagcgccagcacgggcgagcctccggccgcgccgagcgcgagcgcgcggagcgactcgcgcacgcgttccacggggaagttgagcgccgcggccgcgccccgcgccgagagcgcggcctggtcgtaggccatcgcggcggcctcggccgtctcgaacgtgccgagccacacccgcacgccgttccgcgtggagtccctgatctccgccgcgaacctcccccacggccgcttccgcacgccgatgaagcccgccgccgccgccgccgcccccgccccgccctcctcctttctcgccgccctctcgcggcccgcaccgccgccgggcgccgacacctcggcgctccccgccgtctcgtagtcgtagccagacggctgcgattccgaggatgtcgacgacgccgcgccggcaccggcggctgcggtgacagccatgccgccgccgtagtaccagcagtggctgtgttgctccatgtgtgtgactctgtgagctgggaatgtttgacttagcggctgcgatcactgtgatgtgtgcggcgaagtgacggggcgtgtttgattattccctttccaggaaggcagcggattaaattagcgcggggtttatatagagccccgagagggttgggtggctctgtgggcgacgaattttccaggacggtgcggtggggcccgcgcgtcgacaaatgactatgacatgtagggtcatgaaaacctggaagtttgggcgttgtcgttggacttggctgacgtagggcggctgcataggacaaactagcgggcgtcagcgtacacgatccacacccttgctttgctggtggtgtccactgagcaggcctcggcgcgccttcgttaagtggcccagatcactagatcagaaatggattactgtgtttttaagctagtactccgtatctagcatcaccgatgatccaaggggtagtataagctataacacacgtgtctcaaattagggcttcttattttatttatttacatataagaagcgtcagcgatgatatggaggatggtaacgtactatttgctgcatggacaagcatataggtatataggtggtatttgaatcttctgaagatgaaggtaaagattaaatgttccacgtaaaatgaggtggtaacaacgtgtgcttaattgcgttttaattattacaaacttgaaacatggattaatctgatattttaaaacaacttttatataaaaagttttcgcacgaaacacaccgtttagcagtttgaaaagcgtgccacgaaaatccaaaacttcatctaatgtttgtagtggaaaccagtggcagatttaatttgggggcggggggtcttgagaccccactactgccactgggaccatggagaccctcctaagcccccactaaaaattatttgcatagattcataagatatgggagctgaagactctcctaatttgtttagcccccactattattttgttctagatccacccttggtggaaacgaacgtggccatagccatatactacgtgcttccccaaaaaaaaaaagaagagagagagagcatatactacgtgctgaaaccgcgcaaacaacgaaattgaagagcacctcgcaaaaaaaagaaggaaaaagaaagaaccagttaacagcggccacaacaataggctgtactctggtactagcggctggcgtggaacaatgataagtgggtataccaagaaatggtttccccatcgcaggttgggttgagtttgccttggcatgatggaaatttgggctgcgtggttatgggctgttgggtagctacttactcatttgttacgagcacattttctaaacgaataagtctactatacatccttaactctttcctggatcgaatcatatcccttaaccacaaaaccgggtataacacctttcccaacttaaaaaaccggtgcaaatcgactctttaggtggtttgcgaagcgattttgctgacgtggcataattgacttggtccaagtgcactaatgtggcaatccagtcattaaaggaattaaaactagaagtgggccccacttacaagtgacaagggtaagaataaaaaatggtgggcccacctatcagctccactactactctctcaatctcgaacaaatttttaacacaattttgttttcaaatttagatagcttgcaaaaggacagtgacactgccccttaaatttataaaagtatttcttcaggtttgcaagttcagataatgcaaactgagcaatgagcatgctatattcgtttgatcgatcaaagtcgacaaataaattgtacttcattttataattatcagacggatgcaagtagatctacagtgttgaagaacaaaatgaaacacttgagggttatagcaaggttgagtactacccatcgtacttagcaagtcataccgaatatgggtatgatgcaagggattacaaggacaacataagcgctcatttgtataaagcactagtaaacagttgcggttgaaaacaataaagctatggataatgttaagcaatactccctccgtactcgtaaagaaagtcgtttaggacaatgtttaagtcaaaccttgagaatataaatcatgaataactcttaagttgttaagtttgaaaatataaaaattatatgaatagatttgtcttgaaaaatactatcataaaagtatacatatatcacttttcaataaatatttatagaaacaagaagtcaaagttgtgttttggagactgtgtcgctgtccaaaataacttcctttacgagtacggagggagtattgatcaccgatcaatgctacaccgtgttaatagggcccagccatccacctgtagtatactcccttcgtacttgtaaaggaagtcgttttggacagcgacacggtctccaaaacacaaatttgacttcttgtttctataaaaatatttattgaaaagtggtatatgtatacttttatgaaaatatttttttggacaaatttattcatataatttttacattttcaaactcaacaaattgagagttattcatgatttatattcccaaggtttgacttaaacattatcctaaacgacttcctttacgagtacggagggagtacctattctaatattccattaagtcaatttaattaagagtgtgactaatcacggtgaatcttggtcaatcacccataacagcgggcttgactatttgaatagttttactttgactaaaggtgtacaactatactcagaagacacatcccccatgcatgtctccatacaccagcgtatcgccatggtaccctagtaagaggctgtgataggaccctttgcataaccatttacaccacgttgaggttttgcccctacccagaccaggataggtgctagtatttcttacggttatagataaatccgcaagatcacggataccgatctagcattttaccctggagtattccaagtgtgctgtatttatatttctgcaggaaaggtaatggtgtaaagatagagttcatacatccttaatcaagctataattactttactatagtctaaacatgggttaattgataaatgataatgggtaatgtgacacacaggagattttctctaataaatatacactaggcagtggagaagaactatagaaagctaaggttcatatgtacttgtatattactaatgtttagtagtttacatttaacacatacatgcttacaaagctagcacttaattctaagcacacatgtactaccgagagaccactccctattggtctgccagcgtggttatggtattttacaaactcttacgtcatacccgggcgtggcagaatacaagggacgaacatggctgtcaccacctgccacctgccatctacctcactttccgtggggcatacctacatccaacgatatttagctaacctaagaaccatccttatgttaataaataatgtcaccatttcccccaggactcccacctttcagatggataagttggaactagtgcaatccgttaagatcattggaccgttaccgtagcatagatcgactagcctaatcgatcaaatgaagcatataaataaagtacaatctactcatagagcacacatctagtaaactagtagataattcctttattacaactatagtcttacaagaagggtaaagtactcaaggcatacaggaatctccgagaagactatagaaccaaagactattgtaaccctaactccactactactagatataatacaatatggaatgagagaattgcttcttgaagtgtgtgttgaaagtgaagaatctcctctccttttatagcctcctaatgatggttgtatggcggattggcggttactgaggtcggtgcgctcctaaccgtcattagggagggctgagatgttgccacatggaagatgaagatgaggggtagccatggcggttcggccgacccctgggccccacctctctccactgcctttcaccaaaggctgccagatgggcccctatggtggttgaggatggtttggccccactttaggtcggtttggactgacttgtgagcccatcaatccatggactcgtacgtgattcactggaggtatgttttttttgcatgccggctcattcccccttcactttattgtgtaatctctgcatgcacattaattcttcaagacaagtggaactacattatttaatactagcatacatataagaaatgttagttctcttttatttattatggtagttgacggtcgaaattggtacttaacaactgtcaactaacaccccaagctaaacttttgcttgtcctcgagtaaagataaaacttaggttgtttatgatcaggagttgctaccatgttttatgtcacaacagtatcatgcccacaaaatatccttctacctagaatttgaataagttggcaacaatactttaacctctcttatcatactcccatgggttttttagcttctcctcgtcttgggtagttgagaggtagaacggatcgtagagcattaatcacttagtctttgttaaactttctttatggaggttttcaagaattttgcaataaaaccaaagttcctccaatgatactctcagatcgctcaatgtgtacaatttctcaccaaggcgtagtgttgcatctttttcatcctacctctaaaaggtttatagtggagctcaaggtgagaaaaaataatgagacaatactttgtacacatattttgcaaaatcaaagagaggatccaaggaagaaagcaaatcatacaatatgatcaagatgtgcaaagtgtgtggctatatggtggaaggtggtatgtggtactcctttgtcataggctctctttattcctaattggagatatgactatttttgttctaactatttttctcatgttgctcaggaattattgtgagcatacactccttttctcctttttctcataatatgcttgagagcattttctattttctacctcctccttttttttttctagagccatatgttttgcgaactgctaggagcaatttctttactgacatgaatggagtatttatttggtggatgaaaatgttgctaaccgcagtgaagaggacatcaataccgcccatacatcgacgtgtacacaagtacaacttcatggttctattacccgcgctcatgcgcatcaactcaactatcagatgagttcattcgtgagttcatgttcatctgatttatactctcgagacacgtgcattcttgttttaattaggaatgatggagaggatcaacaggggagaggattcatgtgggctggattcagactgcagaacatcaccaacttatgacgaccaccacgactttatgcggactccgttttgcgcgtgcgcataaaaagtttgactgttttgagctccacataacaaataaaacaaacatgcaatggtacatatgctgtgctaaattcccaacatagaacttataaaaatgtaaaaaaaattgagaaatagagtagtacaaattaagtataactaacctttggcgcaatagatctatcaaaccattcgagttcaaaacattctccccctatgtttgtgttcataagagagagaaaatcgtgcttaaatagcatggcagttaaggctcgaccttatataggagaagctattttcactagcggacaacttaagccaacaccatagaaaaaagtaggagtggcggtggcttaagtgggccgcagcgaaaatatcttcatcttcactggcgacccacgtcactagtccgtcatcaaagattttccatcttcgctggcggtcacttaggtgtgccaccagtgaaaacctcaacagcttcattggcggcccgcttaatttggccgccagctgttggcggctgttaaatgccgattttataccgccaacatctgcataaaagttcagataataaaatatccaacatagtaataggtgcttaatctcacatattccacaagtgttggtatatatttgtatgcagataataaaccctaaagttgggaggaaaatcaaactaaagtgaggagaaatgtgtatccatgcatggatgggttgtgaacttcatcaaaatgcccgagaatcaacccaaaatcttgagaaaatagatagaggaggtccagggggaagatgggccaagagccaggccagatgggcctagcccaggttcggccgaaccaaaatctcagccatccaggctggggtttggcgtggacggtcctgatcatctcctgatggcggttgcgaggcatttccgacaattcgcattgtataaccgtcatacctacccctatataaggacatcatctcactcactttaacacacacttccaagcttgaactgaattatacaaggctctattgtactatattgtatactagaataggaagagagtagagtagaagaagtcggaagaattccggagttgtcggtaatcttctcctatttcttttattttgtttattactctgaattcaatataatattcttcctgaataatttagatttatcttgtgagaattatctcttgattagttcctaaacagcatatgggattattgttcactataaccaactaaaaatataatgtttgctttgttgagttataaacactaaagtagatattaattgcttagacgtggtgtttaggtagttgttatccagtaattgctgcgtatcgcacagtacgtttgaggtaggtgta

SEQ ID NO: 39583 - DNA, 8354 bp, Oryza sativa
ggtttcgcgtatggccgccagcgaaaagttttgtgtaacgccatgaaaaattatttttctagtagtgattgcatatatcagtcatgtagggaaagattaattatgtcccaaaatgtccaaaacccaaaatgaaatatatattgattagtgaacgtattccgtatgtagcaaataaaactaagatttttggatttgataacaatattgagccttcagtgccagtgtccagtacgttattccaaactgtgtgcacctggtgtagtatttagtttttttaaaataatgttgaacgaagtttgccaacatgttttattatgtttgccggggaacggttgctgatcatttccaaaccttgttcatcctcgtatcctttttacttttttatctctagctctgcccctgctatccgagaaaagtattcttgttaaactcttcttgatcatggagcaacctctttttgagctgtccgctccttgaggcgaattctatgagccatctccttcatcggagcccatatatacaactggctatgaaattcgccccgagctaatcaatatggttaaggaaaatcctttttctaactttgatccagaaaatccctaccatcatctccgagactttgagcaagtctgctcatgccttaagattcgtggcatgagacaagaaactgtgcggcggaaattgtttccattctctcttccagaaagggcaaagcaatggtacacctctaccgttggatgtgtaaacggtagttgggaaaagttgcaagacagattctgtcttgccttcttcccagttactcgtatcactgcccttcgagtagaaattctcagttttaagcagatcaaaaacgaattaatcggtgcagcttggtccagattcactaatttagtgcagtccggaccaaccctgtccttcctcgagtatgtgctactacagcatttccatatgggtctagataaggagtctgcattttatctggacataaccgccagaggatcgttcatgcacaaaatgccgtcggaaggaagaacaattttggatcaaattctagaaaatacttccttcatgacgcaatccgatgaaccccagacagaggcatctgtgtcaaagatagaggaacctctaacgattgagccactctctgaaccatccacttttgctagcttgattgatgagaaggttcctgagcagccgtccgtcgaggatgaagaaattcagactccggatcatgccgcaattctgtttagggatggttttgacgaagattatggcaataccctgaactatttcagtaagaataaaccactcattcctttgtcgcctctcgatcctatggaacttggcttcttaagggaaactgttcgggagctaacatccataatgagcgatgaatggctaagggaggtatagctttcatccgaagtaattcgggtaaataccgctccccgaatcattcgctgccatctggaagggaacgacgtcggtattctctacagcccgatcgtcgaggtcaatctcatttctgagtcttttgcattcgcttatctaagcgataaggcaataaccccaacgaacaaattcttcaagcatccgaacgggaatatcattgaaggatttgggattgtacaagatgtgcatgtctgctttgaagatagggaggcgatcttggatttccacgtctttggaattcaagactttgacatcctaatcgggctacccattgagcagcttcttattaacacaccccgattagacagcctcaaaataactctaggaggaaatgaattttcagttccattctcacgggcaaggatcgccctaaccgaccctctcccagaaattgagtcagcagaggaggttaccgcagttccccctcacaagtctcccgaggcccttctggaagatgaagtccccgatttcatcaaggaagaagcggatcccggtgagactctcgatctgccaatcatcgaaccgctacctcgacttccgcttgagctaaaacctctacctccgggcctatgctatgctttcctacacaatgacagagaagctcctatcataattagtgacaagctctctgaagacgagactcaacgtcttctcatcgtgttggaaaatcatcgttctgttcttggctattcccttcaagatctcagggggattaatcccgcactttgcactcttcgtatccctattgaccccgagagtactccctttagggaacctcaatgacggctcaataatgcgacgcgagaggttgtaaagaaagaggtcttgaaactcctacatgccgggattatttatcccgtaccatacagtgagtgggttagcccagtccaggttgtgccaaagaagggaggaatgacggtcgttgcaaatgctcaaaatgaacttatcccgcaacgaaccgtaaccggatggaggatgtgcatcgactacaggaagcttaacaaggctacgaagaatgatcatttcccactacccttcattgatgaaatgttggaacggctggcaaatcattctttcttctgtttccttgatgggtattccgggtatcatcaaattcccatccatccagaggaccaaagtaagactacgttcacatttccatacaacacctatgcctatcataggatgtctttcgaactgtgcaacgcgcctgcatcttttcaaagatgtatgatgtctattttctcggatatgatcgaggacattatggaagtcttcatggatgacttatctgtctatggaaagaccttcggtcattgtctgcagaatttagacaaggtcttacaacgatgccaagagaaggatctggtacttaattgggaaaagtaccatttcatggtccgtgaagggatagttcttggccaccgagtgtccgaacgaggaatcgaagttgatcgtgctaaaatcgatgttatagatcagcttcctcctcctgtgaacatcaagggaatccgcagcttcttgggacacgccggcttttatagaaggttcatcaaggacttttctacaatcgcccgacctctgaccaatctgctagccaaggatgcaccctttgagttcgatgacacgtgcctgaaatcttttgaaatccttaaaaaggcacttgtctctgttccaatcattcaaccgcctgattggactctgcccttcgagatcatgtgtgatgcaagcgatttcgccattggtgcagtcttgggccaaaccaaggataaaaagcatcatgcagtctgttacactagaaaaactctaaccagagcctggttgaattatgcttctactgaaaaagagctgctcgcggttgtttttgctattgataagtttagatcttacttagtgggagctaaggtaataatttatactgatcatactgctctaaagtacctactcagtatgaaagatgctaagccacatctcttaagatggatcttgctactccaagaatttgacttggaaattatggataagaagggagtagaaaattccgtagcagatcatttgtttaggctgcagaccactgacacacaggaacaaccgataaatgacttcttgagagatgacatgctgatgacggttcgcgactccaacccgtggtatgccaacatagtaaactatatggtatccatgtacataccaccaggggaaaactagcgaaagctgaagtacgaaagtcgctgtcatatatgggatgagccatacttatatcgagtctgttttgatggcttatgcctcaccctatggtggccattatggtgctttccgcacccaggctaagacttgacaaagtggcttcttctggccaacaatgtatgaagactcaaaagaattcgttagaagatgcacaaactgccagaagcaaggaggaatcactactcaagatgcaatgcccctcacatacaatttgcaagtcgagatatttgatgtttggggtatagactttatgggacttttccctaagtctcgcaactatgagtacattctggtggcagtcgactatgtctccaaatgggttgaggctatgccgtgcagcgccgcggatgcgaagcatgccaagaagatgttcacagaaaccatcttcccaagatttggtacccctaggatggtcataagtgacggaggttctcacttcattgacaaaaccttccgagacctcctacgagagatgggagccaaacacaatgtggccactccataccatccacagactagcggtcaagcaaaaacattaaacaaacagatcaagaatattctgcaaaatacggtcaacaaaatgggaacatgatggaaggatagattgccggacacacttgtcacgccctaaaaatcgtctaatgtaaaaatacattgtttaaatcatttttagaaattaaaattaaaagcctacaagctaaaccctaattatctaggaaaattttcaacataaaaatgagctagataaaattttattaaatactttgcttgttcctctattttctagaattttctgggaattgtttgagcaagggaagtatttttaataattggaacaacatttcacaaattattttaattaaaaagttcaaaaaacccttccttaagtggttgggccgtttttggcccaactttttccccctcccgcgcagccgagccggcccagcgccgcccaagtcggctcaagccgagccgcccgcccctcctctcatgggacaccgacatgtggggcccacatgtcgggcccttctcctacctccggccggccggccttgctagcccgagccgccccttttcccctccaaatccacctcgaatccggccaccccgagtccctttttttgaggggtttttatcctctcgttctcctctatctttaacctcaaaaatcggagcaaatcgttgagtattttatccgaatcgaactcgttttcgagtttatctctaaaaccgagtttttgatttcccgagtcgatttcttgcgggaggagtccgatctcttcaatccaaggctatatataggaccccctagccctcctctttcgtttgccccatcacccgtcccctcccgtgccccgtagctcgccgccgacgccgcctagcctcgccgtcgccgccggcgatctccagccgcgccgcctccgccgtcgccgtcggtcgtcgccaccgtcgtgggcttcaccacgccgtagggaagcacggccaccctctcctttccgccgccggccgccgtagcccgctaccaccgcgcaagccgagccgccgccgccatcccctcgtcaccggccgtcgtcgttcgtcggtagacgtgttggtgagcaccgttgcgttcatctcgtcgtcctccacgtgttcttgtcctcctaatccgcagccggccgctctatctccggcgaggtcgccatcgtggttcggccgccattgatgaagtcatcatgtcatcatcggtttttttctttttcccgtttttctaatagattaaatcttcggaaaatcataactaaataaccgtcgatccgttttaggtggttcaagttgctaaatttttctaaaaccgagatctacatgttaaaaatatccacatgtactgtttatgcttgtttttatactgttttgttgatttttgtttaattgctttagtttccgacgttccggaggagagtgtttccgttgaggaaggttccgaagcgtttgcggaagcccaaggcaagtcacacagatcccaaacaaccatttgagcatgttgaacccacttaaagctattattttatttcaactatgcattgtttttgaatgtcatcgggtggtgaaccttttccaattaattaatggccgaagatgatcttattttcctatgggttataatttgattagcatgaaccttatatgttggattggttcagctaaatgctatatgtaagtttgcttagccatgcttagaaacattagctaactaaagggattaattataaactatgttatattattattaattatggttacattaaatggtagctcacgatggttaatcgtgtgatgttaattaattgataattaaaacctggttaaggtgggttgtgagcatatggttttgatggttgtgctcatgacaattaaggaccggttcgcgagctacttttgtgaaacatttatcgtgccaaccacaagccagcgtgggcaacagctttatcttttgtatagcatgattcattatagtgcgccagactgtgaagcggcgagaagtccgtgggggtcgctggggagtccattgcctctggttttgagggggagattatgatccaggaacggtgcactgcggtgagttgtgttgtgcaaggggtattgtcacagttcctttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtctcacactactcatcaatgttaataatgtgataattaatttgactcctggtttggaatggataattcctagtttggaggtttaatttgttcaactggggttggttgttcaaatgtggttgggcctatgcaacatgggtgtgttgtatggtgtttatttaatattgattaattatacaactgttttactattctcttaaatatttgttaaatgctgttatgcaaatgagctatattatgccatcctttgttatcttgtgcacttgcatatttgctgtgtggcttgttgagtatgttatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatccacctctgtaataatttattatttgtgaatattaaatagttatttatttgtactctattatcaatttgttattgtgtgcctcggttgattcctggacgagggtttaacacacatgtaagcgtttggaattttggatagaaattccgggcgtgacaacactgtgggcataccggacagcatacaagacacccattggaatgtcgccatatcaggtagtctatgggaagtcatgttgactacctgtagaactcgagcacagagcatattgggccatcaggaactggaacatggactttgagggagcaggagaatggagaaaaatgcaaattgctgaacttgaagaatggagagagaaggcttaccacaacgtaaggatatacaaagaaaggatgaagcgctggcatgacaaaaggataaagatcaagaaattcaagtcaagagacaaagtactaatgttcaactccagggttaagctttttggccactgaaaactgcgcagtaaatgggaaggaccgttcgacgtcatcgacacctcttcgcacggggcaatcacactccgcgatgactcaggttttgaataactgtgggggagatatcccagcttctgacgtgcatatactctgaaaattgttgaatctctgaacacctagaaggaactgaactcagcagaaaattgcagagggattaggcaccagagtggttcggccgaaccagtgttggccctaattgcccacaatttttacaggtaagtaggtaagcacgtctattatctgtatatctctaccatggtatagtactagaggtgaaaatttaggaaacacttggttcaagcataagtgaaagataaaatttccaactaatgaaattcttcatatgattgatcttgtataatcattattctcagccgaacttgtgcttgtgaacaaccatccatgtgtagggaaccttatgcatctaggtaattgcttcatgtgagatgatttatgatgaaaggaatttttgcaactcttgttatgactattgggaatttgttttcaaaataaaatttgttttaaaagctcattcctccaattgacttcattttatacctactaaggccatatgcaagtatatcaatgatcaaccttattacgcatattactgcttgacattatattgagctttgtcaaatttgtgtgactcgtgttagatatctttcatactctcatgatcaaggggtcaatttcactttcatttccacatacatgataaaaagctaagcttctacactggaagttggcttctcacgaaaaattccattcgaataaactcctacattagactatgctttcttgtcctagaaaagtttttggtaaaaagaaaatgagaaaagcagggaaaggcatggct

SEQ ID NO: 39584 - DNA, 29558 bp, Oryza sativa
  unsure (1)..(29558): unsure at all n locations
aaaatcccatgagtctgacagagaagcaagaaggactggaatcaggatcattccatctatcaattactcaagatggtaagatagccactgataaagttcacaagtataggtatggttatgaatggtgtatatgcatgatccagagttgtcggtaatcttctccaatttcttttattctgtttattactctgaattcaatataatattcttcctgagtaatttagatttatcttgtgagaattatctcttggttagttcctaaacaacatacgggattattgtttactgtaaccaactaaaatatagtgattgctttggtgagtttttttttttgcggggaacgggagatatattactcggcaacagcctccttacgagccacgtgagaaataaagttacaagagttatctggcctgaacttagttaagctattactacggcccaaattggccaacaagtggctcagatgattttgatttctatgaatcttgcacagctttacctccctgcttcccatcaagaggtcacgaacctccctgactaagaacaccatgtctgaacgcaccattgaatcggactgaacaagttgcttcgccatcagactgtctgtctctacgacaatcggaagaagagtccattgtagcgccaaggaaagcccatctctgcaagagaggagttcagcttccagcgcactgccgtagcgatccacaaatccagacgctgcaaaaattacttctccttccgcgttccgcagtactgcaccgattcctccttgcccgtcgctagcttggaaggacccatccacattcaacttcatccagatgcctgtggtatctgccattttgggctctcgtcacactgtatctgaactgacacactgggcttcgacgcgcgagcatccaccacatgtttgcccttaacaaggttggctcttgatgttgcttgatttctgccaaagagtggatatagctttcaatgaatctttttgatgctgcaatccccggaacaggcttgccatgggtaacctcattccgcgcgtgccagatacgccacagtgtcatcagagtaacagccctctcagactctgcaatccttcctaggtgatcaagaatccctggtgtactccccgcggcaatgccggacggaagcaccctacgcagatcaacccccatcgcttcccaaaacagacaagcgtgtgggcatcggtagagtgcatggccagtgtcttcagtttcaacaccgcatatgctgcacacgttcgacacctccagcttccttttcttcttgttctccagcgtcggaaggcagttagtgactgcacgccacacaaagattttaactttttgtggaacattgcacttccaaaccatattccatgccttacttaggttgctgtctgacgagcttgacccctcctcagcacgcgccagtgatactgccaaactatatgcacttcttactgatttcttttattctttttattacttctgagttctcaatagcaattattcttgcctgaggtatatttagaatttattcttgtcaagaattattctcttggttaggttcctaaatagcatatgggattattgttcactataatcaactaaaatatagcgattgttttggtgagttataaacactaaagtatatattaattgcttagacgtggtgttttggtagttgttatccagtaattgctgcgtatcccacagtacgtttgaggtaggtatagaggtggtgacagccctcgagatcacttaagtcctccctgtccgggtacgtagtagagcgacatctgagaacagcgggttgccagtgcctgaagtattgcattaggattaaagttaagctttccctagacactgtttctcactactaaatcctctgtatccttgcctatcatctgcttggtgtcctaggatgaaccggaggaagatctgaccacacacgttcccttggattcgatatccttggaatactccgtaggggaagtgctacatcggtatatccgtgcgcttgtggattctatctgtgatcgtaagaaataccaacaccagtgaagatcggttttcgctggcagtcctaagccccccacccttcctgatgttgttgctggcggtttcgcgtatggccgccagcgaaaagttgtgtgacgccatgaaaaattatttttctagtagtgattgcatatatcagtcatgcagggaaagtttaattatgtcccaaaatgtccaaaacccagaatgaaatatatattgattagtgaacgtattccgtatgtagcaaataaaactaagtttttttggatttgataacaatattgagccttcagatgccagtctccagtacgttataccaaactgtgtgcacctggtgtagtatttagttttttaaaataatgttgaacgaagtttgccaacatgttttattaagtctatcattttgcagcaataattacattttaccaaatagaactattaatttttcactctatttttatcaaatgtgataacatacgattgccaaatttttttccgaacatttatataacagaaccaacatataatctatacttcttgaaaaaaaaagttattgttggtggcagtgaatctgccatcccatctactaccattgtaaattttacaagttaatgcctgaacttcttaataacaaaaagaatcaaatcttaactaatgaaaggtaaaacttaaaatgaaacgaggataaatgaagataaatgaaatattagccgttggatttactacaaaacaaaagaggataaatgaagcttgaccgttggattagatggatggtgaaaataataatttaagaggtttctgaagatgaaactactagaaggaaagaaagaaaggaatgggaaaagctaaagaataaacatatgaaggtataatgctatacatataatttacgatttgcatctattgtaaaaactattttactaataaaccctcatcataacaaaagaatcatgggtcaagaatcaagattgagctatttcaagtatatacaaaatgtatgttcatttgattaatttttttctaacaattaattttaatatatttgagaaaaaaaatacaataagtacatgcacaattatggtcgcccaaatataagtttaatgattttcacacgaatttaaatgaaatcaaacccattccttaaaaacctacaaaatatttgtgcatagactaaaaaagcacgtgccaaaaaaagtaagagggtcctgcaatcacgaagacctacaagactataataaaatttgtaacaaatattaagctatttagtgtattatcataatattagtcaatctaacctatgttttttgtatgagcaacgagaaactcatacaaaagattaccagtggtttttttgtaattttaatatgtttttttttgtaatttaccactcccacataccacataatagaagacctagagtcgcgtgaatgtgcgatatcataggctagtctaaatggattgccatataaaaaatcagaggaagtctctatagcaaaaagatgggtaacacattaatacattttttttttcttttagctagttaccattatagcataggcaagcagtgaattagttctcccaaaaggcaaggaaaagtgatcaaagtttttttttgagggaaaaagtgaacaaagttatgcagaatctgctagcttgcacataatgcttcaaaagtctgtaaggatatgatgtatatataataccgtgttgtagatatgtactcttgtagcacaccatgcatgtccatatgtatgaatttctcgagccaattccccgctagattttccttttgttcattcagttcatcttcttgtacacactagctagtattccgtttaacaacaagctgaaagtgtttaatggtagcttaacgtatttttgagttactctcttttaccttaattactcgagggagcatagaaagttgttaagtacagtgaatttcgagagtaaaatcacggtcatactagtacatataaatgttgatagtactaatttgggcacatgccatacaaagtttaataatattattatgtgtacccatggggcaagatgcatgcatcaagctagctagcttttgggaagtaggtccttgtgtccgataaagacataaagttcagtccccgcccaaagtacacaccttgaaaatacttcagcatgttgtgcgtataatatggtggtgaccaccaaattgttgcttgctccagcatgtgttgcattgtctgcactttattggcactctagagagagccagacagcaagtagtaggatgcaataacacacatgcatgtgttcaagtagtacttgcagttgcatacttgcatgtgttcaagtagtacttccagttgcagttgcatacttgcatgcagctttttgcagtttgcacgttccattgcaactgcatgcgcgcgaaatgtaattcgcaagaggtgccttgcaaattgccaaccttttggatgatcagtcagcagggtcactaccaccattgatctccgacagccagagaagctcctccaggtactcggcgccgaggtcctcaagctccacgacgaaccgcttctgctcgtccgtcgtcgcagtagtcaattccgtgctcttgctgatcctccgcgtctgcggcgtggcattcgccgtcgcggcggtggcggcggcggcggcgagtagttcagctttcttgcgccgctttcgcttcgagtgccgccgcttcagcgccagcacgggggagcccccggccgcgccgagggagagcgcgtggagcgactcgcggacgcgctccacggggaagttgagcgccgcggcggcgccacgcgccgagagcgcggcctggtcgtaggccatcgcggcggcctcggcgctgtcgaacgtgccgatccacacccgcgcgccgttccgcgtcgagtcccggatctccgccgcgaacctgccccacggccgcctccgcaccccgatgaacgccgccgccgcctccgtctgtccccgaccttgacgatgatcaccgcccgcgctcctcctcctccccgccacggaggatggcgcaggtgtctcgtcgggccagcccgtgtcgaaccgaagcatctccgaggaggaagacgacgaagacgaggaggaggaggaggaggacgcggcggcgtctgccgtgtagccgatgtacatgccggcgtggctgaaatgctctgccattgatttgcgcgcttggattggatagagagatcgatggtggcgtggattgacttttagctgctgattggttccaggaaggcagcgaatcgggtagcgaggtttatatagagctcgctaagagcatgtacaatagcatgctataagccagctgtaaacatattttaagaagataaataaagagagagatgggcagcgggctacagatttgtaaccagctgtagcacggactccaagatgcagtgtgtgtatgacagatgggaccaagtattaatagtgtagtatgtaattattatatgaatgagctattagattggctataaataaattggagtccgtagttggctatactattaaacttactctaagtgcagttggagggattaatatagtgttcatagggcattagggcggcagggttgtggggcccataaatgggctgtcgcttttaacgggaaaggcgtctggtcgtgtagggcacatctggcatgtggctgacatagggcggctggataggacaaaagtatatgacgtaagcgatcccactgtgtgatagtggtatgtggagtactggagtgtgctgttgccttgttcgtacgtgaagaagcttttgcttactaggaacagtgttccccaatttagatcgagatatttctgaaaaagtaaaatgtataggtgctctcttgtagctcctagtacatttttattcttaaacattgataataatgattggaatttaatcatgttaaggctggtttccattggggttgggagcccttctcaagtacgtaaaatggagaggtagattagtgcatgcttgattaagtattagctaaacaaacttaaaaaattaattaatatgattttcaagtaactttcctatagaactttttttttttgcaaaaacacaccggttagtagtttcacgaaaagtatcagtggaaaacgaaggattagaaattggattttaggctagcagtggatgcgatatgccttgcatccccacctcttccttccctatgttaacctcttccttccctatgttgtgcgggaatggctagcctagatttcttacaatttaatcttttctaaaacttattttataaacaaaactctcaagaaaacttatgatattaataaatctttttttggtgcaaatgacgctgacgccgtggccattcccctgccaccatggaatcccggtcgacggggcacccgggggatgacgccaatgacattggcaccttgggtcaacccataatgctagcatcatttgtgccatccactgagaaggactaagccgcgcgggatctcccccctcccccaacctcatttcccccctgcctgagtgaagaacagggagggttcctcccttccctctctctccttcctcacctcttcttcttaaatgtgatcgatttggagatgttttttatgggatttgttggcggaaatcgaagagcgcggtatactcacattctccttggtccatccaagaacatctttcacttgcaaccttagttcatctatagtgggatgggtgggaataaaaatgtccttcaacatcatatcctcgaactcaatatgtgcaccaatataacgtttaattaaccaacctacaacgtagtaaagacgagcaagtctatccatctacaccgaaaacgtattattataatcttttgaaaatagtctatcattcttcctaaatgtcgtacaaacccaaaagtttctttatcaatgcataaattaagattgaccacaacataagcctaaaaaatgttatcaactactagcctacaacaaatatttaattgacatggaaaaaataccctaaaaatataaatcgtgtcctaaccatacattagtctatcatatatacaatgaacacatacaaaaatcaaatgcatggctcacatctatcatatcgatccgtacccaacaataaacctaacacatatgctctcaatttaactagcgagtagagttgcgcgttcgcgcgacccaagcctcctgtctattagatttggtaggaagtgttgttacatttttttatctctaataaacaatattgttgtgataataaatagttaacatgtctaacgtgtaaaaattattgtaaatataatattggaaggttctaaattatgtatattattagcatgtattatattttaaatatttgcccaaatattttttcatttaaaaaattattcagacagatatttaaaatataataactgctaataaacttgtggagaaccctgttgttttgtattataaactttagtttaagtcattctattgaaaggaagcattgcacgtgacaacacaagcgaaaagaggcggcaccactatctgttggcatgcaatggcaactcctcaacccttttatcttgttcattcatgttttatttctccatgtacaccaacgcttcttccatcccaactcaacacgttccaccatctcctctctaacctgatattttttggatgtagctgtatttatggcaccatattttacaccaaaattagtcataattgtttttacagtatgtaaattacatacacccacattgtaattgcaccgtaaattttaaaactcaaattgtaattacattgtaaaatttaatatttacattgtatacttttctaatacacaatgtataagagaattagaattaaaagtaatttattatctacttggaaaatgagactggagagataaaagcatagttacatatgggagaaagcaatcatatggagaaaaagtgactgaaattaaataaaaaatgcggtgccatatttttttgcaaacccatattttttttctaattttgtatttttttaatgatatttttgtttttgccaaagttatctatgattgtgtttttactcccacatgtattccctagatccttctaatggaagcctcctcactgttctccttctctccatatttttagcccttctttccaaatccaatggctcatattttaaagcgtacgtggctcaatcaggaaatgaataaactttcgtcattcaatatgatgatgcctaaattcatttttccatatactccatacacatagtcactaaacaattccagtggcaagtatacatttgaaaaaaaaaatcgaagagtgtcacaacctgaagtttccccccttttcttgctttaaaaattggataaataaattgcccgaagaaattatcttaattaacctagagctaaatccctagttaataaatgcaattaataatcggaaatagcgtggtggaatttttcttgagttccccatgctccaatgcattaataagatttttagtggaattttcagagccttggaaataattttaaccaattaaaaatcaccaaagtgcaattttaaatcccaggaaaaatcctttcttctttttctttttcttttccttcttttttctcttttgggccgtcggcccactccctcccgcgctcggcctccttcctttgggccggcccgttcccctttcccctctcttcgggacgctgacaggtggggcccacctgtcaggtcgtccccttcctccagccgccagccccacgacggcaaccgccgccgaaaccgtccgcgccgccgccttctccgctccacgccgcgcccccactccgcgtccccacgtcgccgccctccccgccattcccgcccgcacgcgcgcccgcaaatgggcgggattcaatttgaatccccccactctctctctctccctcccacgtcgccggccaaatcggggggtttcccgaccatgtccgcccctctcgagcccctataaagcttccccgcatctccctctcccttttccccttttcgtcgcgctctcccgtgcctcctaccggtcgcgcgccgctcgctactagctccgccgcttgccgccacctccggtcgcgcgccgcagccgctagagccgccgccgcgccaagccgccgccgccattagcattgccgccgcgtgagccaccttggccgccgctcggtttccgctaaaccccaccggagcccggttctcctcgcacaccggtgccgccgccgcccgtccgcccctcctcgtcgccaggtcgtcgccgccaccttcatcctccgctccggccgccatactcgccggtgaggatccccccctcctccctcttcccctctctctcgtttgcgccgcctctctccacgcgctggccgtcgctttcggtcgacgccgccgtcctgtaccccgtccgccgtcgcttcccgcgccgccgattgccctcgccggcgaccgtgcgcgtcgccgccggttgccatggccggccggccggttttgaagctgagccgagccgtgcctagccgccgccgtgccgtccgatcggcctcccggccgatccggaccgtcggtcccgtggaccggcggtggaccacccgtgtggtcccggtccacggtagaccggccaccttgagccactgcccgtggggcccacatgccggcgcccccttcctcacccctttgagccgctgacccgtgggccccgcctgtcggcgccgccccccccttggatgacgtcagccctgggtattattgcgcaataattaattaagtactttttctttattagtaaaaacacagtttatcttctaaaattcataagtaattcatccaagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttcttgaagacattgctgaggtctcatcagttcgagagcaaggcaagtcatgcaatacgtttgatcatattttacccaatttaccaatatcccgcatttctattaaatgttgcattcttttacaatgtaatgtgggatgggtcctattccttagccacatattggttaccttatgccattgataacttgggtatcaaaatgactagatgttggcttaggaaatgcttagccatgcttagttcaactaggacacaaatggggatcacattattacatagactctgactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttactacaaacgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttaacttaatgaacttgtgtagttcaggtggttggttgggcctgttgcaacgtggtgtagtgttggacagtgattggttaatattgattaattactacagctgttttactgctttcaactactgctttgaaatacctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacaaagagcctaccagcacattgctcacaagtaacaatacaagcctcaaatctcacattgcaaggcataaaataacaaatttgagcaaaaagtgattcctagggctatcttccaaactccaatttcaaccgattaaaatggaaaaaaataaggggaatttaggagtataccttgctcttcaatttccgcaagaaataccgcggaaaacaacactaaatcgaccggatttgaggaagagaggtgacagggagagagaggggagcaaaacgaagccgtcttcagttatgtatggtgtgcacaatgcgtaagattgtgtatgtcttatccttgagcctatgtagattagcgtgaatgcacgcctcgtgccatcaacagcatcaagaagcaccgcattacccagaggggatacctgctttatctagatgtgaccgagttcaaggaggattcgacatggcagtttatctattaattagaaagagtttgttagtttccttttaactctaggaaagtgtgtttagtatccaataaggacttcatgtttttcttttatatttagggaagtttctttcttgtccaataagaactagtatctatccatgggtataaatatgtacaatcggggtcattgtaaactatctccacgattaatacaaattcggcgcatcgccacccttttttacctttctatttttttcgacaagtttatgctaagacttgtcatggttgtttacatcggcggggatagtgctttgacactctaatcttgtcaatgtaagcacttacctattatatatcttaattaatctagtttggtagttcaatttacttgtatcggctgatattcgttttagggtttatgccggtatcgactaaattgctttaccagattatattagctaaggtatctaccatcctgaaaatcagtcaagggcttgattgtctagatattatgtttcttttcatacttagtgttgtatcagttaagtttgatctactaagtcgtgtttagaaccataatctctagcctgctttttgattgccaataacggtttcatcggagtttcagccgatgaggtatctagacgttgcatcggcttataaggattatatacaagatagattcagtcgattgcgacaaagatttcattgtttatctaattgtttggatttcatgacatcggtcctccagccgatgtatgctttaaccttcggatcattgcttattctatcatattattattagccgattggtttctactagattatattgctatttatcatcatcacctgattgtctttatattattatatatattggacatatagctgatagctcaaaatcctatcgatattggctggcatcggcatcggcattggctgaactactccattggcttgtcaatcgatcggctctttgatctgttatctatatatcttgttagttgcaggatcaaactgactggcacgtccacatctcaacaacctttggacctgcactggagctaaggagatctctcactctctcaggacgttgctgttgtcgacttagttcgcgccaacacagatatggtattatcggccaagcgtagatttttcatcaacagtgtataaatgaacttttctctttatctttgtaaaatgatgaactcttttcagcaaatgaattaatcaagaacacactaaaagtatccaatattcagtctatgatcatgtgcaggttgcagcgtttttgagagaacttttaacagaacatattctgaaatcaagaacaattaacattaagttcggaaataaacaatagaaacggacatttagtctaagatgatgaaaaacaaaagtgagaataatgaattttaaacctatctccaacttattttcagacttggtggtggaccaatatccctatggtttgggggataatgagccctgatttccaccttcccgggccaaaccgaatgcgatttttgtcagcacaaggattttttccccacgtggtgggcttccccgaaggggcagggcaaaaggccggtatcccgcccggccttttgccctctatccgatcgaacgaggcctaatcaattggtagagagatggttgagggaggctaattaattggtggaggtgctacactagctagttttcactagaaagagaggaggcagtggctagaggatgaagatggcctgatgagtaggtctaccggtgatcaaagaggatgccgacagaaaactctattgattcaaattctagaaaattttagtgtcacacatcttagctttcacaaatagcaatattattattttatcagaccggtaattttttaatggtatgaattcaattagctctctttaaaaatgtttaaaaatagaaaattgtaatatcaatgcctgtagtaatgctcgaccaggagtaatccattgtcgatcttcttaaattaaacgctctacgcaggtagtcattgcttgatgtgatggtcactattaattattttggaatgaccctgcaagacttattcagcaggttgttaccagaaaattttaattaattttgtttccttgaactattagcgcaatatgcaaccaagtcgtctaagaagatgctgatgcacttaacaattgagaattgtactgattaagtacataattgataattatatatatgcaatataatatgcttacgtgtagtaatgcatcaacttgttcgccgagcaatcataaggacaacaaaccacacaaaattcgataattagttaaatgtcacagaaaaaaaaaaacaaaatctacgtacatgaaggtggtgtttgaatcttctgaagatgaagatgaagataaagattaagtgtttcacgaaaaaagaggtggtaataacgtgtgattaattgagttttaattattacaaacttgaaaaatggattaatatgatattttagagcaactttcatatagaaagttttcacacgaaacgcaccgtttagcaatttaaaaagcgtgccataagtatccaaaatttcatccttgttggagaaacgaacgcagctttcggtgcgttaacgaaatctagtgatataggagtattccaatcaagccatatacaattcacaacctgcatgcacccccaatatagaaatagttgtcgtgcttattggacaggattaatgaaatgctcgaaaaattccacaaagaaagatataagttaaacgtacgtagacaaaaggatcttgccgaaaagaaggttccgcgatgcagagagaacagtcgatgtggacagcaggagccgcctcccgacttttctccgtggcagttgacacgccctggcaataatcaatattttagacgcatggtctcaaacaaatgcttcactagccaaaactgacctggatcaatattatctcggagattttgagggtttttctttaaagtcatgtacgtgatatatagggtaggctgcgccttactagttactactggtcatgttcaagtcaaaacatgactggattaaaaaaagttcagtgaatgagaacgacgtcgcaatcaccggtaccatttctcggtggacaaggccgtgtcgcaacaaaagaatgcaagatttgtgatgctacatgtttaaccggtcatggacttttggacttctttttggctcattatatatccataagatttggtttataatgagtcgacttttggactcattataatgacttctttttggctcattaaccggtcatgtctaagatttgtgatgccacatttttaaccggtcatataatggtcgacgcttgcagttttaggtgtggttaggggtagatatgtattgagtcgactcagctagataaaactccactcgttagacttttttttttgttagaattaatagatgggctaaggcccattcgaagattaattctttggaaaatcataaaaacccaccttatgggatgacatgcatatgaagtttagtaccaccttgcttattctaggagagggggacctccttaaaagggaggatgccctcctagccatttaaagcatgtgtggtggagagaagaggggaaacacacacgcgctcgctcgcctggccaggcacagggtcgaatggtccgcaaaattggctcctcacctttgcgcaggcggcgcgcgtgcagacgtcgaatggtccgcaaaattaaaattggctcctcacccttgcgcagatgtagcctccttttgcagttttgttttgctgcgggattggattcggatttgttttattttggaaacatttcgaaaaatctggtgcgtgaaaacggcatggagtccggataggttacgcgcgacttatctggttcggtttacgcgggcgccctgatcagacgatctatctctatataaaccgagccgccgccttcatgcaatacacgcgaaatcaatttagggtttgcctcctactctgtactgcgccgtcgctcgtagactactccatcccgctcgtcggcgtgcaccggcgatcgggagatcaggtctccggaacctctgccttcgacgtcctgcaccgggagaaggcggcaataagatttttgggaagcgcttcgcgcgactgctccctgtttgtctacgacggctcgccttcctctccgctcgcgtgcttcgcgactttgtcgacgctcgcaaccgcgagtagttcctgccgagcaaccggtctttccgccacctcggtacgtgttcgacatgttgcgcatatttgatctgttcatgttttactgcttagtttatatgtgtagatctaatgatgcgttcaatctagtttacatatgcaatgtcatgatttatttatggaataaattaaattattatgtgcttataatttcaacatgaacatgattgcaaatacacttaactgcgtcggcaccaatcatcgctgcaagagcagatcaagatggggaagtgcagaggacgcggagttttctgaaagtatatagctccatacctacctacaacctatattttgctatcataaaattgaatgcaaaccattttaatccagccatttatgtaatacattttagaagaaatataacatgtcatattccatatttctgatcccacaattatctcaaatgtaaatgatattgaagtacctatgtgtacgatgtttctcatccaaatttccaattaaacaaataaactcagcaaaatattgaagtataacaacatgaatttccagcaatccaaaataaaacgtgcgctggcagcgaacagcgaacagaaaacggcaaaaagagaaacagagcgtgcgccccagaaaaaaaaacgtttttttcggttttttttcccttccacgcgatggaaaagatctacgtttcatttttatagttttttctgttaggatgtttgttcggattggattataatttttttggaaaaggtttcagtgatgatcagtatttttttatttgtagtaaaatttatacactaaactttcaaattatagatataattctatgtaaatttacatatataaagtttctctctatatagaaagtttcctagtaaattgttcctttaaaaaaatccatcagcattttattatttctagtaaaatttacgcacttaactttctaactacagatgcattttctacatgaagtttacatatacaaagtttatatatatataatttacatatataaattctctatataaaaagttgaaagtttccacaagaactgtgttcaaaatgctataaaaaactataacgaaaaaaacgaaatatgaaaaaacggaagtgaaaaaaaaaacagaaagaatacttgcaacggattacgaaacaatcacgtaaaagaaggaaaaggaaaattgaaaacggaagaaaatagcgtgacccgatttgatttccctcttctaaactgattcgcgtgatccactgatggcgaacattcgcctacaaccctgttcgaacacaaccttgctttcatgctgcagcctagctactacaaaataataatttagatctcaacaaaggggccaaaatttgcacatccatactctttctatgtactgtcattaggatcaattagtagcggtaagactgtaatgacctgaaagttcagactggccgtgtatgtacaccaacatcaaaaattacatcatttaataaataatggagatgagcatattaagttttttcccctgaagtggagctgaagaattaatgagatgtggttgagaaggattattccgtcattgatagcaatggacccaacctattgtgcaacaaatggtggcatgagcaataagtttcataagtaacaactgaaaaaggtaccacaaagaaagttatttaataaaatgaatgcatttttacataagtaagacaatgtggcattcgagaggacaatttcagattcaccaaccatctgcacccgaaaccaacaaacctggccatgttcggtgtactggctcatccatgatatcatcaagcagaagaaagaaagcttgaaggtacccagactttctctgtacatcaagaagctcattgctgaaaaaaaaagagagaagaaatcgatgaagaagtcagatcctcctatagtagccaaactgcaaacaaatatgaatggaaaaagaacacagtgagtaaggtaggagaacatctattttttgaagtaaagacatgagtgatgtgaattatactgagaagaagttgattacagaaacaattggaggatattacatagaacagaaagcaaactgaattttcatgtcaagaaaaactcctaccagcttgtcgaaacaagattttggtaatactaaaagggggtggctatcaagctggaaaagtggatgggtttggagacaaggaattttatacaggttcaggccttcttaatcaagaagtaataccctactcctgttcgggatgattccgccgagtgtattattgatcatatgatctgagaaaaaatcgtgtcctgagaaggacccggaccactccttatatagaggaaggggtccgtattacaaaatacagtccatatccctaacggaatatgatattacagataaaatacaatcgtaaccgactaagaccccgggtacttccttgacatacaagttaagaaactaacccgagttcccataaagatattctatctatattcggtaccctgtatccaacctaactataactgccatgtagatatggggtatccataatctccacacagcttaactccgccacttttctgtcatctgagcaaacgccctagaagatccttctattccgctgaagctagatattccaccaggttgtgatctctttctctctttctttcaatctttggcctgatgatacgagcgaaagcaaagaaatcagtcagacagatattatactcgaattgcataggggacaaaaccaaacttctgttggaattaatagatgggccttagctgattcgaagattaattctttggaaaatcaaaaaagcccacctcataagatggcatacatggggagtttaataccaccttacttattctaggagagggggacctccgtaaaagggaggatgccctcctagccacttgaagcatgtgtggtggagagaagagggggaacgcacgcacgcgctcgcctagcctggcagggcaggcggcgcgccgcaaaattggctcatcacccttgcgcagatgcagcctccttttgcaattttgttttgctgcaggaaattcggatttgttttgttttggaaacattccgaaaaatccggtgcgtgaaaacagcgtggagtccggataagttacgcgtgacttatccattcagttacgcggagtggagatcgtgcgggcgctctgatcaagcgacctatctctatataagccgagccgccgtcttcacgcaacacacgcgaaatcaatctagggtttgcctcctactctgtgctgcgccgtcgctcgtagactactccatcccattcgccggcgtgcacaggcgatcgggagagcaggtctctagaacctctgccttcgacttcctgcaccgggagaaggcagcaataaggtttttgggaagcgcttcgcgcgactgctccctgttcatccgcgacggctcgccttcctctccgctcgcatgctgctgttaacaaccaaatttggtaatatcggcatcgggaaagaagattagatcgaagcaaagttagaggcggagatcgagttcgaaaacagagcaggaatcggctagagtccaaatcggctgcgataagatcggctgagtctgagtcggaataggtaagccgatgtagccgatctcaacaatacaacttgatgtatggtgtcaggttggattgaggtgcttcaaggtgattgccgcacatggatagaatcctaaggaggcaattgtatctattaattaggatgttttatgtaatttccttagagatacgtttgggaaaaagtctgtcgcaaaaacttatggtatcttagagtttgttagagatagcagttgtgtccgttatggacatatcttgtaattctcgggtataaatagacccgagccctatgtaatttttaacacacacgtccaatataatttcggcgcatcgccactctttttcctttagttttgtttcgacaagttcttgctttcgggttgagccgcattggtttcgatcttcaacaagaggtaaaacttgttatgacgacttgtgttctcgggattagggcttccatctttatgacactctgatctcgtttatgtaattcattgagttatcttatatcttacataatccctggcaatatcgttatctaatctacaatcgactaacatctgtcggtagagggcagccgattaggttagatatcgatgttgatttagattatataagatatctacaactctatgaaacttccagcggcttgattgtctagatattgttcttcttttcatacttaatgctgcatcagttgagtttgatctattaagttgtacttagaatatcaatctctagcctgttttctggttgccgattagggtagcatcggagtttcagccgatcttatttgacttaactacatttgctttatatgcttcattgacttgttaaatctgcccttttacgtcaaaatattgttgtatttaagtatattagacctttgtttgatatattatacttgttttaatatcatgatatagagtagtatcggagtattagccgatacatgttagatctatctgatcggctatgctataaacatatatagtcctgttattaatatatattttgatctaagtgatttatattgtctcggcacagcgaccgatctatcccaatcacttgatttaagtatatatcgatgtaagaattatatattggagatatctacagccgatcgaatagatttagtttttttattgtttatttacaactgccgatcgattcacacatgacatctgctcaaagataaatgatacgtcatcggcacctagccgatcggctatcatttatagatttaaccgcggtttctttgcttctatttcttgttgattacaggatcaaatcaactagcatgctagcatacccgaaggcgagctttggacctgcactggagttaagcagatctcccaggcctcgtgttttctgtcaacagctgcgcgccttcgtcgacgcccgcaaccgcgagtagttcctgccgagcaaccggtctttccacaatctcggtacgtgttcaatatgttgcgcatatttgatctgttcatgttatactgtgtagtttacatatatagatctaatgatgcgttcatgctagtttacatctgcaatgtcatgatttgtttatggaataaattaaatcattatgtgcttataatttcaacaatccaaaaaccttattataggccctgtggttttactatggctggttttgccgatgcactgaggccagataaattcaccggtgtgcactttaagagatggcagatcagggtcactctatggctgacagctatgaaatgcttctgggtgagtactggcaaacctgtgggagttcttactgctgaccaggagaaagaattcgatgaggccactactctctttgtgggatgcattcttagcgttcttggcgatcgtctggtcaaggtgtatatgcatatgaccgacgctaaggagttgtgggatgcactgaatactaaattcggtgctactaatgctagcaatgatctgtacatcatggagcagtttcatgactacaggatagctgacaatcgttctgtagttgagcaggctcatgagatacaaaccatggctaaggaactcgaactccttaagtgtgtcttacccaacaaatttgtggccggctgcattattccgaaactacctccatcttggagaggtttcggtactgcactcaaacacaagagacaggaatactccgttgaggggttgatagctctcttgatgtagaggaaaaagctcaggaaaaggacgccgcgtctaagggcgatggtgggcagtccagtgccaatgttgtgctcaaggcctagaacaagagcaaggggaaatacaaagctccacagaccaccaacttcaagaaacagaagaataacaacaaccatcttaacctggatgagaggacttgctttgtgtgtggcttgactggtcatctggccaagaagtgtccacaacgcaaggggatgaaggcacctacctgcagggcagactttcaagtctgaaaatgtgactattggcaacactggagatggaagcgggtatgctaatttacctactattttttcagttaatcagtctactaactagtgggttgatactagagccaatgtacatgtttgtgctgacatctcattgttttcttcttatcaggtcgcacggggttccaccatcctaatggggaatggggtttcaccgttcatggtgttggcacggtagatctgaagtttacttcgggaaagatcgtgcagcatgtccctactatcaataggaatcttgttagtggctcccgtctgactagggacggatttaagttggtttttgagtctaataaagtagtcgtgtctaaacatgaatattttattggtaaaggttatgagtgcggaggcctattccgcttttccctttctgatttctgcaataagtctgtgaaccatatttgtggcagtgtggatgatgaggctaatgtttggcactcacgtttatgtcatattaattttggcttgatgtctcggctatccagcatgtgtttaattcctaagttttccattgtcaaaggttctaagtgccatagttgtgtgcaatcgaagcaacctcgcaagcctcacaagactgccgaggagagaaacttggtacctctagaacccctacattcagatctttgtgaaatgaatggggtgttgacgaagggtgaaaagcaatatttcatgacgttgattgatgatgctactagattttgctatgtgtacttaggtaaaaagataaaaagacttaggtctgatcgtgttggagagtttttctcaaacgagtttgacttattctgtaaggaacatggtatcatacatgagaggatgcctccctattctcccaagtctaatgggattgctgaaaggatgaaccgcacactgactgacttagtgaatgccatgttggacaccgcagggctacctaaggcatggtgggggaggcattgtttacctcgaatcatgcgttaaacagagttcctaacagaaataaggacaaaacaccatacgagatatggattgggaaaaaaccatgactttcttacttgcgcacatgggagtgcttggcgaaagtcaatgtaccaataacgaagaagcgcaaacttggacctaagactgtggcatgtgtctttctgggatatgctcatcatagcattgctcatagattttctatagttaaatctgaggtacctgacatgcatgttggtacaattatggagtctcatgatgctaccttctttgagagctgtttcccaataaaggatacacatagtagttttagccaaccctctgaaataattcccagtttaatcacaccgccagaacaaaactgaacatacacatgaacatgtcactgaggaggatgacagtgaagctcctcgaaggagtaagagacaaaggacggctaagtcttttggtgatgatttcactgtgtacctcgtggatgacactcctaagtcaatttcggaagcatatgcatctcctgatgcaaactactggaaggaggttgtccgtggtgaaatggattccattatcgctaatgggacttaggaggtgacagagcgaccctatgggtgtaaacctgtggggtgcaagtgggtgttcaagaagaagcttaggcctgacggtactattgaaaagtacaaggctaggcttgttgctaagggctacactcagaaagaaggcaaagatttctttgacacttactcacatgttgctagattgaccacaattcgtgtgctactttccctagcagcctcacatggtcttctcgttcatcaaatggacgttaagacaacttttcttaatggagagctggatgaggagatctatatggatcaacctgatgggtttgtagttgaaggtcaagaaggcaaagtgtaaaaattgttgaagtctttgtatggtctaaaacaagctcctaagcaatggcatgagaaatttgacaaaacattgacatctgcaggctttacagtcaatgaggcagataaatgtgtgtactatcgccatggtgggggtgagggagttattctgtgattgtatgttaacgacataatgatatttgggacaaaccttgaggtgagaaatgaggttaaatcattcttgtctcaaaattttgatatgaaggatttgggagtagctgatgttatcttaaacattaatctgattagaggtgagaatgggattacactcttgcagtcccattatgtggagaagattttgaatcgctttggctacattgatagtaagccttctccaacaccttatgatcctagcttgttgcttcgcaagaacaaaagaattgttaggaatcaactggaatactccgaaatcattggctcgctgatgtacctggctagtgcaactaggcctgatatctcctttgctgtgagcaagttgagccggtttacctctaatccgggagatgatcactggcgtgcgcttgagcgagtaatgcgctatctgaaaggtactatggaattggggcttcactatactgggtatcctgcggtactggagggttatagtgattttaactggatctctgatatggatgagatcaaagccactagtggatatgttttcgcactgggtggtggtgctgtttcgtggaggtcttgcaaacagaccattttgacaaggtcaaccatggaagcagaactgacggcacttgatactgctactgttgaggcagaatggctgcatgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctattaggaaattgagaaacttcgaagttataacgttggattacatccaaacagctagaaacctggcagatcccttcacgaagagactatcacgaaatgtgatagataatgcatcgaaggagatgggtttgagacccatgtgagttatactatggtggtaacctagtctatgtgatcggagatcccgtgaattagaacctgggaagaacaaaccattagtaaactagaggagagtaccaatctataccatctccaagtgaagatacatgtactctcatgagctgcaaggcaggttggctatgccttaataagttctgttggctttaattagcgaagatgctgtcctgcagagcattcttgaaagaactcacctttgtaagcttgactgttggtcgcagtctatggagattttgggtgaatcttgtaggaagcttactaaagacctaggagtatgacttatacgctccacccgaggggtagtctacagacggtctagtatcagataagactctaagtgaaacttgcttgcacaagacttgcaattcaaggcgtagtccattgttcaagttgtgagtaagtgtagcttggagttctagatggatgttcaaccttaatcggtctccatgttcaaccttgcgtccagagaaggttgctgatttcggaagacaacattgtatgccggttgttctaaagagaccagaagaaaaggaggtagaaaattgcatggtgctttgaggggagtcgtgggtgaggctgcagcatggaaatattttgaacattggatagacccagatcaattccaaccctttccaagaagctcctagcgaacgaacatgttacactaccacagaaaacctcattggtgccgtttggaaaaccccctaggtccctggaaggcggcattgatgtagaggggaaataggtgcctgtttagaactgacacctttgaggtttcacaaataaaaaaaaagtcagctcgagcagctccccttcacccctccatcccgaccaatccaagaacacatgaagaatattcaagatcaccagaacccaagaacacaaggaacacaaaaacactaagaatggccagccgacgtcggggagggcgccgcccgctgttgccgcctcccttcctgcagccgcccaccactgccgccacccttcctgccgttgccatcacctcccctcccaccggatttggtggaggggtgggcgccgcctgccgctgtcgccaccgcctactgccaccgcacgtcgccgccgccgcttccctcccacctgttgatgagaaacacggtggactaggagatttgcttcactctagtgaaggtcctaggcttgcctcgagtgtcaagagcgtgccagctagtttgatcttgcaaccagcaagaaagacaacaatcgtaattagatgaacgatagtcaatcgggtgacagagccgatgacgtatcgtcaggacccgtcacatgtaataaaatcattttctatatgccttagaacacaattttcttttttcaattttatcaaaattatccaactgaatgttgtggtttgtcagatgcaaattatattactagtgacaattttctgaattacctgaactttgcatattaacatagtatactgattgtccccccatgcttaatcacagtaaaacaaaaccaactctatgatactacctttggtttttaatatatgatgccgttgacttttcgacaaaagtttgactatttatcttattcaaattttagtgcaaataccacctcatgggatgggatgaatggggagtttagtaccaccttacttattctaggagatggggacctccttaaaagggaggatgccctcctagccacttgaagcatgtgtgatggagagaagagggggaacacgcgcgcgctcgctcgcctcgcctcgtagggcagggcagggcaggtgcgcgtgcacgacgtacgcgtcgaatggttcggttacgtggagtggagatcgtgcgggcgcgctgatcaagcgactattgacggtccttaaatcataatatctgacagtgttggtgaaatatgtgtatgcaggtaatttgaggagaaaacacatccgtcatgcgacaaaatgcacctccacgcattcaggacacgtttacatggattggaggccccataactcaagtaaacacctccaaatggtcccatctaccatgccaatgggctgagggcctcaaaattagtgtccacgacgaaaaacgggctgaatggagtcctcccgggttcggccgaaccatttcagaggtcgttgatcccgagattcgacgtagatggccctgattacatcctgatggtggttgcggggtagttgggtcatttcccatagcaacaaccatcatttggagcctatataaggaggagttcactctaatttccaacacacaactttgagctgaattacaagaggctctattgtatcttttgtacattagaataaggttgacagtgagggaaagctctggaggagtgcccggaagtttggtgctcatccaacttctacctcgacgagtgtagcttcctaggaggaattcgggagaagtaccggagctgtcggtacaccctgctctgggttcggagaacttcttctataaagtaagcattcgtgttcctttgttttgttatttaattactttttgtctaagtaagatagatttccatctttgcgggttcattgtttagttgtcgtactaagtgccctagtactgggactccgggtagaaaaggaagttcctacgcaagtattagagtagtaattaataacttagacgtggtgtctaggttagagattacctttgtttgttgtgtatcccatagatttgtcataggtagacgacaggtggtgacagccctgaatcctgtcctagcaatcctccacattcggatacatcatagagctatagccggaaccacgcttgcagattagcaggggtcggtgcccgaagcaacagataggaatttacctttaacttagcttagataattaaaatgcatagaaagtcctctctaacctgcctagcctacttatagttgttttccttggatcgtcttagccttagatagattacacacgttccctgagttcaatatccttttagggtcacccgaaggtgactgtgctacagtggtattccgtgcgcttgcggatttatctgtggtcgtaagaaataccaacaagcatttctggcgccgttgccggggaacggttgctaatttatctgagtctaggtcatcctcgtatctttatttttatttcttcttcttttattcctttctttgatggagcaacccacaattcaaaatctctctgctcctcgggctgatctatgtgagccatcgtgttattcaaaactaatcctttcggatggctaaaaaatcggtcctggctttatagccatgattcgagagcaaaccttctctggtggtattagtgaaaacccatacctccatcttcgggactttgagctagtgtgttcatgcctatccatcgtaggcatgacacatgaaactctaaagtggaagttgtttcctttttctcttagagatgaagcgaagcaatggtacactatgtctgtcaagaaattccacggtgaatgggaggagcttaagagcaatttctaccttactttctttccattaacccatgtaatcaatcttcgattagacattctttctttccgacagaacgagaaggaatctctcggtgtagcttgggccaggttctcacagttaacttagtctggtctagacttgtctttacccgaccatgtgttgttacaacattttcggtatggattagacaaggggtctgccgcaaatctcgatatttctgccggaggatcattcgcacacaagacaactgccgaaggaagagaactcttagatttgatcttagagaatgattatcccggatgtcgagattatccatgaggaacctttgcatgtggagtcgaaacccgactcaactgtcgaatcctcattccagtcgttggagccggaggaagaagaaattcatcctccggaaattccattccaattcagggatgatctttatgaagattatgagaacaccttgaattattccagcaaaatcaaggctcatcccaagcatgagccattcgaggaggtgatgtttgtatcttcgttcatttcttctgaacctattgaccatcttcatgaaactgaacgaccctcatcaccctcgatcaagtctaagccttgtccctctggccctcataacgttgttcttgtttatcatcatgaaacaacccgattcttgcatgatgtatctcttgagaaggaaagccttcaggccacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39585 - DNA, 2895 bp, Oryza sativa
  unsure (1)..(2895): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgaacaccttaatatttattttttcaaaggatttataaatattttttcttattttctgatttactgaataattgagtattatttgctttaatagggagctttaggtttttccatgtattaatgtttctttacaagtttgtacccccatctccaaaatcctgcatcagccactggggtttgtacaatttaacaatggcaatccctaaacagttttgccattatatacttcttacattatcctatggttttccctattttcatttttctacatttccagtatttgtttccaaacggacagaatgttggcatgagggaagtggcagaatggaagagagcttggtcagaacagtggcccaaaaataagatgaagagaaattacaaagaaatgtattccatggattatgctaaatattagtaaaaaaaaacaagccaatagtgtagcgaggaattccaacaaggatgtacctgcttcagttcttccagactaattgttccattcttgtcaacatcaatggcattgaactggtcacgaagatcagacaactcttctgcatttagtgtagaagctaacgcctacaagagatgtaaacatttaaaattgactccgaaatcatcctgagtcatggataagattcccttaagttatggtatgataacttacccgtaaagcaaattgcttaaaccgactgtattttacaaactgacgcatattatgtaatacagatatatctagaggtatatcagatgcctgtcctccttctctcacccattcatgtgctgaagaaaataatatgtaaattttcatgttagtagagcactgtgataataagattgtttatttttataccacaccaggtatgcccattctgtgcatacacctgatacaataacccaactgcaacagccaaatgtctagttgtctatgcatgtaatgaaaacatgaattagttggtattggttatgtatcaatattagattgtaccaagccttagtaactgaaccaaccatgtctaaccatgaaaaagcaacataagatgtttctatcaaattcaaggtataagctgttattttacgcatggtaatcagaaagtgctaccatatacatagcaatacttaacaatcaaatcgataaaaggcatggaggtctgaatttcatgagtagcaagcatagccacatggcttcaaataacaagccaaagctgaacccccagcagaagttaaacaaataagtattaagctaacagggagtatgcactgcaaacccattaatgatcgctgagtaagcctttgaggttggaccctcatacataagtttccaacctgaaggggcccttcataaatccccttagatatatcccatctaagagtcacccagtaatcaagttgtgaatttgcatgactgcactcagacttagcaacagtttgccactagaatcccattattaaataaccagatttgcaaacttgcattcaagatgtcccaaaatgatatagagtttccctaatcagattatcatacttaaatttaagacatccaaaaatgatataaagttacatacataatgcctgagcagcagttaatcttgcacggggatccttaacaagcaacttttgtacaaagtctttagcacaaggagtgatatttggccagggcttgcgacgaaaatctggcttgtttttcaacacctgcaccaaaaagaatatgccactttgttagcattgtggaaagagaagcggggaacagaggatggacacgatttgagacaaggtcagtaattccaacatgatacccaaagagaaacataaatataagcagccaccagggtagcggctacccaagatatacatatttttctttatgcacaggcacagctaatgttccatagactgcaggcttagctccatataggtttaggtaaggagagagggtgaatcatgtagattgactccacatagatcctcctatgctagcatttgtacacattacgatacttgttctaagatagttcactcggttcatccatggatgcgtgcttttctggatagcatataaacttgttgacgcttgtggtaagctatttcccaagtatataatcagtgtaaatctacacgcctgatattgtgccaatggcaaactcgtatgctatgaagtgcactgcatagcaaggtattttcatcttttcaacaagttggatcatatttttcagatttgtcatgacacagatcactagatcagatatacttgagcataaatcctgagaagataaagagttagtcttttttatctaaaaaaggggaaagtctatctttggtctgtcaactcttcatgtaggtcaatttttgtctctcaagtcaactctaagacaacttgtcactcaacaattgaaatcatgcaaataatgtccctatgattgtttctcaagtggttttaagtgaggtggctttccacatcattctgttttgccatgtcatttgccacatcatctagacccatgtg

SEQ ID NO: 39586 - DNA, 14427 bp, Oryza sativa
gtgctcctctcggcgattttctcttccaaccgtggaaatttgattcctctccgtggaaatttgattcctaccacattggtggctaggaggttcatcccgcgatcgatttgcgatttcccctctcaaggtagcacttttgatcttctcttttggttcatcatgtttttgccccgatctctaaatatgtgaacctagggagaaaaccttttggatagaattgttcctgctaccttgtagattgtcgatctataggattgtcacatgcactggcctggttaaatcctctattcttcagttttgcaggccggaaattccggtgttcttggcccggaacttccggtctctgtccagccagccagtaaccttgattttgctactgtttcatttaaccattgcactccaaccttgttgattcttgttgcagtggtcattatgcctcgtgagaagagacagaagctttctcaagatgttcctgctgactcaagccccccggttcgtggtcctagggggagattgggcaaagaaaaagttggagatttttacagtgggagtcagattccgatccattccaggagggctagtagcattgtcattcgtgatgcaccccgctctccctctccagctgcatctgactcagatgatggtggcaatgaggatgagcctggttctgaaagcaatcctttgaggctatacaagacaagggctgttgatcctgatcctaaacgcccaagagtgaactatctgaagaatctactcaagtgtggaagggacagaatggttagtcctgatactctgccagctaactctcaggatgacagattcaggaccttggtgtaggttgattggtataactctgtgatcatgggaagatctcatccagtggtagagatgaagtggctagactggcagtacatgtcctcaaagaacaacatagtcttcaatgaggtacgcaaggtgtgtgagcgcaagcacgtggcagatttgttggccttgcagtattcctggaatgaggaagtgattggacagttctactccactgctttctttggcaccactaagaaggggcttgattttgtgaagtggaccattcaagggcagcagtatagggtttctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgctgtactctatcttcaggtggtctttgctccccaaagtgggagatgctacagctcttccaggtaggcatgcactcctccttagtcgcatgcgctataacaagcccgatttcagcatcatgaagcttatctggagtgagatctatgagacagtgtgtgagccaaagagaggcttcatctatgctccttatatcatgaagatgattgaggccaagactgggatttgttatttcaaagacaatcaacacaagcctttccgtcctcatgctcccactacttcagctactcctaccaccagagtgactcgtgcttccacctcagctgctccttctttctctgctgcacctcagcgttctgagtcttcttctcccataaagaaggctctcagggctatcttttgcatgtgtgccaagacagctaagaggtaaagaagatagagaggcgtcaaaaggaagattggattgcaacaggcaaggatgtctctgacatttctgatgatgagtttgttgatccttttgctgcttatgagactgctcgagacattgctagtgatgagggtccctctggcacttctcgtttctttaatgaggagtcctctcactccgaggagagcagtgatgatgaggagtcagatgcccctactgagaatgctcctacagatcccaatgaggcagtggatgccgccgggcaagacatcgactctcctcactctggcgacactgagatcattccttctgatggcgataatgatgaggcttgatcctcttcttcccttgtgattttgtctctttttagtgcattgatgtcaaagggggagaaaattgcaatcgaagggggtcaaaattttgtttttgatgcttactgcctgctgtctgtttaatccggaagttccggatcctcttatccggaagttctggacctggcagctccctcgccttattgtcatgtcagcttgtccggaagttcctggtattttatccggaagttccggaccttgcaatcctttggcccctattcttaagaactcatggacatgttctaattctctatttgtgtgaatgtaatggctgttagatgctcttagctgccctttatttatactcctcttcatttatgctatgagtgtcttatttgttgtttgtgatgtgatgttgattttatctttttgagtgctcaacgtgtcgtatcttttgcatataatatctattcttactgctttttgcatcccacgaatgagtagggatgaaggaaactctcctcggttgctcccttatatatatgcatatgagctccactcatatcttccatatgcatacattaagggggagtttcattcacctctaaccattcaaaacaaaattcttatcaatcttttgtaagctttaaccatgttatcatcaatcaccaaaaaggaggagattgaaagtgcattaatcctcctagtgggttttggtgattaatgacaaatgtggttaagagactaatgagctcattgagtagctttcaggtgcattagtccaaggtgtggaagatggatgcttggagaccccccaaaaagtacaaaatcaaagcggaccagaactcgagaagtgcataggatagtttatcttctgaaatcgagtttttaggaaaaaccgtactattaagaggggttccaggtgatgctctgagatatatcaagtgctcttagtgtgaaccaagtgtcaagtttccctaggagttctttttttttttgcaaatactccatctgtccaaaaatgcaagtccggaacttcctgtcttctaggtctagaagttccggtcttgtgaaaaagattttcctaagtgtagtccggaagttccggtcttccaggtccggaacttcctgtcttgtttccagttcaaatttgtgagtaacggctagatgacgtcacctagccgttatacatatacagttcgtttccagctcgttcctcggccattccactttcacttttcgaacctagagctattgctagcctctccgaagtgtttcttgtctttccactgaatctagagcctaattcttgtatgaaagagagattgagagggagagaagaagatttggagaggtgtgaagactaggatcttgggtgagcacttggaatatctcgtgggttgtcatctgagtgcttattactcttggagatgatctcctagacggttaggtgtcacccgcgagaatccattgcgtattgtggatgtcccgggtaagtttgtgaaggatttcctctcctccaaaagggaacgaggtaagttagtgaagttcttgtgctgagattctagaggctttccaagtatagcaacccacacttgtagtggatttctagaagtaggttgagttggatcttggtggtcactcaattctagaaatttgcctaggggtgtttggggttgaaggctgtggatttccactggggtttttgcacaagtgaggcaaggggttaatcgagacccagctctttggagctcctcaacggagagtaggatcgcaagatccgaacttcaaaaaaaaatcgctcttgtctctttctgtgatgtttctgtgaatgattctgtgatatatcctctgcttagaatacctgtgcaccatcttgtgaagattggcttagtctcctgtttcgaaatttgaatttcatctctgttttgttacccggaagttcttgtcttagaacaccggaagttccgggcctggcaggccggaagttccggagttccttaccaggaagttccgggtctgtttgaattttaccgttgcgatttgtttttaagatttcagggacaacctattcacccccccctctaggcttcatcagcgcgttcagtgcgaccgccgctgtggaagccgtcgttgtcgaggacggcaacacctggaagctctcgcgtgggggaggacatggggccgagggatggagaggagggcgaggtcgaagcagtcttcctcggcagtccgctcctctcagcccgcgtcgagaaaggcggcaagccgcagcggagcggcgggcagccatgccagggattgctttttcttttctttttttttgcgcgatggcagattgacgaataacgagcagtctcgttcgtttttgtccctccgcggttgctcgtaaatgggctgaatgggccgtcctcgccacgctcgtgcgatgcggaacgaaggaagcagcagcgccgtgagatgccgatcggatgatggatcgacgctggatgtccctctgacattgtgcgcctaacgtcagacgatctgcttcccgtaatctcgtatactcatgggcacaatacagtgacaaaacaatcgcaatttggccgagtttagtttcaaactttttcttcaaacttcaaaatttttcgtcacatcaaaactttcctacacacataaactttcaactttttcatcgtatcgtttcaatttcgaccaaactttcaattttatcgtgaactaaactgtggagattatggatatcccatatctacacggcgatggtatttggactgaatataggataccgaatataggtagaatatcttatttgtatctcgggtttgtttcttaacttgtacatcaaggaaacaccttgagacttagtcggttacgactgtattttatctgtatctgtatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagctagatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggtgtcagtccagtcgggagagaaccagatttcagtcccgtttggactcccaaacgcggctgaaagttacttcaagaccatctcaatcgagtcggcttcaaaccactcggctgagatcgcatcttctccaacgacaccagatcgagatgatggggcttacccaccggtcctgatgaagctccccgacgatttggctgccatctccatcacgacagcgtctccatcccgcaggcctaggcggaagtcggcttctacaccgatttcgcatgcttcagggaagtcggcgtcatcctccaaccactcggcacggtttcgacggatcagctggatggctactacagctctcccaccgtcgactcgcgccccaccgacatcgtggagtacgacgagtttagctctcgctacaacgacccggatctcgacgacttcgatgaaagcctagatgacaactacacccctctcttcttcggcgtcttcatggccaataatgagacggaggagcaacgccaagcccgggagaccgaagtgcgtcgcgagactgagcgtcgccgactggaggaggagcatcaagcacaagaacaagaacggctacggcgtgagcagcaggagcgtgagcggactgcgaaggaggctgaggatcgacggcagcgagctttggaagcaggacgccgagcgcgtgatctcatcggtcagcaagatgttgaagggacaccggtttttcgcacccctcaacagaatgcggttgccgcgatcaccctcctcgacaccctcctcaaggaaaacgagctcaatcaatctgatcacgtcgtcaacatcctgaaccagacgaagaccatgattgcagcttcggtcccagttaactccgaaagcgtccacacgccgactggcagccgagtcccccacttccgatctcatgactaccgtcatccaagcctcagcatcactggcgcaggatccaatcgcaggagcaggggtcacgacgagcggtccattcactcacctcccgaccatcatagggagcgccgagtggaacggcctcgctcaccacctcgtcgtcgccccgtcgatcttcgcgacacaatcatacagcgccgagcagctcgaggctatcatcattcgccggaccgccacgacgacgaccttgacggagtagcagccttcaccgacgacctgcgtcgagtggattggccagccggcttcaaaccgactggaatagagaagtacgacggtaccactaacccagaatcgtggcttaccgtctacggtctcgcaatccgcgcagcaggaggagacagcaaggccatggcgaactatttaccagtggctctagcggattccgcccgatcttggctccatggattgccccgtggtacaattggatcttgggctgaattacgcgaccacttcatcgccaacttccaaggcaccttcgagcgtcccggcacacaatacgacctttacaacgttattcagaagtccggggaatcccttcgagattacatccggcgattttctgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagctgaagacgccgtcaccgcatcaaagcagtcgggtcccagttggaagccaaacaagggtacgccggccacgggaggaggtggaagtaacaacaataaggaccgcaagcgtaagcctgtggaacttgttgcaaccgccacccattcttctcgacagcgttcgcgcgttaacacgttcgacaagatcatgaactcccaatgcccgcaccatcctaactccaaccacgtggccaaagattgtttcgtctacaagcagtttgcggagcaatacaccaagactacaaggaagaattctgacgaagaacaaagcacgtcgaggaagaaggacgacggtgacaccccggcaggatttcaagaccaccgcaaggagctcaaccatatcttcggcggccccctggcttatgagtccaaacggaagcagaagttgactgaacgggagatcaatactgttcagcccgacacgccccagtatcttcgatggtcagagattgcaatcaagtttgaccgctcggatcaccctgaccgagtggtccacccggggcggtaccccctggtactagacccagtggtccgtaatgtcaagcttcgcagaaccctcattgacggtggcagtgcgctcaatatcctcttcgccaagaccttggatgatatgcagattcctcgctttgagctaaaaccaagcaatgcgccttttcacggagtaattccaggattatccgcaactccactcggccagatcaccctcccggtcacctttggcactcgggaaaacttccgcacagagaatatcagctttgaagtcgccgatttcgagacagcataccatgccatactcggacgcccggcgttagccaagttcatggccgtcccgcactacacttacatgatgatgaagatgcctggtccccgaggagtcctagccctacgaagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaagagtggagaaagcgaagccaagactaaaaagattcccctagatccttctgattctactaaaactgttgtaataggcgccgagttagattgtaaataggaaagcgcgctcatcacctttcttcagaacaataaagatatctttgcatgtaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcatgcttcattaaagaagtccttcatcccgactggctggcaaacccggttctagttcggaagaaaacagggcaatggcgcatgtgtgctgattatactgacctcaacaaatcttgccctaaggatccttttgggttgcctcgcattgaccaggtagtcgactcgaccgccggctgtgagcttctcagttttttggactgctactcggggtatcatcagatccgactaaaggaatccgactgcttgaagacttcattcatcacgccctttggggcatactgctacgtcaccatgccgttcggactgaaaaacgcaggagcaacttatcaacgtatgatccagagatgcttctcaacgcagatcggtcgcaacgttgaagcctatgtggatgatgtagtcgtcaagaccaagcaaaaggatgatttgatcttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttaccgctatcctcaacatgaaaccgccaagtacccagaaagatgttcagaagctgactggatgcatggcggcgctcagccgatttgtttcaagacttggcgagcgggggatgcccttctttaagctactaaagaaaacagacaacttccagtggggacccgaagcacagaaggccttcgaagatttcaagaaactcctcaccgagccaccggtcttagcctcaccacacccgcaggagccgttgttgctgtatgtagcagccacctcccaggttgtgagcacagtcttggtcgttgagcgcgaggaagaaggccatgtccagaaagtccagcgaccgatttactttgtcagcgaggtcctatccgactccaaaacgaggtaccctcaggttcagaagctgttatatggtattctaattactaccaggaagctatctcactactttcaaggtcactcggtaacggtggtcacatcattcccactcggtgatatactgcacaaccgcgaagcaaacggacggattgctaagtgggctttggagttgatgtctttggacatatcattcaagccccgaatttcaatcaagtcccaagcgttagctgattttgtcgccgagtggaccgagtgccaggaggatacccccgcggagaagatggagcactggaccatgcattttgacggatcaaaacgactttcaggcactggagcaggactttccttgacagccgatgatttccttgacagggagaacgccgtgcgccaccatctccttcaggttctcctccgtcacgtcggacggcgcccattggccttcaaagctttcgcccattggccttcaaagctttctttttcttctgccatcgattttacccgaatgcgctgatttgattcgagggatggctggggagaggtgagggattgaggcggtggatcacgggaaggattttgatgaactttttgaaggtggattcgagtggaatggtgaaccctagtttgccggcgcagctctgtactgtagcagggattggggaaaatggcgagagttccggcggggaagacgaagcgtcgcttcaatctcgggatttcttgttaagggtatcggaggtgcgaatgggcttaggcctgaacagtacctcagcccaatacttttgacagcgtggcccattgtgttccttagagacttaggcattttttgctttggcaatttatgcgcacaatagtgttgcccaatgctgataaaatccttttttatgcggtcatataattctttggaattattgcaatgcaaattaaaaggtgcccgacagaaaggcgttatgctgtttttgtaagcttttttaggctacaaaagctgtctgggttaacttggaatggcttgtttttaccatagtcatttccttggtatgttatatgcctgttttcattatggtaaatagtcatagcctaggctattagacttgttcattaccataatttttataatacttggtgggtaatctttagagttttttattcggatgcctgtcaagtatgttcattcgtggaccttttagagtgttaaccactcggattccttttattatgaccaaaaagcagtcggcaagaatgcctctttaggcgccgcgtctgcttttgtcatatgatgcacgattgtgctattattttgttctcaactatatgtttagtttgttaactaatcacatagttgggggctacacctaattaggtgcatctattcgatgcaccatattctttattttttcgccctttacagtcttcgtcttcgctactcggcaggccttagcatgaaaaatttgaagcactcggattattatctttgagaaggctatgatggttgactgcaaaggtctcgggggctactgtggagattatggatatcccatatctacacggcgatggtatttggactgaatataggataccgaatataggtagaatatcttatttgtatctcgggtttgtttcttaacttgtacatcaaggaaacaccttgagacttagtcggttacgactgtattttatctgtatctgtatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaactcatacacttttccagcttgatagccacccccttttattattgccgaaatctagtttcgacataaacacaccctttaactactccgtacactactacacacgccagcagtgatgtgaagcacagcaggtgatcggagagaccatctctaatactaggcctctacactcttacttggccacggcgagttctcgccatggacgacgcatcgattagtactgtaaagcctacgcgccggcgccgaggcgctgggtggcaaggtcgcagcgcgctggcgcgaagccgacgcggccgttctggaggtcgtactccacccacacgttctgctggtggtggtgcccgatcacgtacgccgacatgccggccatgtccgagttgccgaacgtcaggcaccacaccgcctccgcgcccccctcgccgcgccgctcgcctggcaccatgtacaggagcttctccccggacacggccacctccgcgccgcggagtacgaggcccacctccgggaggaggccgctcgccgccgccacccgggcctccggcccgcggaagcacgcgtcgaacgcgccctggaacacgaaccctggctctcccagcggggccaggagcaggcgcgcctggctcgtgaactcggccttgagcgccgcgtaggcgtcggcgaggaggaaggtgaactgcgtgccggagtccaccattgtctgcccggcgccggtgtggtccggcgtgagcacggactttgggatggggagcagcgcgcagccgacgcggatgccctccagctgcacggagtatgccacccggtcgaagtacggcagcggctgggagatctcgatcagcggcgtgtagttgagcggcggagccacgccgccgtcgtcgccgaggaggaggacgccggggccctcgcctggggcgatgcagtaggcgaagcgacgggtgcccgtctgcgtcacgaaggagagggtgccccggttcatgccgaggaggccggtcgccgcctccgagacgtccgtgccggtgccgttgctgttggtggcggtggtcgacgagtaggaagtgatgcaaccgaagtaggcgcccacggccacgggcggggcgccgccagtgaggaggaaggtgtcggtggcgaggaccccgtcggccgaggaggcgtcggcgtaggagagggagacgcggcaggcgttcgacggcggcgtgtcacagaacggcgggacggggaggtcgcggccgcgccactcgcacgccgtcgacgggcaggggaccgcgccgtacgaggaagaacccgacgcgttgaacgccggggtcagcggcggcgcgtagctcccgttgcagagcagccacgagagctcgctgccggtgtcgagcaccatcgtcacgttctgcggtggcgtgccgacggccaccggcaccgtcaggctcacattgtgccggaaccggagcctgttcgccgccggcgcctccaactccacctcctgcacccgcacctgcagcgggaggaccgtgcccgccggcgacctcccttctccgccgctcgcaagaaagacgcagaggcagagcagaacaagagacgcctccatgacgcgcgcgcgcggccggccaacgcagccacccttacgttttacctctcaaaagcgcgcgttaagcgagaccaaactctgcaagaatgcaaacggcaacgcactctggttaattcatcggatgcaccagcatccggcaattacaccatcactacaccttctcctcctcctcctcctcctcgtggcatcgacatctccatcattagcgtcaccttcgcgagcgttttgatctttgcagatgtgtgtgtttggtgtagcagagcagtagagcagcacagtacactacgcctactcgccatgttgcatggtcctttccttcaccctggggcgggctggtcccgtgcgtgcgtgtggggggctctgcagctgcaaacatgtacaggaggtgaagtactacgtacttctacgtggagggatcacggatctcatctcataaatacgctagtccggccggggcagcgaggactttcagcacagatgctcgttgtcgatggcaccatccgttgttaagtttgtcaaaggagatctttctgtgttactattggctccagttcatcctgtctgcggttgagaactcccaggtcgatagctggattctatgccatggaacaccgaaagaccgaacgcactggccagcttgcgcagatgtttcagtgccttgagttcaaaaccgaactagagcgaaacgctactagctgaatcctcggtcctccgtaggggtgagacggtcatgaaaattcccaagcgaatgcccgcttatttctgatttttatcagtcaagcaatgtgaaaatagttacttacagaacaaaaataaaaatgaaaatagtaaattatatgaataaagaaatgaaaatgatttctctgtttaccgacgtttccaaattttaccataattataaatttttatattatagtaattaccgttaatatttatggtccgtatttgacccataatttagaggcatgttaacttctcaaccaaatccctaacttaaatactccctccatttcataatgtaagagtttctagcattgtccacattcatacattcatatggatgttaatgaatctagacatgtatatgtgattggattcattaacatccatatgaatgtgaacaatgctaaaaagtcttacattgtgaaacggaggaagtacatgattaaaaggaagtcaatttataatttatatagtgcaaccttgaatttattttggttggaaaattttgctacataacacctaaaacttgtctaacttgctgatagacatcgaaaaaacgtgtcatgactaaaagacatccaaaaaactggtggtttgccagagaacaatttcgaatcaattgaagagataattttttaagaaagacgagaatgtatttagtaccacatacttcaaacaaggcgttaaaataaaagtttagaaattacgcaactctaaatttgccatcacttcaagtacatcactagcatatatcgtattccttattcactccatcctcagatcaaaagctttcgatcttaggggttttctcgtccttttgaagaattcatttctccaattgagccaaaagtatcttctaacaaattaccatttttttagagtgtcttttagccgtaacacgtttgtacgatgtttcccagca

SEQ ID NO: 39587 - DNA, 1914 bp, Oryza sativa
tttcatgcctactcctgagtcatgaccagcttcgctacgcgcctacgccgaatccagagcccagcatgatacttgttccatgggggccatactgatcatgagatgccgacgggcgccttatgatttttgcgtcgcatgtggcgtgctccgcgacatggaccggatcactgcactggacgggatcgatcacactgggctctttgattattggctttgccaactctagctgccgagatgggagattgggagcacgtttcccttacgtgaaagtaaagtgaactcctcgttgttgtacgaagcattcgcggatctggccttctccggtctcccggtctcgtcccttcggcgtactcctctctcgatgccgtcacgcttgacgacaccaagagaggaggacagaacaccgtgcagggagaaaacggcctgtgccttcacgtacgcacagtacgccgctaattttgattcttcgagattaaaatggaaatccttgtgtagacttggggtattccacgaaaatcaaatctatcatctcctatgataaatggatctaatacgagatacaatacatcttagtattatcaatgtgttgactcatgatattgcacataaatcaaatgtattcctcccgtcctataataaacaataggatatgatatactccctacatcccataaaataccaacctaatactgatatgacatatcctagtttgtttagattcgtagtattagtgtgcatcatatttgataatatgttggttttctattaaacggaggaagtatcttctaaaataaacttaacaacataatataacataatatgagatgtgacacataatgtgttgaacttatttttatcttaaaataaacaacgagatatgatacattttagcacaatcaatcgatcatataccgtatgttgggcgtatgtagggacgaaggtagtaagagataatgtcaaattcaaagctggaaagtcgccgtggttcggttcggctccacgaatgattagagccgtactacgttggcccctcccagaccaacagacgaccactatcctgcttcatttagcccaaaacagtagccacgtacacggcaatcatgcacagtttttaaagccccggtgcaagccagtctggcacgagggaggacaagaggatgtcacaaagcaagcagaatcatccaatctctccccctgcttgacatagattttgagccgtacttgcaccaattatatgccgcctaatttctgcaatccatcgctggtgattggaggcaagggtacacaatggagggtaattcaatacttggacgctgcaaaatgatgtcggcacgttggggagagaggggccaaaccagcaagcaaagtggagctaactttcagaaaacatggagcctcaccaaagcatttgcaaggacacacgcagggtgtagtagtaggactattggttctgaaatctggagcaaaccatttagaataaccaaaaggctcgcgctgtatttgcacattagcacccgtcgagtccactccgacagtgttgtgttcacagcagagcacctagcccagccatgctggcatgctgccaaaacaatcacagctgcattgtgagtttgatttagattattggacggattattatcactgattatctacttactataggagtaaattattttttaaaaaaattaataaattatcaggattatggataccacatacctaatagtagtagactaaatctcggcaggacccacaacataccatgtcctatacggaaataacatgcggatataggagtagttccggataaggaaagacaaccagagttctacatggaaacgacaaggactactcggattgtatccatattggtttccctagttctacttggacaaggagacacctatgggtata

SEQ ID NO: 39588 - DNA, 2923 bp, Oryza sativa
ctactcactggttctcaactagtcaatcgtagcgatctctcgtacatttccacttctagtggtcgagtttagactacacctggtcctcgaccagcggtgtagcgattctcccactatttctacttctaatggtcgagtttagactacacctggttctcgaccagcagtgtagcgattctcccactatttccacttctagtggtcgagcttagactactacctggtcctcgaccagtggtgtagcgattctcccactatttctacttctagtggtcgagcttagactactacctggtcctcgaccagtggtgtagcgattctcccactatttccacttctagtggtcgagttacgactactacctggtcctcgaccagcggtgtagcgattctcccactatttccacttctagtggtcgagttacgactactacctggtcctcgaccagcggtgcagcgattctcccactatttccacttctagtggtcgagttacgactactacttggtcctcgaccagcggtgcagcgattctcccactacctctacctcaacaagttgatatcaggtacacaatgtcgccaagcattttacccagagatcccttaccacaaagacacctagcgttgaaacctatcctcatgtccctttacgccgtcttgacaaggactccgaggaacctaaggaaacttcggctggggatgcccagagccgataaggccttgtcggatcctgtagagacaaaagtccatgtaagatctggtcgtgtaagagttctcgccgtgcgtattaaccaagccgtataatcagaaattgggttttccaacttcacggctgggggctaggatcagtgcttgttcaaccgaggcaggtcaaaggtccaagagccttatctcccgagaacgattctccgatgacaaggctgggggcggagagtgtataactcaacaaactgactgatcgaagtcggtaaaagagtagacgctcatgtgcaaaacattggtctgtaaattcaattcatttttagtttttcatatatattataacatgtcaccctttaagcgttcgctcgggggctatttctatctaatactcttttctgagtattgatttcaggaaaattctattcgacattatcgaaagctccatgtctctatggttctacaccaagatcgactaaggcgagtacgacaaatattgacaaggctccgtcgcagactctacgcctactcgattactcgagaacggttggtggatctcgacaaggaatacggaatgaagagatggtgtacccgccgagataaacttcttgacttcaatccaaattctcgattacagcaagacgggagacttagtcgtatgctctgtactttcttggttcacatcggagatggactcagacaaaccctttaggtgcctgcacgaggctgataaaggaagtctaacgttatctctgaactcaccgataacggtcacaagagctcgataacagttcctccaaggtctgcagttgagaatatgaactcgctcatttgcattgaagtcgggggctactatcagggttatggataccacataccaaatagtagtcgactaaatctcggcaggacccaccacataccatgtcctatacggaaacaacctgcggatataggaggagttccggataaggaaagacaacaagagttctacatggaaacgacaaggactactcggattgtatccatattggtttccctagttctacttggacaagaagacacccataggtataaataaaaggccccctaggaagagaggagacacgagacaatcaacacctaccacagtcaacatacagggaacaacagaagccacaacatacaagccaacatacgccaagacaagacgccggatattgacttcggagataggtacggctagtcccctgcggtgtctccagatactgtcagtagagacgaaagcgttatctttgatcttgccggacacgaactcgaggaggaaaactaccctgttctcgactatgagtcagaccttcagaccgctatgtcgataacagttagataggcaaccccaaatattgtactggtgcgattatggtgaataagagtaataccggcttcggccaacaggatgtagggttattacctgacaattcaggggcccgaacctgtataaaaatccctgtctccgtctcttttacctcagtctcgtgtatatcctagtaccaacgatccccataccatgcaaataccggaatcgcgacatcaaacgtcgacagtggcgcgccaggtaggggactttggtgcttcaggatttcgacgagatgggtttaagagatggattctccgacaacaagctactcgacgacttcggctgtggggaggtctaacccgaccggagtttgccttccgacgagatcggaaccatcgtcatcaactattcgatccgacgagatcgatcaagcttcaagacgtcaccgccgcggagaacaacagttcaatgttgtcgatcgtgaggccttggcccgattgattactttgaaaccacgtcgccgccaaaaatctaatcagattatccatctacatcatcagaggtaattagtaagattgattattaaattgatctactaattttgtagatacatccggcatgtatctacaaaggtatgcaatattttatatgcaatttaccgtacctatattcagatcatacagcattgtcagatccatgttatgtttacctagagcatgttttttatacaatatctattatacgagtgttttcggtgttaggccgagaacagtttaacgctgggggctcgctctattttcttccgtataaatcatgcttgtttacggtttacataatgcctgatatttacatctgctcgttatatcctgataatgctagaagatccatac

SEQ ID NO: 39589 - DNA, 15739 bp, Oryza sativa
  unsure (1)..(15739): unsure at all n locations
ttgtctgtggctcattcagcagcagtcgttctcgcggcgcacgcgctcgcagtgacggccaggacgaacgctgaaagttgtccaggtccaccgatacaattccaaaaccattgagccatcctgccaagcattttccctgatgagtacttagtaccaaagccagcctcaacctctggtacctaacaggaaagcttacctcaaaagaagatgagcgtccataatggcagggaaagcgaagggcgttctactgctcatcatacatggcctcctggaaagaatgggtccagtcccgattgacctgacaactgcctttcaatcttggtcagaagctcttaggctgagatacttctaaaaatggacccccaaagcttcgaccattacctagaccagtagcagtacagaatacctccatggatgctccagcaggatgtttaatcaaccgacattagatgatgtagaatgctcaacgaacaagagaacagcatttcatctaatgtaggtaacaggcttgtgggaaattcatgtagccctgcaactcagaatttgacaatggcaagatgttaacagatgaacacaattagcaggtgatacttcagaagattctatgaggtttcaactttcataggatatatctcccctgccgacaaaatgcccccacaatgccatcaagtaactgatattaaattactgttaactatagaacattggaaacaaacaggcatcatcctgaacatgtttgccattcaactagagaaccttgtcaaagctacacatgggtccactgaatgtcaacctacagttcagggaaggagtgacgacatggacgttttcatggaaattgtatcacagtttttctatcctggggctaaagaaaggccttctgataactagcaacagaaaattaaccacgtatgctgaaatagcttatctactccagagtaaaccattgagtccgttaacaaagaagaaaccaaacaggtcgcttgataactattcacagccagcagttgatgcaagaaaagtaatgcaactcgttagtattccttagtcactagccaatagataggaatctccaggtgcagaaaacaaccaaacaatcggttccatgagcaaccatgaagtacagttgcactccaggaatgacaaggtgaagaccaagtaacacacgataacactgttaactcagaaaagtatgttctactaactgcacagtttgtgcttaaaagtagtagacacggactatgagccaaagtttttaagaaatgaaaaccatttctatcctcaagtgtgaagagtgaaagataattggcatttcatttctgctgcaggcaataaagattggtattagatgtttcaatattcaccatggtaaaagagatgtagaaacaagcagacaactaaggcatggaactgcacgataagttggtaggaggatgggcaggcaagaaaaaagctagcaggatatgaatattgaacttgagttctgtttgaaatccttctgctctaagtaactttgaagttacttctctgtccaaaaaataatcacagtagagtatgatcaggtatagaagtaacaaaagagaacacaaatataaattggtaagaaaaataagtatgctattgcatgaaaccgagccttacggaaaaaacaaaagcattccatggtaactacatccacataaagcaggataatcaatatgtttcttcttccataacactaagccattaacaaaaggttgctagagaatgttttttgggttgcatcaatccatgttgctactgcagccacataaaccatgcatgattgcaaaatccaaatagacaacatgataaattgctacggcataaccatagaaatacaataaaatgtcattatgttgctatatatcataaaagaacacaagggaaaggaaagcaagcacataagaaacaaaaaggaaatttcacagttaggccaaccactatgcattaacatttacattaagagaaagaaaccacaggaatgaacatagacaaagaatcaccatgcattttgcatgatactgtaatattattgttcaacaaccctgccgcagagggaaatgggaacaatacaacaatactaccagcaactctagaaaagcaccgagtgatgaagaaatagaatagctagacctgctatgatgaagttacacataaaccatgcctgcatttaagcatccatttatgggcacagagcaatctgttaattgttcagagatataggaaaagccaaataatttgttagctgagtgatgctgtaaatgtattatctaaccatattacaagtgtaaagcaccatacaccccagatcccaaataaacccccacgatagtttaactcattgaagaaacaaacctactatcttggtatttcaacattacaaagtacaagcataccacagtcagactcaattatgtattattagtttcactctttatcagaataatgaaaacatgacagggcagcatgtgagacaggacacaaaagaaacaacaggcctgacataatgaggttggcatccctattcagcaaccgtactagctcaagatatgatcaagacattatagtgtcttatgtctagatattgtagcaaaatactatgcgaaacgtattatcaatattaaacaggacacacaaaagcttatattcaatttcaccaggagaatacgaacaataacaaataaaaaaggctgaaattttattagaacaagatattgcaaatcagaaatcttcttggcccaatccagtatatacacaaacagtacagaggtaagaacaacactttgttctctctgactacaacattgcaacaattgatttacccaataaattcactgtcattcctttcatgaagtcctgtgcttcttcctcctaatttgctttccaaactaatttccagttgtttgctattttgctcgtggccatctctaaataaactcttaaaacgggacaaagtggaaaaaaatcgcaaggttttcatttacatcaaaagtcccaagaacttataatctgggttcccttcttatactaaatcctacttattcaccactatcaataggagatcgagttaccgagaaaactgcgttcagccactacgggactgcgatgatgaactctccggccgactgctccgaccaaaacaaccaaacagattcctaaatacacggcgaatccgaccttcgccgccatcgacatggccgtcgccctccggccacgttacccgcctcggcccgacgccgttactgaagcccccatccagttcagtgtagacaaccggaagctgctcccttggcccaccggcgaacctcccgacggcgaatccaccgcgtgggagtcgccagatggttagtcccgcatctgcctccgactcgggggccgcggccgccggtagctcgcggcggcagacggggcatgagttgcggagggagagccagggcaggatgcagtcctggtggtagacgtgcttgcacggcatctcccgcgcggaggcgcccggctcgaacgcctcctggcacaccgcgcagtgcgccccgctcccggcaaccgtcaccgacggcatcgactccaccgccgccttcgacgccggcggccgcggcgccgccgcctcgagccgggagaactggtcgagcaggcggtggaagcccgaccccatgaggaggtgcgacacgtcgccgggcagcggccgcagcccgtcgccggagccgtcgtcgtagtagagctcgaacccggacagggaccctccccggagcacgatcaccgggttcatcgccccgcgccggccgctcccgccgccgccgcgcggcggcggctgcgggaactgctccaggaagccgccgtcgcactccgggcagacgaccgtggacggcgacaccctcacgaagcggctgcagtggtagcaccagtacgacaccggagaagacgccatccgcgccttgaaccaaatcgcccccaaaccaaaccaaaccaaatcgaaccagaaactcaaatcgtctgctccaaaactccagacgcagatcgagacgggaagccgaggcgggatccgaggaatcccacggaggcgaggacgccgaaatccccaatcgaattcgccgccggattcgaattgggggtttcggggaggagaggaaactaggggaggcggaggaggggaattgcggggtgggtgagtgggtgcgccgcttttatttgggacggcgcgtcgtcgcgggggggcggcgccgtcgaggtctgacggcggccgcacgtggagcgccgcgattgggtgggatgtgctgacggcgttagctctgtagagtgacgttgactggtcagacgggccgggagtcaaaggggaggcagggatggatggatgggagcgccggcgagccgacgggttaaacagccgccgcgtggatggaagaaaggaggcggttttgacttggcggtaaaacaagttgagtacttcaacatttttttttgagaaacagtacttcaacaattgtattagtttttatttggattccaacttttttcttcgaacgtccaacttttccgtcacaccaaatgtttaaacacatgcattgagcattaaacgcagacgaaaaaaactaattgcacagtttgcatgtaaatcgcgagacgaatcttttgagtctaattacgccatgatttgataatatggtgctatagcaaacatttgctaatgacggattaattaggcttaatagatttgtttcacaatttacaggcgaaatatgtaatttgttttgttattggtctacgtttaatacttcaaatatatgcccgtatacttaaaataaatttggcacgtgaactaaacacggcctaggtggtactactcaggttcaaaacaaaaagcttttcgtgctaacgatacaaggtgcctttatttttcataattgctacgaaactttcgtaagttttttcctccaaaacttttagatttgtgaaatcagatcactttataatttgtgtataaaggaaaaggaattgctaaaaagaaattttcacacatatcaagcgtaagatctcgatgctaaccaatcaaattatagttgaacacaagtttataagtttatataaattatatcgtagatacaatataattataatgcagttatataattacactttaattatgttatagatgtaactggaagtttttaataattcaaaaaattgataaattttagatactcccttattttttttggcaaatcgatatttataacttttaaagtatttatatggtaaggacatgtgatattatattatatttatattgaaagtacttttatatatgttactaatagcacatacatatatagtccataaaattagtgatcaaaccgtaatattgtaaaatgtgtaaaaatttaatacgtcttatattttaatttaatacgtcttatatttcggtatgaatgggatacacggtaatatagtgttggctgatgaccacttgtggcacgatgttggtcttcttttttccgaaacattggtgtaaacacacacttgttatatgtgtacgcacacttagcctacaagagctatatataacacttcgacagattgaagcaacatactccattttagattgacaaaatcactataaatatctcaacatcaacaaatgtatcaactatcactaaaaatataatcagttatattaagaatttaaacttggatgaacaagtttaaaaagcttaactggttgagctatgcttgatacaatctacaatggtctcttcgatcccttacagattatataaaaaagcatgaaacttaaggatggttgtgcaaaataattactatactgctctaggttcgatggattttctgtttctgcccctgtgatggtaattggagcttaatcaccgtgaaggcatgttctatcatatgctcattattttgcagaggctcatgcgtcccaaaaaataaggggacatgtcggccatagttgacagtgtaacatgggagaagttatgctttcctacgcgttttggcataaaagaagtttattcacatgtagtactagcaacacacagctgtaaaacctaatgcctcctggtgaaaatattattaacagctccagatgtctacgtgaatggccactgttgctgtaacatccctttcgttcactcgctttcataacgagtcagcggtacatgctccctgctcgggtcaaatcctggctcatgatgtatccttccgagtctcttaatcataattaactccctgtgataaacaaatgaaagctaaaggcagctgtggggaaagacacccatcccgcttcgtatggatcaagcagcacaattgacaccgcccatcacacatgccctgcacatagttgcatgccacaaattggccagagtacacagatgccaaaaatcagggaggtttgacatgtgcttcaagtccatgtcaggaatgagatcaaatcgttagaaccgaccaagaaatttcgggggtgtttagatggggctaaaactttttagcccatgtcatatcggatgtttggacgctaatttagaatattaaacataaactaataaaaaaactaatttcataaatgagagctaatccgcgagacgatttttttaagcctaattaatccataattatcaaaagtttactgtagcatcacattgtcaaaatcatggcgtaattagactcaaaagatccgtctcgcgaattagtccaagcttatggaatgggttttataattagtgtatgtttaatactccaaattagtatccaaacatccgatgtgacaggaacttggaataagtcctgaaaaccaaacagccccagattgctgtcatcttcaacaagacatgctacacaacaccatgtcttgtgaacagggcctgttaagaagcttcctctccatcccttgaagtcttttatagtcgctgttattcaacagggtctattaaaaagaacacttcttttcaacacctacagattgaatttcgtgcggccactaggtggaattcaggtactacttatttatgtgttagaaatgcagtcacacgttacacaaaattatttgacaagatgctttgtctagaaaagaaaaatatcacttcaatccaccaccaaacttaagacctgtgatgctccatactgtatcaatcatttatacttcatacaaacatttttaacactactcccttcgtcccaaaataatttaacttaagatgggatatgaccaatcctagtataatgagggagtacgctacatatgtaacaggtattcatactccagcatacagaagtgggtttattcctagggtcttagcttatggaacatagacgtcaataacgtatggcacatttcacaaaagaaagaacacctttttttcatccttccagaaggatagcaatcaaagaataaaacatagatctagctgtggctttcaaggctcactacaaaagtcaatgcctaaccagtccaaatccaacctaaacacaggagcaataatatataacaaccatccagcttcaaaagcaacatgcataattcaacaatttcaagctgatctgatgcatagcttcagttttaacagtatccagattgatacagctcgttgaaccttttagcaagaaagtcgatagctgtgtattagcctcaataatagaacggtgctatttttcagaacagaagatgccccaacaaaagtaaaaacaaatgaccaagaacatgctattgttttatttgcattgaaatgcaccatgttgaccattgaaatgcaccatgttgacaagacaattcaatcgtgaattcatgatacagaatttacgaggcacttctagtacagcttctcacaattcataataagaaaaattgataagaaatgatattaattcgaacaacttatggagaaaaggactatcactctttataatggcatcaagccaatgcaaagtcacatgtcgaatatcgatctgcagtaacagaggaaccctgtgagtgcacaaataacctaatgaaactaattacaatggattcatttatgcacgtgccctcattcatctaaagaacatccaacgaagatgtattccccacacttgttaaagaaaagagaggtttagtatcttatgcaactaattgctatatttacttaatcaattcctattctagcattccctaatgtagaatgtcacaaggttgaatactccaaggtccaagcaaccacatattcagtagtaatggaaacaaaatggtagagtgttctgaagttagacccaatttgacatttttactgctatcaaacttggtttccaaaaaaaaaaaagtacgagtactggtaaatcaaacaagccctaagttagacagtggaagatgtgctcacactggaaaaggaagacgaagtgctgtaccagcaatcagaagttcagaactttcttttccttcccctcgccttggccctcttcttcctcgcttcctctttctgcctctcggcctcctccctctcaaacttctccctctccctcttctgcaggaagtcggtaaccgacaggtagatcacctgcattgccaaaacaaacaaagcaagagcgaagatgaacacaatatccagcaacgctatgcgccaattcatggacaaatgctttaaccgcaagcacacatcacgcaccccgatggtgaggatggagagcccgacgaacgcgacggtcaggagcacggacaccacggtggcggtgacgctgtcgtcatccgccgccaccctcatcatggcctcggtctgctccatgggcgcgtcaacttcccccgccgccgccaccgccgctcggccgcggcgcagcctcgtgagccgcagcggcctcgtcgctccgccgcatctcccaccgcgacggagagcagcgtacctcaggaagagcggcagcggcgtcgcctgagccggggacgacgggaggacggcgagggagagcgggtgcgcgtgcgctgccgccattatcctcgcctcgcgccgcccgaagcggaacgaatggtcggaaaccgagcggacaaaacagctgggccaatccgatcctaaatgggcccgcgtgggccggcccatagggttcgcgtgcggtgggtgggcccgcccgcccgcccggccggccgagtaaattccagagggatccatccctatccccaaccttcttctcccccacgccgcgacgtgacgtgacgtcacgcatttgtcactttctcgtagcactctacccctatctaatccggtgcagcacgagaagaagaaggggagagaaaaatatctcgcgcttcacacgcaacgcaagaactcgacgaggcgagcgagcgatcgagcggacaccggcggcataataggcacgggaaggcgtgggggagggaggagggcgacggtaggggatggccggagatcggctgagctggtcggggctgctgaaatggagcctctcctacgccgacgggacgcggccgtctcgcgccatcaggtgaggaggatttggcttgcggagggttgattgctgttggggaaattggaatgtggcgggttctttttttccgtttcttttcttttctttcttcttgtttgcttgagttgtgtggctgatggtggagagttggttgggggtgtgtgggtggtggtgcgcggcagcgaggaggagcggaggtggttggcggaggcggtggagcgtcacatgatggtggacgtggtgagccgcatgagggagatcgcgctgctcatgagcaccccgctctccgtcctggaggcgcacggcatcacccccgacgacatcgaaggtatgtttcggttgggttgtcagtacagaccagcggttgtggttgatttgaaggattaagcatgaatttgagcgatcaatttgcgattcggatgatgaactaggaatgatggatattcgggaactaggaatatggattcttgactctcttttcttttcggttggcgatttggatgatgaactagggatgatggattttcgggaactaggaatatggattcttgactctctttttttaggtcggccgcggagaagggttcttgtctactgaattctttgtaaaattcgtgctatggtgttaccaacttggaagtgccgggcgtaacatatggtactcgggaaatgttctcagcaaattgaaaattttatatcatctaaaagttacttacggttttcgcaatccgtgcctacttttgagattggcaaggattcgtttttccgttgttctgaaatttcccgggaaggcgttattagagtgcgtctgcatgattgcatctctttgcaagttcatgatattccctctgttcttctgctgaaactgactggagtggatttgaatattgcaggtttactggctgagttgcaggtacatgtcgagtctattgacatggcaaacggtacgtctagccgtggtcctctagactctagagcatcaccattttgttccatgctttactactgttgttcatcatgcttcatctgtgttgtatgttcatcattcgaaagctatgatgcataatcacatatctaccattctatattagcataaccacaaaagaactgaggagccttcacattcacacaattcaagctagggtctggtccttgaacaccattttacaaaatgtacatcccaaacagcactagccgtccaatatatgtgcgcctttgttagaactctccaccaccatgagtttgtactctttgcataatctatgtttcttactattgtattgctgagttgctatatatgtgatctcaaatccattccttaagttaaatctacaattccatctgtaggaaacaaatgtagcacttggaggcatacattactggtgtcaaaatgagtactttcataacattggatgattcaaaggcatttgtagttactgttgaggtggctaaacaaatgggcggaggcaaccatagtgttttttgcaataaaacattgtttttcaggtgaattctcagcttccccttccaatacagcactaatacaacttccaaggggagctgacagatagttgtcggattcctagactcacttcacaaaccaattcaataagacaaaaaaaaagtttgaaatctggaaacaaggagcatgtgacagttaacaaccaaatgttaacatattgtcggtgtgaattgtttcatatgtttgtaactttgtatgcatcatctgttgacctattttgtttttctttagatcttcattctgttggtggcttggttccggttatcaagtacctcagaaattctaatgctcgtatccgagccagagcagctgatgtggtaactacagttgttcaaaacaatccaactagtcagcagctggtcatggaagccagtggctttgatccccttttatctaattttacgtcagatcctgatctcactgcccgcataaaagctcttggtgcactatcctgtaagtatgttgtctatctttttcagatggtgacaataataataataccttgatgttcccctcattgacattgttcccatttcatgttcagccttgattcggaacaacaaaccaggtgtttctgcttttcgtctagccaatggatatgcaggactaagagatgcattgacttcagaaagtgcaaggtttcagaggtactttagtatagttgatctgacctgagccatcttatttagtatttggcaacattgacttcagataagtgaggagtatttggcaatgcttatgtgcttttgactgacacgcatgctgtctcttccaggaaagcactgaacctcacgaattatctgcttagtgaaagccattccggttgctcggtgtttgcacagctaggtttcccgcggcttatgatgcatttggtgtccagtgatgacttgggtgttcgagaagctgcattaggaggactgcttgagcttgcaagggacacgacactgggaagtaggagtctactagcagatcatgacaggcttcgacggcttctccaggcacgtatagagagaataaggatgatggctccagaagaccttgatgctgcacgcgaggagaggcaactcgtagattcactgtggattacgtgctaccatgaaccgtccacacttcatgtggaaggtcttcttgttttgcctggggaggaatgtttcgaacaacctcctgacgtggctggtagattcttcgagcctctgcggcgaagttcggcaaggagagcaccttctaatgagagatcagatccaggagatggaactgggggaggaatgatgctgcttttaggtccatccccaggcagtagatcaaactcggggagtaattgatcactctgggatgtgaattacatggaaaaggagactgggagtctgctgtcctcttatgtacattgtgcagggctagtgctatagagtgttgctgttaaggggctagtaaaaagtaaataaataatttcccagtttcgaagaaatgtaagtggaaaatatgtgtgatgttcagcagtgtataatatgtctgatgtttagcagtgtgtagtctcatttatanncaatagaananntgcgaanactacttgnttgtggntacacgcaagcaacncntnacananctgcantggngntgcgcgngcctgtattacgttatgcacaattgtcaaactgtagcgggccctaaaatagntatagtcacccttgtacatngtttatgttgtcatgtnnggaaggagtaatnnacaggctgnacaattnnatctctttgcatctactatgttcactaganagctatgctgctgcatattcacatttcaacctctgcggggtgtaatagnatctattgtccttccggactatttctgcgattttctgcgttacccccaacctacaaaccttcttgtttctgctcgtctctggctgatcatccccattacaaagaagtctccacccaactatagctatcaagcttcttcagacgccgtctcttcaccaacctcttgatcttgaagacatcatcctgcttgccagcgttcgccagcgcactcgagagcaggaggcagctcgccgcattgtctggctcgactgcaagcaggcgcgacgccgcaagctccgcgagctcgatgtttccatggcttcggcacgctcccagcagcgcgccccagacgaagcggtcgggctccaggggcatcgccctgatgaaaccgtacgcctcgtcgagcctcccggcgcggccaagcaagtggaccatgcaggcgtagtgctccagcctcggctcgacgccgtactccacctgcatggctcggtacaggatcttcccgacctcgaccatgccgccgtagctgcaagctgtcaggacggcggtgaacgtcaggtggtcgggctttgcgccgtcgcgcagcatccggtcgaagaggccgacggcttcttggcagtggccggagttcgccagcccgaagatcatggagttccatgtcaccgtgctcctctgtggcatcttgtcgaatagccggcgcgcttcgagcacgagaccgcacttggcgtacatgtcgacgagggcgctgctgacggtgagctcttgctcgacgccggccacgacagagtagccgtggacttccttgccatgcttcacgtcagcgacattggcgaacgcgggcaggatggtactgatcgttgccgagcttggcaggacacggccgccggcaaccatcattgctcggaacagtgcgcgtgctctgccgtactgaaagttcagtacagagccggagacgcgcgatgtccatgtgaccacgtccggctggaacccgtcgtctttcatggcgccgactaaatcgccggccatcaggtcatcgcccgccagcgcgaagcctgagacgacgatgttccaggtgaccaggtcgggacacaggccgatgccccgcatcttgacggccagcgccagcgcgtgctccgggaggccgtggcgcgcgtagcacgcgagcagcgcgttccagacgaccgggtccccgcgcgacgccatttcgtcgaacaccttgcgggcgctggcgacgaggccgcacttggagtacatgtcaaggagcgcggtggcggcgacggcgtccgaggcgagggcggggcgggtgagcacgagcgcgtggatgaggcggccggaggcgacgtcggcgaggtgcgcgcaggcgcggagggccgtgggcacggcccccggccaggggtccaccgtgccacggctgccagcttggagtctgaccccggtgaagaagaggcggaggacgtcgccgtggtggccttgccgtgaagagcttgtgagctgcctcatccatgagctggttttcgccgggcacatttgccgctgatccgaaccggtgtaacgctgtggctgtgttgcatttcacttcaaatgaaggaaaacgcttcagtctgagctagaaccggacgggatgggagagtagaaccacaggggaatatctttccaaatttcagctaatcaatcaaaaatatacatgaactttgaaatctaaatttcactatagtagctggtcccgttcatttctacaacaagatttggatgaagatcaagatttttgtggcacgtttttttcaaactgctaaacagtgtgttttgtacgaaaactttctatacgaaagttactctaaaatatcatattaatctatttttcaagttcgtaataattaaaacttaatcaaccatatattaataccacatcgttttgcgtaaaacacttcatcttcatctacaggaaaaaagaacaccaagctgatgaggctttagcagctcgggaagggactgaaaacttggaacgacaagaagaaacgcttgacaccagtatgataggtccaaggtttgaattcagcggtgccaaaagattcagataaacaggtgaagctctgagccgacaaaatgcagcaacagataggagtagttaccaacttaccatagttcaactaaaatttatagcccgaatatgggacaaaactgctagaacactttatctaaccaaagcaaaagaacaaaacaaaaaaactctagcactgaaaatgacaggagcaagtacttctgtcaaagaagcaccagactgcgatcaaatcttgcttcctacacaatactaatcctgaaagctaacttctcactttggatggaagcaacattgcttcattatttcagcgggaacagaagttcctattcaagttgaatccagaaacatcaacggttcacacaacatgcantaggtgcttcaggattctatgcctgcaaatgagctaaacagccccctcaatgatctattatccactggtggttgactgaactgttttcaaaatctctcgccaaatctgaagaaaactgttccagtaccagcattgtgatctacgatgtactctccccttaccaagccaagcttgacgccaagaccatatgatgacccatgaccaacccgtcggaagaactctgtggggttccctttcacatccttggaactgccaaggtcagtgccatgttcaacaaatccatacacatatgtgttcctcacaggaatacgcaactcactcgcaacctgcaggattaaaagatacataagtcaccaacaaagcaaggatcactatatgttgcaagtagccatggtactggcatcaattatatctagtagttctttgttttataattctaaaatagagtaaatttaagacattgtatcacaaaactacaaatttagcaacaaatttatcacaaaactacagatttaatatt

SEQ ID NO: 39590 - DNA, 9688 bp, Oryza sativa
tgaaacaagtcaatgtttcaaaatgatgctcacaaacatacagtactccctctgttccatactataagacgtttcgggtttgtcctaaatttgatcgagtttgtaaagaagtgtagcaagattttcaacacaagtcaaatatactatgcaaatatattgaatggtggatttaatgaaactataatttggtgttgtagatgttgctatgttttttttttctatacacttggtcaaacttgaaaaagtttgacttaagcaaaccgaaaatgtcttataatgtggaaggggttgtagtaaggtactcccaccatcccaaaatatagccttcagcacgggtatgaaggagaggggtaaaaagacttggttgccttcttgggatgggtcagctataggttaggttgaggctataataaagcaaaggggtagaatgggtagaaggggtattttagtggaaaaactcaccctttacaagtactaggtagcatctatatttgggacaaaattaactctaggaagttatattttggaacggagaagtagcaattaatgaccacagttacatgaaggttgattagaacagaaaatttccaagttcaacatttgatgcaagacatggttgtcaattaaaaacagttatttgaggaggttatgtagacggtttcaaaagtagacattcaagttttcatatgaagtaatcaaaccagcacgaaccaatattgtccctcttacaactgataacaccataacacttgtctaaacctacaaaaattatgtttatctaacagtaacaaaaagaaaaaaaaagataaccaagtgaagagaacattaatcacgaactgacctgagggttgagcaggttgctggatgtaacagaaccaacaatggatctgtttagaccatagatgttccggtgctcaaatgacacagttcctccaggttgaatggatgcctaaaataattgccatcagatacgtcatacgtgttggtagggatggattggaacggtgttgttaaaataaagattagagaagaataaaatgttggctccacagtaggtaaattaccagagttggtcggccttcacgtccaggtacgatgctccactctgtacttacttcagctgacttcggttctaattctttaagcttgatttcaaccacaatgcccccttcttttgtttcatcagggcgtggattcacctctatattggagaataaagcaagtgaatttatattcttcagagcttgcttccctgctccaatgttaaagatatggccaggtcgaagctgcaggatacagaggtacaagttactgaaaacactaatatatcacattcagaataagaaatatacttttttcttcaagacccacatatctgcaactaatcactaacagtggcaagaagtatgtagtaaacgtttaacttcaggctttttcatggcacaaaatcatcccacatgtcatgaaaggggtacatgctactgcttttctagaatcaacatggcgataaaattgtatagtggcactaaaagaattccgtgctacaaccagaatccaaagtaatcactatgtggcagggtattcaaattatcgcttataccttcctaaacacatgatctagttatatgaatcactaagaaaattcaaagatgggaacaaaattatattctcgtattaactatagcagctagcggtatttggtatacctgctgtgggagctccctgtctatgataggaatttgggtattcccctcaacaaaatttccaagcttatcctggaactggtactccactttggttatatccccctcgaccacctcgcaaacaacctcactggtgtttaggtttccaaagttcaccacctgggcgcagacgaacccctcattgtggtaccatttctggacatggtccctgatcctctgcaggagcctagcgctcaccttctcctgcttcttcatcattcctagcacctccccacgcacgttatctggcaatatgcacggcttggcaccacgaacacgctgctggtaatcacgctcctgcttccggaggtaatccatcttctccctctctgtcatgtcctggtcgaagtcaacctggcccgactgcgacattagccccacattgatgcacttgaactgcttagcagcgctccacacgctctcgacaaaagacacggtgaggccaagggtgccatcgggcttggccttcccctcgaggtcgaccctctcgaacatgccacaggacacgagcgtctcgagctccttcagaagctgcgacttggtgtacacgccgccgggctgcagcgtcaccatctcgaagaaggaatcctcgggccccgtgaacgcgcctccccctcccgcggcgcggtcgaagaacttgagctcggagatcttgtacctcttcagcccgctcagcttcgtcatcggcacgttgatgtttgccgggagcccgtgcgggtcccaatcccccgacgacttctcatccgcgtgcgccgcgccgccggagaagatccgcgaccagaacccgccgccgccgccaccaccaccaccacctcctcctcctccggcgccccatccaccgcctccaccgccgagaggacccccggcgccgcccccgaacccgccaccagatgacgcgagaaggaatgcaccagaggcggcggcagtgatggcggaggcgagggcgaaggttttcgagcccttagattcggatttggagctggacgacgcgacggcgaggggttgttgggggtggccgtggggctgcgagttgtgcgacgaggcggaggcggcggctgacacggaggtggagcggccccgcccccggactctccgggatgggccggcggccagcggggagaagaagaggctctgggaggtgagcgccattgcggccgccgcggatggtggcgaggcttcggtcttgccgccgggggaagcagaggaatttgggggaggaggaggaggcggatgggggggcttttctcgtctagccctgggtaagggttttcctcccaccccctatcttttccacgttccaccggcttcgcgtgttccggttcgagggtttagccgagtctttgcgtggcggctgaacgccttttttttctctttttttcacaacattttctgctttatattgccggacacaatctccaaatcaaacgtattttgtaagtttgtatggtcgccattacttgcaagaaatatatgcacgtctgtacgtgacaaaaagggagaactgcaactacatatcggtgggcgtttcagatgtgtatcctgccgccatcagaacatcagattcagatgtgagttaaatctgctggcttgatggccctctttctcttgaagcaactatgttgcgttctttgcttccggcaatagctataccagtatgttgttacaaaacaaatgtttggatctcctttctttacacgtgtgttacatactcatacgtaaggattaacagttactcgtacaggttaataacccttccaaaaagaagatggcaatgtggtggtaagtggtaactaggcagcacacgcatgcatggctagctaccagctctccacaggctgcagataatgctgcagcgactgaaccttcttcctgcccctgagcttccggaacgcgaccagctcgatctgccggatcctctccctgctcacccccatcagccgaccgatgtcgtgcagcgtccgcagccggccgtcgtccatcccgaacctgtacctgatcacctgcctctcccgcgggctcagcccgtccagcgccctgtccacgtcttccttcatcagccaccggtgcagcatctcctccgccgtctccgtgctcgtgtccggcgtgatctcctgcgatgtatgcggtgatcacttggattcagtaattggccatggatgaggtcgaggttttgtgatgtgttcatgttgctcgggcgaagggagcagactcacctggtatgtcatgtcagtgcacccgaccttgctggtgagggaaacggtgtattttgggaggctcatcgccgcctcgacgcgcctgagcggcatgccggtgtcggatgcgatctcttcgttggtgggtagcctcttcagctgccggcggagccgccgtcggcattccttcacccgggaacttgcttcggccatgtgtgcctacaagcagagcatcataattcataagaagcctttctggtgtaagatagcaacgcagcaaccgtcaaaaacagcggtagatggttcatgaggaaagacgcacgagtgaaaaatcattatgttataatcgttgcttggtttgtgttgttcggttgagcacttgttccatgatgcaaatgaaaatcaatgtgttaaatgaaatataacagtatcaactatccacttaactattgcatgtcagtgattgtagccattcccatcaatcaccgttcaccaatgtgcagacatcaaaaccaactacttgatctagtaatgatggatgaaaaagatggcactatgaaatgaccaaaagtacaatgcggaagtgaacataccggcaagcgaataatctgggtttgttctaaaacggatttgcgtattgcttgtttgatccaccagtgagagtatgtagagaatcgaaaaccctttgaagcatcaaacttttcagcgcctcgtacaaggccctgtattccttcctacaaaagttacagaaagaaatgtgagtcataagcataatcatagaagggctatacttaaccgtagaaaagggcaagcaaaatacctgaataagatcagaaaattccattccaggaccttcaaactctctagcaattgagattacaagtctcacgttagactttaccatcgtgttcttgcaggaaattccatagttcagacgttttcgcaaagtgttctcgtcagttccagctgcttctgcccactgtgagaaggttggttcaccgccgttgtagtgagcaagctccttttggatagcttccaacttcaggagatcctgtgtcaattcatggcaaccatccatagtaagcttaagttggtgaaaatggtgctaaacactaacactgtgtagtctgtactgacgatgatgccaagaacaacaagaataatattgggactagaaaaccagtgttcaagagatgatattggaacagaaaagcaacaattctctaaatttttcaccttaactgttaatagtctgttactgagccatattcagcttcttgttagcgagcaatattcaccttactgctagtgagcaatctaggatgggattttagatgctgtggaatttgctgcaataaacatatgctgctgcaacatttgtaccaaaacatgcatcctaaattttgcaagcataacaccacaaaaccaaaaaatgcaatctcacaaaatgcattcaatttgttagcctcacctgaatgccttgtgagaactcaacttcttgttttgctgtcagaagcctccggccggtcatcttgtagaagcagccgagaggactccggcaacccttcaacctcttcttcctcgccgacgacgacgccgcgacgggattccggccgctgaacgatttggccgccttcatcgccgccctcaccctccgagctctcctctcggactggcgcaccgatttcacagccacgccctggacgcactgctcatcgtcatctacctcggattcatcgctgaagatactggagaaccccgcatcctccgacagacaggcatcggcgtacctcgcccccaatcccgcctcggcgcggaggatctctctggccaagtagttgtcctccgtgtcgtgcgtcgtgacgaagtcaggccggtgccgttgctcggtttgcgacatccggacgacctctccggcgacctccgccgctgcccttgctagagcgacggcctccgccgctgcggccgccaccacggcttcttggttgagaatcgcctcaccgaaacctccctggtaattacgcagtccaaagtaagattgagggccatgaatcccagtgagccgcccgcaggattcgtttgaggaaacagggcatggtcgtggccagcattagcccggaacacagcgaaaggacgttaccggaagaggcggcggcgcgacggctccgtcgtagacgacgagacgcctcgccccgggggccaaggaatccgagctctcggcctctaccagcgcggtggtggacaccgcgcagtggagcctaacggtacggaacccgccgattccggcgccgccgtgctcccggaacgccgccgcgcgggtggaaaggggccacttgagctgcggcgcgaggcacgccatcggtggcgcgcgcgagagagcaggtaccttaggctcgaacgcgcgacgtgtatctacctagctgttgttgccgcgggcggtaacggtagaagtagaacgcgcggcggagccggagaaggggggcgcggtgaggcgtgcgtggctacgcgcggggaagaagcgggagagggcacggggagagaagcggataagagcggtggggacgggagcgtgcggaaagagaggtggctacctccgcacctgcgtcgtgggccggaccggtaattttggatttttatcgtgtcaaagaacgcggataggaaaaagtacacccaaggtccctcaacttgtcatcgagttacaaaattgtcccccaaccgtaaaaccatataccggacgtccctcaactaacaaaaccatttactttagatcctttgtcccccaaccgtaaaaccatataccggacgtccctcaactaacaaaaccatttactttagatcctttgttagttttgaccccggttttattcgacgtggcggctgagtcagcgtgggacccacgtgggccccacatgtcagcatggccacgtcaactcctctctctcccctcttctctcccttcctcatctctatcactcttcttctcctctacgacttgggcaggccgaccgacgggtcacggcgtcacgccacgcacgacggcgacgctggcgtcgcgcgagacgggcgggtgcgctacaaggagggaggggacgaggcgccaacgggggaggcgaagagcgcgggtggcggggggaggggcagtgcgcgggcggcggggggaggagcgactgccaacggcggaggagcggcaagccgggcggcggcagacgatgttggctaagcccaggaatactctcacactcacgaacacaaacgccggtgaggcagacgatgaacaatggattttacagcgacgaatgccgcggagccgatcgctcctgtatcttggctttattactcactgaaccttgcaaagaaacaacgaaggagtacaagggcctcttatagaccggggacacaccgggagctagcctccatgccggccattgcaccacgttccgcagaacccgctcaatgtcgccgtgagccgcacgctcgcccggacgacgcggcttcctccgcaagaaccgacgccacgcacaccacgcactcccacgactcgatcaacactgcaacggccatgcaaacaaccatgcagcagccatgcactcgcgatcacgactcaatcaaactaacagaacgcacacgacgcacacatgcagcagcacgacacacacacacactgactcaaccacgccaggaatacaccatgacgtgtttatttccaacaatctccccctaaacacgacatggcacacttcgttatcacagcagcgtcggctcctcatcgacgttacaaagcaacgcctgttccttcttcttccgcggacagttcctcgccatgtgaccgcgttctccgcagtcgaagcactttcctcggtagcggctcctaccgtgtcccgagcttgtgctgctgccatcgtcgtcgtcgtcgtggctgccgcccttctcaccaatgccgccgtgcacatgctccttgccacggcgttgacgccgcctcgcctcccattgctcctccgtgagcaggagttgcccagcatgctccgcgctagacgccgcttgatcctcagcgtccgcgtcctccgccacctgcaaccggccgacgagctcctcgatcttcatggtgtcgatatcggcgagcatctcaatcgccaccgcgacttgcttcagtctcttggggaccacgcgcagaactttcttcacgacgcggctgtcctccatctcctcaccaagctcgcgcaggctggcgacgagaccgttgatgcgcatcgcgaagtcgccgacgttctctccgtcacggaacgtcatgttctcaacctgcttcatgagacgttggacactcgcagccttcatgcggtcgtcgccggcgtgcatcttcttcaccgcatcccacgcctccttcgccgacttcttcacggcgagcccggccttcatctcccttggaacggcacagatgatcatggccagcgcgcgccgatccttgccccggtccttgctcactgcctccactgcgtcccactgctccaacgcctccatgctcacttgcatcaccaaagaccattcgtggtagttggtccttgtcaacagcgggagctccacggcgctggagttggccatgacgcgctcggcggcacccgagctcgatccttctccgatcttcagtgacgagctatctccgatcttcgtcatccggctctgataccaattgttggctcagcccaggaacactctcacactcacgaacacaaacgccggtgagggagacgatgaacaatggattttacagcgacgaacgccgcggagccgatcgctcctgtatcttggctttattactcactgaaccttgcaaagaaacaacgaaggagtacgggggcctcttatagaccggggacacaccgggagctagcctccatgccggccattgtaccacattccgcagaacccgctcaatgtcgccgtgagccgcacgctcgcccggacgacgcggcttcctccgcaagaaccgacgccacgcacaccacgcactcccgcgactcgatcaacactgcaacagccatgcaaacaaccatgcagcagccctgcactcgcgatcacgactcaatcaaactaacagaacgcacacgacgcacacatgcagcaacgcgacacacacacactgactcaaccacgccagaaacacaccatgacgtgtttatttccaacagacgacgccgagtcagggttcgtcgactcgcgcctccgccgccgtggccgtggacgacgtcgatgtcgacctcggcatcctcggcggtggaatgaactacatcagctagctcaccagctggcgtccggcatccacggccgcgacggcacagccgcccacacgtgccgagggcgacgtcgtccgcagccacggcgacggcagcccgggtcgatgaaccccgactcgtcgtcgtccgcgttgttgtaccgacgctggactacgagcagagaaccgcgctgcggtggagtagcctgtaccggcgcatcgtggtggggcacggtggccggccagtgaggcgcacactgaggacctgggatgaggacgagcgttgcctcggcaagtaggagctcgcccgccgccgctcaatctgacaatggataatcagagaaacaatcaacaattaggactgatatgtagacatgaattgaaattgccaacttgtagtgattcctggtacgttacaagcaaagcatgtgcaggatggccggagtggcaggagacgctgcagctggcgccggggatgccatcgctgc

SEQ ID NO: 39591 - DNA, 1234 bp, Oryza sativa
tgggccggctctgctcccacgtcgtcgcgcgcagagtggagctcgacggcgcgggtgatgccgtgctggtccttcctggccgttgtcgaccgcgtggccgtcgccgaggtcgagcttgtcgcctcgccacggtctgctcccgggctcgacgcttcgcctcccccgtcgcccgcagctcctccccccgccggcacctcgtgggcctcgtcccctccctcctcgtcgcgcacccgcctatctcgcgcgacgctagcgtcgccgtcgtgcatggcgtgacccatcggctggtctgcccaagtcacagagcgaagaagaagagtgatagagatgaggaaggagagaatgtcacgaccagaaattcacgaaccagaatttctaagctgaatgtgtattacacccctgtccaggactagccagggtacacaaacgacaattgttgacatacagatccacgtcttacaaaaatataaaagattacaaatgcagcggaaaagataaaagcgagctaaaccgggaagcttgacttcagcagcggggcgactccattccacaagcaatccttgacggcaacgacggaaccaacctctctgagacggctccaactgagaagaacttcaactctagtgtgggggaaaagagagcaagactgagtactacccactgtactcagcaagtcataccggaggaggtatgatgcagaacataaccaaaggaggctacggggttcatttgcataaagcaggcatttaaaaccagtagttgaaaacagtaaaaacagttgtagtaattaagcaatattaaccagtcactgtccaacgctacaccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaaaacacagccccacgacacgtttctgtgtgccgacatgccaccacgacataccggaaagaggccgtgacaggacccttcgcataactccctctaaccgatcgcaccacaccttagggttcgcccccgtccccagcaggcaacaggcaacccccctttagtgccgcagtgaatccggaagccgatcaaccggacaccctggccgacccaactccatcacgcccaccctcgcctgggtacgtcggctagaga

SEQ ID NO: 39592 - DNA, 4578 bp, Oryza sativa
  unsure (1)..(4578): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcaacactgctataccgatttggatccaaaatccactcgatatatccaaagaaagctgagctgtaacctgcaagtcaaggtcgagacgttacgtcgagggacgccgatttctgcagcgagaattgagcatatatcaaatgggatgacgggatcggggtggaggatgtaggttgcatgcaatgcactcaggcccgagagggacccatccccgattgcggccacccgggcgttccacggccgttgctttcgccgatcgcaacgctccaactatcaagtttggacatgtgtgtgactgacaccaacacgaaagctatagcatctgcccattatcacaccaaccctagacagtgtagcccacaccgatgatcgatcgaccgatcgattgggtagccgcagccgcagctggctgctgggaaaatgaccgcacaaacagaactcgatttgtatggttcgttttaatcggtgtgcatttgtttactaacaaaagctccaagtttttaatagaaaaagaccaaaacttctcgttcgtgggagtgaaatttcagttgaaaacggaagggtgaagggggagagtagaatgatcgatcggtacgtgccggagtgtccaatcgatcaattataactttcgtgactggtcttttttaaaaacctgtaacgacaagaacatgtggctggcaaaacctagctattatagcacggaggcaaacatatgcatcggtatggcagcgcctctgtgccgctgtgtgtgaccccagcatcgatcagcaggcaggcagcagtctctatctcgctcattatctttggccttatcctccctatcggaaaaaagagctctgttcgaactgttcgttatttaatatagcatggaaaataaaggaaaaaagatagtgaacgaacgtttgaaccagggtacagctacgtacgcacgtataatctacttgactttggacaaaggaaaagaaagaaaaaggcttgacagatctcttccccgtgtgtacgtttatacgcgtgactaactccagcatccggaccggatgatcgatgcatgcattgatgagaagattagagcagcagccccaccctaccgtggtctgtggatacacagcgctgacgacgagggagaggagacgacgaacagtccaaaggcgcacgtgttccagcagcgccgtgaaaatggtgcaatgcatgcgcgaacggtctcatatgcagtctcgaccgatcgatctcatctcactactcggcatcgacggcatgcatgcgtgctagctactccctccgtcccacggtacaaggaattttgagtttttttttaactttggaccactcgtcttatttaatttttttaaatataaaaaacgaaaggttatacttaaaatactgtagataataaagtaagtcacaaataaaataaataataattttaaaaaaatttgaataagacgagtggtcaaacgttacaagcaaaaattcaaaatccacggaggagtagctagctaccagctgccctcgtctagcacctgtttgcacgacattttttcaaagcccacctgaccccgatcagagaggccacgccccgcgcgcgcccaccttccgcgcaccttcaccctcgcctctctctcaagtctcaacgtaggcagctacacgtggatcgcttggccactgatcagtgcaacgacggcgtacgtgtaacgtactaacgtgtacccgcgcgatggcgaggaggacgtttgcctcgcgattgggattgggccgattgggaacaagacgaacgcgcggtgtgtgcgtgcgactgcgactggttcgcggcttcgcgcggtgagtggatctgtggaaggggaagtctagagggaagctaagcataaatagccgcgaatagcaacgcccatcggtccgttctctaccataccagtagcagctaattaagtgggtgggttcgcttgcttgctttgcttttgcttggagacgggagcgacgctggcttcagcgattggcgtggagaagctagattgttggtgcgactttccgaccgcgaaaatagtagggctggcaaaccggtggccggccggcgatccggccgaggggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatcaatgtctctctacctagctagttagccttccacttctttccctagttgtttgagtaggttaattaatcatttaccatgttaattaatgtgctatgtaatgcataagtactcgtgtgatcttatcgttccattttcttcagagtttgaagaatgtaaaattactgtgcgtatcaagatcggcagtggttgctcacttgctccttcactagctatctgctcgatcataagctcttgcatcttgttcttcgcaagcaccaattcacgcttgtgtcaattgcttggtcattttgcatactttggactactcgatcactacaaaatatttcttgagttttactccctgcatgcactgctcaatgcgtgattatgcctgaatacactaattgttttgttagaattgtgcatacatagctatgcttaattggatgtgttctttgtacatgcatgcatggttttgcttaaactttcctaattatacctcaattcaaatcctagctaggttcacccagagtctaattgtatatttcagcatattctaatgttttgttcttttaaaattctagcttgctcggtatgtttatttatgtttcggtttggtagaaaaagttcagttgattttggcaaatcaattattccctccgttgctatattttgggatggatggagtaatttaatttctagtttagtaagcttcgtcttgattattctctctctctcttgtcgcacaaacactcgcacatacagatgaattctttggttttgacttcttaatgccgcactacaacgaaactcatgcatgattgtctaatccgggcatgcgaatggctatcgattgcactacggtagagagtaacaacctgacagattttcatgttaagtgcgttacgttgtccagattcaattcatgcgtcacacacctaaatgcaaacccaagcatgctaaccttactatggaatttatgagtagacaagtgcagtacaactcaatttgccatttgtgatagtagtgtgtgtatatttggtagtgcatgcatgtcttagcatgacactaaaaagggagtgacaattccatggtcagcaatattccggctgctgggaatcaaagttaatttgcattcctgtctgccctccaaattaaaacactttcatgcataattccattctatcaagaataacccacactaacacagactaatgctcacccatcttttcattgtcttcttttgtcccaaattagttcggttgggcaggaaaaaaaatgctctcgtcacagaacaaacactgcaaagttagctgtgacttgtcagtgccgatttgaagaagcatggagccatggcgagacggcgacacggtgacactgtgcctgggccctacgggacactgccgggtgagatgatactccctccgtttcaaaatgtttgacaccgttgactttttagcatatgttgaccattcgt

SEQ ID NO: 39593 - DNA, 31941 bp, Oryza sativa
acatatgctaaaaagtcaacggcgtcaaacatttcgaaacggagggagtatatacgaagagacgaggtgaggtgaggtgaaacgaaatgatgatggaggtggtgtctaggtagtgtttgtgcgtgtatctacacgctccgacccccacgaaacgaaagggatcttctttgctcattacccatctttggatgcccagagtacataccatatgtgtcatctctgtcacgccagaacgctgtggagacgaaccttcatgtacaaaacaaacttattcgctctgaattgccgccctactttcttcttgctagggacacgagagtgggcgcgactgtggtagtatgcgtggatgggcgaatggcaaaaacgttgggttttgatttcaagtgtgccggtggtgggggtgagtctccgggaaggaattgggatgcgatggtgtattgtgctatacaaagttggcgatcgatgccgccctgtcgtgttgacaagccccttggtcgttgagagagctagctatcctctggagtgcaagcatgcgttcacatccgacttgacgtcgtgccggccgggccctcctccccgccacggcaaagccagggattgaggtagcgagcgccgcgcggtgatatcggtgtgtggtaggtgcaacgcgcgcgaggccgtttccgccgttgtttttttttttcccaccggagcgcagtgtacgtacgcgcgcgggcgcctagctcccacgcgtcgggacgcggaggcgagcgaggcgcgggggcggggggacggtgggtggagcggtggaccgcgcgcggacgcggacgcgcgggcgggcggggcgggcccgtacgagcgattgccccgcgtgcgtatggccacgcacaggcccgacctccccacgtggaggcagtcgcgtcatttaagccacgggactatttgccgtcgcccagcgcagcgtgcgtgcacgcgccgtgcatgcatagtagggtaagcgagtgcatgggggcagctggtgaaccatctgtgtgccgtttcctttcggctttcggccggcgatccggtcgcactttgcgggcaccgattcgtcctacgttgggcagaagaaaggttcagatttcagccactacagctacaagtggtaaacttgcactactgtccgctgagaagcagggactgtagtggcgagaggagtggtggtagagtacaagctggtcagggagacttcatctccgtatggcgaaatttcatatcgcataagtctaacctgctccccgcctctcccatccgtaacaacgaggaggaatagagaaagccatcaccggtagccaataagtctaaccaacttgcgctgctaaaaggaagacggcgacaacgacggccggcgcgtagggcagtggcacatactcgcccagaggccacggcacgtgtgtcgccggcgcgacgcggccatgcaagtggcgcgacttatagggcgcgccacagtggccgcgtgaccgcggcgatcggctataacagtgagccggattaattgagatcgactatatatctatctctttctctctctcgatcagggtctctccggacaaccaaatcccggagacgttttgacggcgacgtcgctgccgtccgacgagccgggcggcgccggtgtgcgcggtatgatgccctattgccctgcatgaccgcatgcggcatgcttgtccagatctgagtggcggcaatcataacagtttcgcaacgccgcggccaaaaataggaccgggattgcaagatgcggagcaatcacggggacgtgcaatcattcggcgctcggcgacgcagtcacctgactgattgcgtgtaggaagcaatcacgagaaaccactataggccggcgcgggaaacgggagtgcaaattggtaagaggcctagaaggctaacaactaaaacaacggatcgagtaaaggaggctccactaatcctttccaacctgaaagtgttaagctgattctcccggggagaaaaaagtagtagttgaaacttgaaagcgttgcaagaaaaatccgggcgcataagacagaaaaaatgcaggtagggtgaattaaggtcttggatgaggacgactaaacgaaccatgagtgatgacagtaatttaattcaagcgataggactgtaaaatcagtaaatgacaaaccaggccataaatacatggaaaggataaggatggaccaatgaagcattaagaggggagcaaatgactttgtggacatcaaaatttggggggaatgttttgttccttcacatattattgtgcacttgaccatcggttttcgaacgtaaaatattatcggctttacctcgccaaaagaattttatttacgctgtggtaaaatttcgctagttgtcagtcatattcctatatgccagttcttccctccgtgccttatttctgacgatatcagtgaatctgtgattgatcttgaagggattatcctcctcgcaaagatttctcggaagccactatcatggcgcctctagagtggtgatatacttgctgtacacagagggcgagctagacgcctagaccgtgcgtcaaactcagcttttaaacggttaagcggagcgttttgcacaaaagtactttttatataaaagcttctttaaaaatcaaataaatatattttaaaatttataataattgatattttaaactccctgccgacgaatgattcgagtaaatttataataattaatattttaaactccctgccggcgaatgatttgagttgtttcgcatggcgctaaaactcccagctgaaacttagccgacgtacgaacatgttggggaatatataacacaaaataaacccaaataagccaatggggaatacgacttgttcggttattctcaactctgaagaaagacaaaccaaaaacacattgctcaaatatgttgggttatttaatagccacaaagttgctcgagtttatttcacttaacgaaattgttacaggcagtatattagtgcgtaatgatccgacaaggtcctaaaataggcaaataatcgaataagctaagtggtaatactgctactattgtgcagtacaacaaatgcaaccgatggaaaattcacctaccaacgaaaagccaaatgcacgggaaaacaatactggatctatccatatgactatgacagtaagttacgaccataagcaacaaaagactgcaagcagaaaaacaaacgagaacaatcttataaaagaaaatgaaagaacaccggtgctaaaaataaaagtaaaagttttgcagataaataacattgcataaaatccataaaaaaaatattcatgaaataataacagcaactcttcaaaaacgacgtgactggttgacaaagaaattggattaaataaagtaacaaaacctacaccaaaatcagaatataagatcaaattcgtcaggtgaattcggaaaagcggcatgctgtatccaaccgatgagcaataaatatctgcccgtatgccatcttatgacattgcatactgcaagcaaaaattgtgctcagattactcctggacacttatcaaatttgctttgtgcaaacaatggagcattatctaaaacatgaaatgtgagtaaattcgcaactcaaatataacgatttgctccatgctggaaccgcaaaataagagggcaagatgaagtgttctctcaacagtacaaaacatttgcttatgggcgttccgtctggtctcaacaacagtgcaccctaagcaagcatcagagaaatacatacatattttcattacttgatcagaaccaagtcatgaagggagtaacacaaacctcaagccaagaatcagtaactttaaacaggtactctgatactattcacaacatcaaagaggttaccaacttggttgttgttgaggtgtggattaaatcaccctgaggaacataaaaagcttgtgcacatggtgctaatctgccaataatccagatttaaattaacaaagcggttcattttaaattaaggtgcacactgaaaacaaaatgaacatgttaccattctaaaagcaaacctcatagcaccagtaacacttcctcaatcgtcattgcaagacatgattactaattcaccttatctaaagcttttccataatcttcagtacacatccaataccaggtttcaatacaataatcatctacggagtactaactagcccaatttgcacaattaattcatgtagtatataaatacaataaataatttaactatgtatttttcggttatattttttaaaaacaaattgctcctagtaaattcatctgacagatactacaacagcagattatgagaaatatattgtcactaattgagattaatgttaataacaactgggagcacaagataacataaatatttccttctcagtattatggttgtacagacttataaaagcaaacattaccagataactagcagctaagcctgaatacagctgcatcaagcaaacagctcaggaatcctcaattactcaggtcaactgccacgtaaacatacagaacattaaataggagtcatataagcacacttccagaacatgatataagcaaaagaaaagtttttaaaagatgtaaatgcatagcaagagattcctcagcctagtggttgatggctttctttgctctaagagattccagagccttctcgcgaagctcaatttcaagtttctgctgatccgattcgtctcttccattatatgaacctttcttcctagcatcagcatctgagtcagattcacgatccttctcaagatctgaagccatatcaacagtttcagcatgcttcagttttagtttgctggcctgacggtctgcctttctacggtgccgctcttcacgtctgcgccgtctttcctcttttcgcaacctcttctcttcctttctcctcctcttggactctttgtcatctgactccgaattagattcatcagaactgtcatcataacgtctcttatgcttacggctctttttatgctttcgcttctcagaatgggatctatgtttccctgattcttctgaacctgaactgccagaatcaatgttgttattaccgtgtgcttttctcttatcttttcgaaaaggacttccatcttctgactcagaatcatcatcgattttagcaggatacttcttagaagccataccgtcacgtaaaccctttattgcatcctcactgttcatgccatcctttgaataagagttgtgcattccaactctactaggagtgtgctgtttctgttgggaatcatcaggagaatcaaccgtgtgtttcgttcttctaccatcacgctcatcttctgatgactctgacagttgattgttctgtttcctccttgtctccttgccactagaacagaaaacagtgtcatgctagctgaggaaaaagaaatggtgcttctgacagttatagctagatgatacaaaatgaacagagtaggtattggtaattggtctattagttgacattacagtcattaggttctcaatctgtccgtaacaattgacaccactaccattatagtgtgtactttggtaagtaaaaacaatcagctaaatgctttcctaccaagatttaaaatggcaattccagtatgcatccatggactttgtctagaaataaccagtacatgaataagaaaagagaaacacactgaagtgctccaggcaaataggaaaagtgctacctcatgaacagtgctaagaaaaaatgctcataccaagaaaaaaaaatgaaagggggtaaaattaaagaaaactaagaagcaatttcatttgacaaccaaaatgcagcaaagaagcttacctatgttgtgatggagatttttctccagggctcaaatcatcatgtgctttctttagttccagatctgctgagaaatccttaatttttctgcgtgatgaatttgcttttcgtgcattctctctgaacataaacaaaagaaccgtttatatcaacaataagaaactcaaacaacccttttgaaagaagggataggtagaatggagactaccttgcacgactgccctcctcttctccactgctatctgttctgacctgactgggcaagtgcttatcagtgcccttcaaagaactgccaaaaaagatggccaagccttcagtatgcacatttgatcacaaatatgtggagaagaaatgaaagaaataaataaatcgatacggacgagtagatacctatcgcgtgtcgagttcctttctggcttgtttggagaattcaaggattttgtcagcttacgatgctcagaatccgatgaaagatggccactcacttctgtatcattcctattgtcatcgtgtgatctttctttgttcctgatgtaacagaagtaagagaacagcttttctgaataattgtactgaaagacaaacaaaatatgccatgcacattacctttgaagcacatctacatcgttactggagggaatgccgtttgttcctttttcaatgtctctactcaagctcctgcgagaatggattgggctcctatcgtgtggactggtactccttttaaacatcagcataaataatcgaatcagaaaataattacatgcaggaagactacaataggtgcacagcaaattcaattgctcggtacctccttcgttgtggagagggccgacggtttgcagaacgacttctgggtgaaattggcgatctcctagggcgttttggtgacctcaaccgcggagagcctcgaggagagggggatcttcgtcttcctggagatcgtgaccttggcctgcgtctacccggagatggagaccgtggcctacgtcttcctggtgaaggggaccgtggcctacgtcttcctggtgaaggggaccgtggcctacgtcgtccgggtgaaggggaccgtggcctacgtcgtccgggtgaaggggaccgaggcctacgtcttcctggagatggagaccaatgcctgtctagagatgacctgcgccgaggagatctatgacgtgcaggagatggtgatcttggtgcacgacctggagaccggcgatggtgtggagatggtgatctctgacgcacaaaaggtggagatttcctgcgaatatgagatctacgatgaggtgacggagatcgatgtcttggtactgaaggtgatcttctggaatacggtgatctccgcctcgacatcgaaggggtacttcttggagaacgctttcgtggagaaaaagaacgcctaggtgaaactgagcgccttgaagatcgttgctgtctcccaaaagaaatggaatttctggaaggagatggagaacgcctcctaggagaaacagatcgccgcctaccgcgaggcgacaaggagatgctcctggacctaaggctttccctgaaatgagaagtccaataacattgccatcacaaatttgttttggtggaatcagcttcttgccatgtacatgtgtaactagaacaacagtcaagtgaggtcatggatgaattacaggctcttaatccagtgttcagggtccaaaaagtttagtcctactaatttgctgcttaaaaaaagtgagtgcaagaaagagtgttgattctttttctatcaagggtttgtcagccttagaatttcaattttgatttttcataaaaagattcaacaaaaagaaatgctaaaaaaaaacagctggtcgtttagggtcaaaaacaaaatcaccaaatgatttgtgatcagggaaccttaaaaaaggcagaccaaaatgaaagaattgtgcacaaaaagtttcaaattattgtaacttcaagtgttccataaacaagaaaatactaactttagaatcatgttgaatccagaaaatctttatgagcatattctaaaattcaaatacaacgaagaacaaacaacggatcaaacttaatgcagaaaataatgacaagctaaacatatgtatgactggtaaatctttaagatggaaaataaaggcactccgtaacagaaaaagtggaatccaagatgtggttgttctctgagaatttgatctgatgtcacggatttaaaggtagttccagtttaagaaggtagaactaaccggctctttgttcttgagctatgcttagaatccagttctttttcctcctcagcatcagcacgatcaggacctaatctagaattaccggcatccccgtcctacagcagttttgaggtaaagaacgatatgaacccaaataatcggagaagctatctgaatgtcatcagaaacacaagaggttacaagacaacccgaaaattaacagcataacaaaattggtcagaatgaattagctcaccatcaatttttgtttctctagttcttgctcccttccatctttctcccgtttcttctggatctcctgagcaattctactttcctctgcctgcgcataagcccaaggaagttaatgggtaagcatcccctttaatgaaattaagccgcaataaagcacaaagatagtaacaacaccatgaggtataaagtgtattccagtttcacaggataaacggataaatcctaaaggctacaagaaattttgccgtttccataaatcacatataaaaagttatcaaaaacaaataggacctgtaagaacaaaaataataataatatgccacaaataggatcaattattattccatattccgtgacaaagaaaaacagaaagggtaatttaaaacttctagcttgcattctctccctcgagttcttaccaaaaaaaactttcattgtttttggtaagtcatatggattcatcaaaaacagatgatctaaaacatgcacccaaatatagcgataatgcagtatatacttatgttaacctttttctgctgaatctcagcttcctttgcatctaaaaactgttggggcaccccactagcattctgttgtgcactgagtaggaggctccacagctccttcatgaacttcactgtgttcttctccatgaatcctgtcagctgtatctgtatcttctttccatccgcctcctgccaaacaaacagaaattgaaaccaaaaccgtattagccccaccttctaatatcttgtacagaaacccacaaacgttaagcactaaacaaacacaaaacataattactggtttcttgagttttggttttgaccaaaaactagcctagagcagacaaaaaaaaattcaacaacatgcaaaaatgactgccgaaagaatatgctatctaaccataattaacggtacacacgacgctggtattgttttacaaatttgggaaaagtatccaataataatcgaaattcccaacattttacccaaaaagaccgttgtaggttttcaatttagttcctgaactccatgtataatttcagtataaatactgaactacaccatgtatttggttttctgtcatgttcagacataccctcatgtatgaggtttagcaattcaacgagcctatcttcgtcaaattcaaaagcagcctacgtaccacgcgcatagttcaacgagggcgtaacaaaccaacctccattgctcaagtcaaataaacaatatgtttaaaagcctcaccttctcttcgaggaggccgtagatgaagttgatgagcacttcgtcctcgaaccctaggagctcggtgacacgggtcgcgatccatggtttcatcacatccatcttcaccttagtcatgtccacctgtaaccaacccaacagagagaaaaaaaacaaacctaaatcagagtttgcgtcgaaacaaacagctggtagcacaaacgacacggcaaccagcaggtgcgtgagcagatgaagcacactgaccaggtgttcaagctcgggcgcgaacttctgcgtcttgagcagcttcgcctgcttgttggagaaacgggtgtcctgatcggccgacgtcccctgcgaaaaccccacggcgaatcagcgccgcctctcacagatccagcgagcgaggggctacacggcgaggtgctagatcggtacggaggatcggagctacttacccggaagaagccgcccgacatcttagcaggcgatgcagcggcctccgccgccgccgccgctttgagggggaagaggggtggctagggtttcggcaattcggcgtggtgtgggaagagttgaagacgacaagttgggggggtgtcgcaattgggaagaagggcgcaccggccacgggacgaagtgatgtagccgcctttagcccgatccagaacggtcactttttgacgtgggccgatgcctccggacaatgggcttctttcacaagcgacaccgccagcgggtagaattatacaaccagggcctagttttagttccaaactttttcttcaaacttccaatttttccatcatattaaattttttctacacacataaacttctaacttttccatcacattgttccaatttcaaccaaacttctaattttggcgtgaactaaacacaccgcaggtgaaacgccggacgttaccatgggagttcactacgagaacaataactaaaaataatactctctccgtttcaggttgtaagactttctagcattatccacattcatatactcccttcgtttcacaatgtaagtcattccagcatctctcatattcatattgctgtaatgacttatattgtgaaacggaggaagtagatgttaatgaatctagacacatgttataagactttctagcattgtccacactgctagaaagccttataacctgaaatagagggaatatgtaagatagtttaaacaacataagtttatataagttgatatgatttaaatttaaatagtcataagttttcgagccaactttcattatccatcttatttgaaataattttaaaaacaatatttttgttgttattaggcgataaaacatgaatatcattttatatgtgatttgtgtttttattgttttcaaaaaaaataaataagacaaacggttaaagttgaacttggaaactcataactacgaagagagtactcgaaaattcatgttgattggcgtgccatatattttatagtccgcatgtagcgtttttggcttatttgaaacttggttagtttccatgattttatttgacatttaagatttctatcatagacatagtgtacaaatattttcgtaagtattgaccatctgagtgagatttgggtgatggtcatacattcgtacgacatcacaaacaaggtactccctctgtttcaggttacaaagacgttttgactttggtcaaacttaaactatttcaagtttaactaaatttatagataaatatagaaatatttataatactaaattagtttcatcaaatcaatatatgaatatattttcataataaatttatctcgagttgaaaatgttactacttttttctacaaacttggtcaaacttaaatcagtttgactttgactaaagtcaaaacgtcttataacctgaaacggagagagtagtattttattgagtaaatttcacagaactataggtgctctgatcaaattattagaaaactacaaatttaacatgatgcatcacaaaactacagatttaacactaaattcatcacaaaactacagatttaaggtgaaatgttacaaaactacatatttagtaacaaagttatcacaaaactacatgtttaatgataatttaatcacaaaacttgaaaaattataagtccaacataacattagtgctcaaaatttaaaccctaaaatatgtagttttgtgataattttattattgaatttgtagttttgcgatacttagctttaaacttgtagttttgtgataaatttattattaaatctgtagttctatgctacatcatttaaaatctgtagtttttttgataatttgatcaaattatctgtaagttttatgaaatttactctattttatttttcaatttatcagtttttagaacacatgaaaaaatgattgtgttatactttctatgtttttttacgtgaaactttatttaggagatttcccatattctaatagaaatatgttctataaatcatcatatagaaatttaatatttgtctaaacaaaaaaaaaatctgaatattttgtcttgtctcttcacaatgttttacagcttcttcttttgaaaatgggtatgtcgttgaaccgcttgctagttaagccacatatgtgatgtaaaattcatacatttagtacttcaaacaatatattttatagcctcttaacaatattttaattttcggtgtggcatgtataatacattaaagtgagatttgttttaacataaacactcagaaaccctagtgtttctttttttcttctatccatattatttagtgtgtcttttgttgtaataccataattgaacaaaaacggttctatcgcttaacaaacccgcgataaaatatgtggcaatgtttgtttatatattgtcaaatatcattatttttcaattgttcattatctttttactcctagtgttctttatttttcatatattcacttgtttctcccataatggtagtattttttttacaaaaaataatttgttgcctttttttttctagcgacacaaaatgtgcaaatccccgcgtgcagaacgcgaagggtgagaatggcaccggcggccagggctatcgccaagtggactgtgcatgctttggcttaatttatttttgtttttttagataatggattttcattaatccggcctctatattcacgagggatatacataaccagaatgatacaagagcgcttagactcatgcctcattaaagaggagaacacacacaaaaaaaaagacgatcttgacacatccctatttcttgacatcctcaattgaaacgattatattcgatgagtggaggtcatgtagcttgtgcgttgtcgctacaaaactccgctggtgtcatcttcatccgcttcaagtgagttgatgccacgttccgctagtaagcccacctcatctgtcatcatccaatcagaactagccaaccagacgcgagctaaaggatccgcttccacttcactggattcctatgcctccgccacctacagggctgccaccgatgtcgaaatccacctctgcctctcaaacacccaggcctccgccgccgacgggatctgccttcgtctgatccgcctcctcctcaccgagatccttgcaccgacacttaggctgttgctgcctctagggcaacctccgccacagccgaggaggcgcttctgcctacgaaccacctccgtcggatccgccttctccatgcagagggctggttgtcgatgtcctccgctgccgcagttctctgtcgcacccaccgtcggcgtcctccgcagcgcccaccacctcccgaagaaacgccgccgccgacggctcaccgctacctgctacggcaccaatctcccgaccacctccgctaccgcccgcgccaggcgctagcccactaccgctgcccacagcccctactttctccggcgttagtgccgctagatctgggggcaaaccacatacctgactcgcccgtccatcgcaagtcccgtcggagtcctgccgtcgccttcctcgcagtcgcacgtcacactggcggcctgcttgggcggcagcaaggcaacaacgaggagatgataagtcgaggagatgaagagtcgggggagacgaggagatgatatgatctggtacatcggcttaatttaattttgtgatgtacggtgagctgttttgtttcctcaaatgaataatctagatttatctaccaatagagaactgacacgtggaccaatcattgccaacaaacacagcaagcatcagaatgataggtatgtacattacccaagttagcacatattttacagtgatgcctaattacatgaaacatgtgaatgtctcggacaaaatgtgtaacatgtgaaatactactatgataatttaatgtgcaagtttcctaaccacacacaaatgggattcaaaaacaaaatatttgcgatattttgacttatcaatccgctccatgttttctacccgatcaaccttctcattcatcattgatgagcttggtgaagtccgaattaaaattcaaggataggtgagggagtggagagaggagtatgcgggaagcatagtaagaacataccggtagagaaggtagttagcaagggcggagctgatagcaggggcaagttaccaaagacggaattgatacagcggatgggacaatgtagaggatcggtaaagatcacaggagaatgaaaagggaagtaacatgatccaacaagccttgtcggtttggggccgatgccacggatgatgctaggtggagaggcgtggcggagattggattgggtggagagaggaggtgatgatggtgaggggagggattgagaagaagaggagacacaatatatggtaaaaatatagagtaatctagacaattccatgaatccaatggtcacaaattcatacttacatgattttcaatagacatgtcctacccttgaataaacatatgtacattaccacgtatttacagtggtatcatattgttttttctcgctgggatgcaagaacatttagctagctagcacacagtgtcactcttcaaatcataacaaaaaaaattgtcctgcggtgtatccataatggtggatacaaatgctttatgcttatataccatgccaatataccgggcagtagagcgccagacccaacagtctagtcgtcgtcgtcccaatcggccggacggcgtcgctcatcgtcgtaccagcaaacgcagctgagcccgatgagcacctcgacgatgacattctctgccttgtgccggtcggcgaagtgcagcgtctgcaccatcagcacgcgcggccgcatgctgaaccgctgcgcccgctccatgctatgctcgtcgtgccaccgcaccgtgtcgtgcgccataggccccaaccaccgcagcatcctgtccaccgcgtccatcgacgccgccgccgcagcctcgtccactggctgccctctccagctctctctcagcttcgccttcacggccgtgcggatggtcacaggcagcatcttgtacagctcgtctctcttcgagagatccatcccggcgtccacctcgttgctgtggatcgttggccaaagttgcctgagcagcatctcggcgcacacgatcatgttcgcgtatcgcagctccatccccgagccgccaaccgtgctcgccgggggcttgatggactccgacgctgaaaaggcggtgtctttctgccgaaagatgggagccgagtgccggatcgccgcggccggtgacgccgcctgctgtaaggggccagacgtgcggcggagcgcccacgcgcgacctactgtcaaaagcggcaagcccggcacgtacgcaccgaatgttattgagatgcgcgcgagcacggcgagcaccgacttggccatgagcttggataccttgtgcgcggcgacactccagagcgagctctccatgagtcggcgcaccttctgccgctgcgagttgagctcgcgtatcagcttctcgccaggttcggggacctgcctcttggccgatggccccggctgcgccgggatcggcccgctatgcctcatccactgctccatccgccgctccgacgcctccagctcgctgagcgcgtccatctccgcgtacagcttcgccgtcgcagccacgtgccgctccatcttcctgaaccgcttcgccgcgcccctgtagaacccaaccgtcgcgtccagccgcgcgaggccgttcccgcgcttcgcctcggcgtagacgcggtcgaaatcgtgcaggaacggcgcgcccgcgcagcaccgcgccccgaggcgcgcggcagtgccggcggcatggtcgaggtccgccacgaactcgccgcacgcgagccggagcaggagcgactggtccgtggacgtgacgcgcgcgacgccctcggcgcgcagcgcgtccgcgcggagcctcctgacctccacgtcagacagcgagcggtggagcgacacgagccgcgacatggccgccgccgcctcgaacgccaggatcccgagacccgcctcctccctggcgccgccaccgaaccgcgcgcgcaggtcggcgagccatgacctcgcccccgcgggcatgccaaaacctcacacccgacacggcaccactttacttaccaagctcaagaacacaaggaaatactatcaaataacacccaacgtaacgagcagccgcgcagcagatcaaatatcatcagtatgaaatcgagacaggattgttcatgcggattacgcgtctaaacagcgaaggagcagaaccagcacgcgaccggacggtatccaagcaggattagccattaggagaagaaatacgtgtgctcggcagcgcgacccggagcgggtcaagagaggcgaagtcgtccacgcagccggcaaatcacgagaggccatgtgcacggtctacccgtccaccgagccagccgtccacttcgatctcccactggccaccaccaccactagctagacatgtcaacgtgccatggaattcctcccatcctctcgacccaaccgggcgggcgctgcacggccggagacttgcctcggggaagtcttgcatcgacggcgacgcctgtcgactgtcgtctcttcccgctgggacacgaccgatctacgtaggatcgcgagatgagaacgcgcgagcgtaaggcgccgctgctgcaacgccgctcgcttagtttccacatgtgtcgacatgtcgatcacctgtcgtgggtaattgcacgagagagatactggacgtccttctcattctcaatttctcactcgattaatacgtgtgttttgaacaggtagcaagacctccaataccatccttgttcccatctgaaacagtaattacataaaacggtacggtgcattaacgcgtgataaattaagtattagccatttttaaaaaaaatggattaatttaatttttttaaacaactttcgtatagaaacttttttaaaaaaatgtaccatttagcggtttgaaaaaaagcgtgcgcacggaaaataaataagaggggttgggaacgcacccgagtgcctgatctccacggatgtaatctatggctcattcattgctcaattacgatccgtttgctgcaaatgcacaccgcctgattctgctcagctatatcgtatacacgtatcccaaacaaggttacaccgtatacgtatgattagaaggtacgtatatacgtaaggctgtgtgcctgtgtccatcgatcgcctctacattgcgatcagatgccactactctgtagtattattgccacgtacatataggtacgcgtcgtgttgtcatcgatggcgcaatgcacgccaatgcgactagctaggaatatataagacggtgtactaaccaaccaatgctgctgccgtgctgcgtcattgcgaatgggtggaggagaccaaaggagactccgcgatcgagcaaattaaagctgcgtcacgtggaaaccacccgggcatacgcatgcaatgattatacaccatcgatcgatcgatcgatcactcgcacaaaaagaagttaaaagtgccgcccacttttgaccgcaccactgtccaatgcacgtaccgcgcgcggcgcgacgctagggcatgtaccatatctaaacacgactccctaaatctataactaatataaatatttaaattttttctatcgtcacaagtcggacgaagggtgccttcgtccctcgcggtgcgccttcgtccgcagcccctgaatcccaatccctctcagaattggatacaagagaaacaatttccaaaatcggcacaaccaaatcactcagctacaataatcacaaaatcacaaaataaacatccaagaagaactacaatatacatcacaatcacaaaactacatcacaaaatttcactcgcctgccgccggatccaaccttgaccgtcgccactgccgccctcagccgtcgccacgatatccatccatggccgtcgccaccgccaccggagggagaagagaggcggcggaggagggagcctccgccgctggatccgcccgctgccgccggatccgctcgcggctgccgccgccgccgccaccgccgccggaggaaggcgagagggggcggagggagccgccgccgctggatcgaccggcgcattaggtggcggcggggaggatggcgaggcggcgcagctccggagcctttcctcccgctggatctggtggtgggagggcacctctgggcggccgccgctcttcccactactgccgcggaggggagggcgcagccatcgctgccgatgctgcctcctgccgccgctgggccgcaccgtctccacctgccgccgccacccctcttgcgccgccgcctgccgcctcggctacgagagagaggagagcgagagagaagaccgagaggaggagggcgccgtgcgagggggaggggaagcggcgcactggtgaggggagaggggagggcgtcgctggctgcgacggcagtggagaaaacaccgagaaagaggaaaatgaagggaggagagagagaggataagggaagtcgggaaaaacgagaagatgaggagatggaaggatcgaggcgccgcttgctccgcttgctcgctcggggataaggattaggtctggcgggccttatatcttttttttaaaaaaaatgagcactctgtatttgagaaaaaaacagcacaagtatgccatataaccggcacatatagagatttatagagttggtttttaatttttgttcggttttaagtctaatgggcctttcttttataacttttttatttctataagaaatatattttttaaagggctcatatcataaaaactaaatcctaacgatctaatattttttatatttttgataattttagtttacccgttgcaacacacaagcatctatttattaaaaaattttaaataataaaattttcttgacctgttcttgtccgctctttttttattatgttttttttttattttttcccctcaccatctaatcttctttcatttctttttaatgtctacttattaatatttgacctcaaatacaatttgtaaataaaaaacaatactcactctcacaaaattaataagactgttttttacgatttgttgaactccacacataggtaacaatacacaagtatattcccactattgcaaagtgggtatagtttaactggataggtttcttgtggtggaaccagtcaatctggattcaaatctttgatttgacacgggtgctcgaggcgttcatggttacttcgtcaatctcaatactcgtgttgtgagcgcgtttgcactttgtgtttctaaatatatatatatatatatatatatatatatatatatatatatatatatatatatatatattctcgcaattcaaagtacattgagtacaaaaattccactcatgttctacataaaaaataaatatttttgttcatgataccaattttcatctgtcgccttttcggcaaagacaatcatattattcgtccatccattttctcccgtgctacaaatcatccaaactaaacatcatttctacaaatatagagcagattatttatctaaaagcaaacaatttttttgagtagattagttgtctaaaccaaacaacactattttcactatacacactacgtaatcacccagtgcaacgcacgagtatttttgctagtatcatctataaattatgagatgaggcgagaagagaaaagagagaataagtcacctctcatacaagcatcaatctctttacaaacttaaggaaatagaaaaaaaaaggttgattggatgagagtggataaaataaaataattatgttacattagggctagtgtattaaatgcgatgtggtgtatgagatggccgctaataaattaggtggtgtttggatccagagactaaactttagtccttgtcacatcggatgtttggacactaatttggagtattaaacatatactaataataaaaataattgcataaatgagagctaattcgcgagacgaattttttaagcctaagtaatccataattagcaaatgtttactgtagcatcacataggctaattatgaattaattaggctcaatagattcgtctcgtgaattagtccaagattatagaatgggtttttgtaattagtctatgtttaatactccaaattaacgtccctacatccgatgtgacagggtctaaaaattttagccccatccaaatagggtcttagttgatgatgtggataatattttaaagaggaacttgtaaaccatcgccgggaagacgccatcgacgacatggatgacagatggggagggagccacctagattcgcgccgatgcagctaaggatgctcattgacggtcgaagaagaagagcaggcgatgacggctagggaggaagccgccttgatccacattggcgttaacggctagagacgagcgctgacggccgaagaaggagaggatgcggcggctggggagggacccacagatctgtgccgacaacgacagttagagagggagctgtctcaattcgtgctaacgatggtgccggggacgcgcaccggctgctgaagtaaaggatgtggcaaagaggacaaagccgctcagatccgcactgacgacgacggctaagagcaaggctaataatacagccagctgctgacggtatagatctttatagcctatctctcagctcactcatatagtgattaactcttcctataaatatatggttcacctgtctgtctcacatatttttattttggttcttgtgtctaaggcggctgtaagtttacaacccatttcttatctctctcctctcctcttttatctacatcagcatttagccttcttgcagccctctattattcttgctctaaggcggaagccgcctcgattcgtgcggacgatgacggccggggggaagcctcaatccacgccgattacgttgatcgtgcctggtttggagtctttcgtctgtcgtgctagttttaggtcaaggtcaattgcccgtttgtattgccagagtggagcgcttggagacgagcacactgcgagaccgttgcaactcgccaaggagttttggtcgcaacgtcgtgtacaaaaagagagtcaatatagtaagacaagattagtttcttgatcatgattagggcatggggcccaaaccattggaggagaaaagaagataaatgggagctatgtgggtttttctttccctttactttttcatgaggaaagcccttcgtacaaaacaaaagcttgacaagggtccttcatagggtgtattcaattcacaccaaaattagaagtttagttaaaattgaaacgatgtgacggaaaagttggaagtctgtgtgtgtagaaaaattttgatgtgatggaaaaattgaaagtttgaagaaaaattttgcaactaaacacggcctggtatattgtacgcgcctactgaacctgtgggccaaaaggactgcttcattgcatgggcctttatggccagattgaccacggcgtaatgaaattgggcaaagcagagcatatacaactgcacgaccaccgtaacgtggatgatgatagccatcatgatgcgacgataatagttgtgaggaccatattagacgataatgtactcttgctgtgcatgattatacgcttgggttcaataacgaatgttggtgttatctgtatttggctgtagccctacttcatttgataatctgtccgttcggcaccattattatcgtttgataaggcgtgagcggaggaccattaagctcgctcctgtatcatcatgtgatgatgtccctaatactcgacgaaagcgctgcaaaaagaaaaatccgatgaaaaattaggctgcttttgagagttgaacaaagaaaaaaaacatcatgtttttacgcgcacacttacctaactactaaaatatgtattttttaaagtgaagttgtggattagcctaaaaccagctctacttttattttagttgaaggtgaaacggtttggttggactacaagagtgatacagctagagctagagttgtgctagataaaccattggtaattttcaccgactcaaccaataaaagttacagcaccgtgattctgtgaaggagcagtaacctgcagtcgtgaccggagcagcaagatcgcagccgccgaccgcgagtgacggcgagggctttttccccgtgacctcacctgatgagcgtgcggagcagaggcagcacagcagagacgacgagtcggacatgacacgttcaggctcatttccacccgtcacgggcaaatcgtggcgcccacggaaggaaaagggaaaaaaaagaaaagaaaagagaaaggaaacgaggaaaaagaaaaaggcgaaaggggagaaggcccccgtacatctcacgctcagtcgctcacttgcttacatatctctcgctcacttgcttgcttgcttacgtctctctcgcacactcccactattctcctgctcctcctccctgatcttccctctctcgctgccgctcctcttctcgccggccgcctcagcctgcggcgagctcttcgtccagccagtgcacccgaggtacgcgccgtgctgcacgcgtcgccccccgcggggtttcgttcgccgtcgctcgattttggttctcgcgtacgatttccatccctttttcgagctgccgggctgatgaagggatctgggggtggtggtggctcctcgctgctcttgggtttatcttgtggtttccggcattactcgtgcttgatctgcgtggctggagctggattcggggagtgggaaggggatcttggggtggatggcgtttgagcttaggcatttcttcccctggccgaatcgttgcggtttttggagtcaccatgggaaattggggcgtaattaagcaaggcttttgtggataaatgattttaatctagtaattttgagctatattcctctgcaagttttggagctcactcctatgtttttttaaaaaaagaaaaattaccctgtatttttcctggtgatctcctcctccgtcccgtactgcaattaactatgcttggatgattagatccttactgcgtgtaatttctcgtccaggagcttaggccggatcctgggatccgtaggagaaaccttgctcgggttccggagaatgtgaccggagcaaccgcggcttcaaatcagaaaaggctacagcaggggagcaacaggggcggtggtggcgcgcggcagcagcagcaccaggccggccaatggcgcagttgccatcaatgctgccgcgccggcggttggctcggcgccggcggaggtggccagattccactcccaaccaccacaacaggatagggtatatggctctatatgctctgtgttctttctcatggaataacttattatgctttaacttcaatcttttgtgttgcttttttggtacgtggattagtacgtgcaattgctaggccttggcgaccttagatgggcacagacctttttcgtagtactgagtacgaactgtactggcctggtggtggttgcaactttgcaattggggcatctgtaccccccaaataatttttctacccccaaataattagggtttagtatgcattaactacttgctttattatgtgaacaatttgtttaattagcctttactttatgttagttggtgttgaattgcatgcactttgcaagtttccttcgctctgtaatctttgcctagaccccacaacattttctctgaatagcatcgtatggaccgttttgtcaacctcttttttcacatatactatagacatagctcatggatcttgccttagatatgcatagagttgaaattgggagttgggagcaaaatatcttttctctttggctgtattggatgatacaagtataaactcactgtagcattctatgttatttggtcgtttgaggacaaattgaggttcctgccaattacatggtatgatgaaaacattgtctaacttttgttaaccacacacttttatgcttatttgttgttacatcaagttcactgtaagtgttgtttccatggttaagaattagctagtaatattctttgtctatacagatcataaaaagtggagaaaagttaaattgcttttgaaattatagccttcacacagattagcacgctatttcttaactcttattcattactgaagttgactttagtatcttcataaaaatcaaactggatgacttttatttctgtttcttgcaacaactaataattttagatgttctaatacatgtctctctacatttaacagcagagtagatgggctggctgtttttctgccttgtcatgttttggatcacagaagggtggaaaacgaatagttcctgcagcacgtatacctgatggcaatgcgtcaactagtcgtggaaatgcacaccaatctggtagcaattccaaccaaaatgtggctctgaatttatctcttcttgctccaccatcttctccggcgtccttctcaaattctgcaattccttcaactgcccagtcacctaatcgcttcttgtcaatatctgcaaactctcctggtgggccaacatctaatatgttcgctgttgggccgtatgctaacgagcctcagcttgtctcacctccagtcttctcaacttacacaactgagccttccacagcaccactgacccctccacctgaactaactcatgcaactactccctcctctccagatgttccatatgctcggtttcttttttcagctatggatcttaaaactgctggcaaggatcacaacatgccgtacttatctacagcatattccggaggttcaggactccaggcatcttatccgctttacccagaaagcccttctagcagcctcatatcgcctgcttcagcaactccaaggactggtctttcatcacctatccctgagcaagaggtgcctactgcacattggaagacatctaggtccgcctgtgacacaccatattccagggcttcaccaatacctgagcaagaggtccctacggcacagtggaagacgtctaggtctgcctgtgacacaccatattccaggaattcaccgtccaatatttttgggcttgattcagctgcttctagaaactacatgttagataataacttctttcggccagctgcatctgcccagttctacctggatcaggctcagcagtcatttccatataataatggaggaaggattagcgtctcaagggacaaacaagacgctgaggaggttgaagcatacagagcatcttttggatttagcgcagatgaaatcgttacaactcaagcttatgtggagataccagatgcgcttgatgagggattcagtatatctccatttggaaacaatgctcctgctaccgaggtagataaaccactcttcaatgtaaaagtgaccacaagcccaaagaaatctgcagaccagctttccaacgactctccacataatgtggtgcacttggacatattcaaaggtaattaccctgagctttgcttcaaccattcatttgtattttggcataatagaatcaagtgtttggtttatcttgtgaattgctggaataaacagttgtttcaacgcaacttgtaagcctgaagtctactgttttttatcttatcaccctgtgcccagattttgatgccacattcttcaatgctcctttgatgcaattttctgtttctacgcttttattgcaggaacaaaaggaggggatctatctgaggatgaaggggtcgtgaaagattgtcatcctttcagaaaggcgatggatgaaatatctctaaaacccatagaagtcaggaagaaagttcagcctggacagtcatcttcctcagatgcagaaatcgagtacagaagggctaggagtttaagagaagccaatggagttttgtcatggcgcagcaccctggcaaggcaactacagtaacgatgtggtaatacgcaggataagatagaatgcagagttcccttggcctagcgttcatcaatttgagctgttgttagaagtaaaatctttaggcgaagagtagcccgtactgtatttctggggatttctactgccagatcatgctctggatatgtgactatcagcctgtattctatttaaattccaagttcgtcttttgtagacactctgttcgttagctgaatcacagaatcagtgaaatggaagtgcattttgaggagagatggagaggttgctcggctcccaatccatttcctcctgtactgctgatcaattggataacttgatagctcagggcttctgcgtgatgggctgttctatgaattgtgacgggtccttggacagcatgtcgccgtggatcttacgactttgcagccttgcaggcttgcagcattgatgatgatggcaacggtgaactctgcaatagatcgtgaaagtgttattagcaagtcgggtaacgactaattagtcaagtgacaagccctttcagaagaccgcccccaaaaaaatccaaccaggccgtcgatcaaactgatcaaaagggccgccaagtcgccatatacacaaggaatccgattcatacaggccaaagctaaaacggacaaggaagagtcgcgcgacacggcgcggcgagaccgcgagacggctcacggcgagcgctcttcgatcctcattgcggcgcgttgtgcacctcgagcgcgcagtgcgactggaagaacgacaccagggaggccggctccgccaccggcgtcgacagcgccgggtgcagccacccaccaccgcagggcgcgggcgcgggcgacttcgcggcgtcatccgccgcctggcggtcaccgccgcacacgggcgaacgtgcggcggcgccgctactaccttctcgccaagctcctccctgcacgccgccctccctccttggcgcccctgccgccgccgccgcctggtcgtccggctcccacgccgccgacggcgacacgacgagcggggacagcagcggtatcggcatcctcccgtcgccccacgcgccggtgggcgacggcgtggacggcggctccagccgcagcgtcgcgggggcgtgcttctggagccggctcggcgggcgcttgaccttcttgtcggaggcggacggcttcatctccatcggccggcgcgcgcgcgcgtggactcgtgccccctccctccctctctctcctcccaaccgtggcgacgcctgctcgttctcggtggacttgtgcgggaaacatgcgtgcatgggggctggggggaggcgcgcgcgtggagcttataaacgagcggcgcgtggggagagggcggccgcgtttggcggacgagaggtggcgcgaggcgtggacggtcgtgagggattcgtgcgcggttcgttccggttttggcttttacacttcgctctcctcccttcacgcaacgcaagcgtagccgcttcccatcggagcaaagatgtgcgctgcaacgtgcgggggacggttgcaatatcaagtgcatttatttattatagagtttgcgtgacgtgtctgcgtggagagattgttgccagagcgtgttcatttttggcggcgccctatcgatgtttgaggttttttttccctttttttataggcatcgatgtttgagttgtttaagaatttaacagcaatttaacaatacttaatgagccgaattctttgtttgctgtcatgttgatgacaaacaagaaaattaaattggacagttatcttccatctcgttacccgctgcccttccattcgttacgtaacagagtgtacagtagcacaagcagagatccagagaggatggcttcctatcctaaagatcatggtgacgaggtgcgctgaggccgaggtgcgcaggtgggtcgcggagatcgggccatcggggtggagaacgtcgggaggaagctggtgaactcggccgagccgccgaaggtgacgctgagtaggctgatggagtaccgagtacggcgtaacgctggtggagcagcaggagaacgtgatactcgtaggtacgtactttcgctgagcagcccagaccttggtgttgccaacgaggaacgatgaagacaaattttcttttccaaaactgaaactaagaaaggagcaaaaatttggaacttcggcaaatctgacaggcgtttgtgaaagaaataagttcattataagtctctcttttttatgttgagtttgaatacatctttatctctttgaaccgtagtattagatataacacgtccctcaactttcaatgcaggatcacccaagatctttaagtagtatttgtacccagttttagctaacataacgagttgacaatgatcaaccaagccaagtcaacatggggcctacgtgagcctgacatgtcaatagcatagatgcctaatcttcttcatctctgcccatcttccctctcttccccatctctctctacatggcctccaggacgcgcggcgggtgggtgggcgtcgttctcgcaatgcacggaaatgtcgtcgatatccgctttcttcggcaagtgaacgaccacggtgaaagaccccagccccctttggagacctcgccttccacctccccatgcataaattcctcattcttgtagtacaacagaagcctgcatcggaaccgtagccaaaatcgaagcaaacaatggctggcaggatttactggcgacatgggaagggagaggagagaaggagaatgtcacagagctcggcgtcttcctcggcccgctagccccaccgcctagtgcccgtctccgccgctgtgggcacgttgcaatggccggtagaggaggggatgcggcagcggcgatcttgtctcctttcaagcggcgacgcccttgacacagagcttgagtagccgcatcgtctcctccatcctctctcttgagcggcatgagctcgacggcactgcctggtctccttttctcctccactgctgcgacgtctgtgtacctagcaggaccggctcttgccttcgtgaccgctaggggaggacaccgtcaccgtgttttgtctcccgttcacaccgttgacgcatctgacctcggctacctcccctacctcgatcgacagcggagacgcgaggccgtagctgtggcttggaacggataaggggaaaacggacgccacgagggggttggacgcgcgcacccagtggtggtgtctccgccgccaacgctgatgccctcatccacgttgcgcgttggtcaccactacccgcgcctgccgatgccctcctttcgcactgatgctgccgagagagagagaggaggaggggaaggagatgatgtgtcattgacatgtagagccatcattttttattttttatttaaagtgaaatgctgactcaaccgtcacgtcagccgaaacgggacattttgctgccctgggatattaagtacaccgtttttgcaaattgagagacacgttatatctggtattgcggttagggtcgaattttaaactcagcgacgaattggagggaccataagtgaacttattcatttgtgaaacaagtcgagaaatttaaatggctgcgaaggtccctcaacttatcatcgagttacaaaatcctcccccaaccgcaaaaccagatatcgggcgtccctcaactaacaaaaccattcactttaggtcgttcggtggttttgacctcggttttgtccgacgtggcggctgagtcagcatgggacccacgtgggccccacatgtcagcttggccacgtcagctcttctctctctctaacctcttctctgtcacgccctgaagttcctctttccagctttaaaatttgtaaaataaatcgtccgaagaaattgttctttttaacctagagctaattcctcaaattaataaatgcaaataataatcggaatcggcatgtggaatttttcttggattctacatgtcaaaatatgctaacaggatttttagtggaattttcagagccttggaaataattttaaccaattaaaatgagcaaagggcaatattaaatccctgggaaaatcctttttcctttttatcttttcttttccctcctttttccttttcttgggccgccggcccatttcttcccgcgccaacccgctcctccctcccactcccaaagttcacccggcctccctctccctctcgggcgctgacaggtggggcccacctgtcagtcctttccccttcctccagccgcccacgccggcaaccgccgaaaccgcgcacgccgccgccgtttcccgcccttcccgcgcccactcctccccactccgtgccgcgcccacgttgtcgccccctctccgctcctcccgctctcgcgcgcgccccgcaagggcggggttcggtttgaatcccccctccctctctctctctccacctcccacgtcgccggcgaaatcgggagcaccccggccacgtccgccactcccgagccccaataaagcttccccgcactcccctccacctttttcctctttccgccgctctctcccgtgccctccatcactccagcgccgctacacccatcgccgccgccctcctgccacgctccggccaccgctagccgtcgctagccaccgcgccgagcctcactgtcgacgccgccgcgttcaccatcccgtgagccggcgcgtccgccatccgcccggccaaatccaccgtcggggcccgcttctccccgcgcgccggtgagtaccaccattgccgccgccttcggccatggtttccgcccgccgtagaccacccctctccctctaatccttcccattttgttccctaggatgtcccggagatcgtccgcccgtcgccgtcgtcctcccgtcgctcgtcgtcgtcgttcgccgtcgtctccactcgcgctggccaacctcggtgagaaactccctctcctccctctttccctctctctcgtgtgcgccgctgttgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaagaaaagaaagacaacaggggctaagccttgactagaactgcagcgggaacaccactccacaggcatcctcgacggcacggacgaagcctactcctcagagacacctccatctgacacatactcgtactctggggttgggaaaaatagagcaagactgagtactacccactgtactcagcaagtcataccggaataggggtatgatgcagggaattatcacagaagagctagagtggttcatttgcataaagcgagcatttataaacagaagttgaaagatttaaacagttgtaataattaattaatattaactatccactgtccaacgctatcccacgttgcaacaggcccaaccatccacttaaactatccaaattcaaaagattacactagggtgaaactaatcacggtgaatctggttgaccgcccataaccgcgggcatggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagctccagctgttgcccacgctggctagtggtaagtactataagtttcttccaggggcattccgcgaaccggttccttaactaccatgggt

SEQ ID NO: 39594 - DNA, 1483 bp, Oryza sativa
cattcataccaagctctaggggcttgtttgagcccgtagagcgccttgtggagcttgtacacatggtttggcaactttggatcctcgaaccccggtggttgctccacatagactaactccgagataggtccattgagaaaggcactcttgacatccatttggaataacctgaaatcatggtgagcggcataggctaaaagaattctaattgactcaaggcgagcgacaggtgcgaaggttcaccaaaattgagaccctcgacttgggtgaacccttgcgcaactaaccgggctttgttccttacaaccaccccatgttcatcttgcttgttgcgaaagatccacttggtgccgatgacattttgcttgggtctctccaccaaagtccatacttgattgcgagtgaagttattcaactcctcttgcatagccatcacccaatccggatcaccaagcgcatcttccaccctggttggttccaaagaagagacaaacgagaagtgttgacaaaaacttgcgatacgagagcgagtagttaccccttttcttatgtcaccaagtatgttgtcaacgggatgatctctttggacaatgtgatgtatccttggatggtgcactggggggacctaagcctgatcagaatgctctaaagtgccctcagcatcgatcccatccacttgtgccattggcacgtcttcactgccactgatccggaggttccggactgtagaacccggaacttccgggcctggagatgtccggaggttccagtcaataggacccggaacttccggctcagcagacacagcacttgtagggctattggatgtcgatgacgcggaggttgatccctatcttcttggtcatcctgcgtctcgactggtcgtatgtctccaatagccttagtacctatagcttgatttggatccacatctcctacaatatgtacaacaacttgctctccttgggagccattagattcatcaaatgtcacatccctagtgacttcaacaataccggaggttttgttgaagacacgataggcatatgcatttgattcatagccaagtaagaatccctcatccaccttaggtgagaacttagatgagcgaggcctcttacttaaaataaaacatttgctcccaaagacatgaaaatatgaaacattaggcttcttaccactcaagagctcatatgaggtgttctttaggatcttgtggaggtacaagcggttgatggcatgacatgcagtagtcatggcttccgcccaaaagacatccgaagtcttgtactcatcaagcattgcccttgcggcttcaatgagggttcggttcttcctctcaacaatgccgttttggggaggattatagggggcggagaactcgtgcttaattccttcttcatcaagaaatttctccacttgagtgttccttgaattctcctccattgtcgcttcgcaccctcttgatagtgagatcatagag

SEQ ID NO: 39595 - DNA, 1892 bp, Oryza sativa
atccatatgaagaagctcgagtggtcttgttgtagtcatgatgttttttataggatgtggactcccaacttgcttcccggcttggcagcactacacacacgatctttctcaaaagaaacattagatagaccaagaatgtgttccccttttagaagagatgccaaattcctcattacaacatgggctagcctacggtgccatagccaacccatagaggatttagcaatcaagcatgcctccggattcactctatctacgtcgaaatcaacgagatagagatcaccctttaacacacccttaaattctatggaagagtcatctcgcctaaaaaacggtcacatccacatcggtaaacaagcaattaaatcctaacttacacaattgagacacggataataaattgtagcttaatgaattgacaaggaggacattagatagagattgattctttgaaatgacaatcttaccgagacccattacctttcctttaccatcatctccaaagacaatattttcacgacttccaccctcctcctcaagacttgtaaacatactcctctctcccgtcatatgattggtgcacccattgtccacaacccaacttgagccaccggagaagtatgcctacaaaagagatcaagcttgggatttaggaacccaaacttgtctaagtttgggtcccttgatgttagtcaccaaagcctttggcacccacacacaagtgcggtacttatcattgtaattcccattaaaataagcaaccactttgccctctgaatttttggaaattacatatgaatcatagtaaagaccctctggccggaacttcctggcattatacccggaacttccggtcagccccttcggcctatcagaagcccgaaacttcctgacaaaatgtccggaacttcctgtcttacagggcatgaacttccggtcattttgcctagaacttccgggtgtctgaccagtgaggggacaagtcacctcacttgcttatggagcttttccttctcttacaaacatcaagcattctttcccatttaccatcacacgcttagacacaggacttccaccagaaaacccgagcccgtgtccatccttgttaggatgagcggtgatggtcttgtaaagggcatcttttgaatggtatgttttcatgcatccatatttcaccaatgtgcccaacctttcattctctttcttaagagcttgcatagcatcaacattagtagcatgagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaacttctcttgaagagtttcattgacattcctaaggctagctagagaaccattagtaaaaattaagctcattagctagttgttcatttttagcacattctttagctaggatctcctctaaggcaaggtttcttttcttctcaagaataagtaattcttcttgcctttcgagagattgttctttactatccaaagctctcattaacttagccaaatgttgcatagcgggtttgctaaagctcttaagcacatcatctaattcattatcactttcctcatcactagaatcaatatcaagagaggtgtgagagggcttttgagtcatcaccttgcggccttgggccatgaaacaagagtagtggtagaagtcatcgtcgtcatcactcaagttgttgaagagacgcttattgcttgaagaagatgacttgaaggcgacggtagcaacaccaccttctccttcaaccttgtctttcggcttgggcttgggcttgacctctggatcttct

SEQ ID NO: 39596 - DNA, 3977 bp, Oryza sativa
ctcttgacaatagaaagccatctcttcatgcttcactttcttcacaacttgactcttgcttcttgttttgccttcaaagcaacttcttgattttagatcatggcggcattcttcaccatttgcctcacttcacgagcttcctcttcttgcatctcatgagacacaattcttccaagaatgtcacttggggtgagtctcttgaagtctttcctttcccgtatcattgatacaagagtgggatatcttggaccaaatgcacggagaagtctcttgaccacaaaatgatttgtcatgtcctcactcccaagtcctttaatcttgttgacaaggatcatcatcctatcatacatctcttgtggtgtctccttgtcatccatcataaatcttccaagccttccttccaataattcaatcttggcctcacgaacggcgggtgatccctcatgagccaattgcaaagtatcccatatctccttggcctcctcaagcccatcaaccttgttgaactcctccggactcaaggcggagagaattgcattggaagcttgagcattgcggtggatgagttgctcttgctccgaagtgagctccatgtcatcatggggtacatcaacacctgtacaaacaactttccaaatacttggatgcaaagatattagatgcaacttcatcttgtgcttccaagcggcgtaatgtgtcccatcaaattgaggagcacgcccggaaggtacggagacaaagttgtgagggggaatggtaagtttgctgtaatcaaaatgtatagtaactcccttgggtgatggagttcccttgcttcttgctccatcttcatttctattttccccgttctttccccctaagtccgacatcgtggatcactcaaagcggttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccggggagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacaacccaccactcagtgtattttaattaactaacaccattgcggtggcacaaatctaaagctatgccaatagtcagagtctatgtaataaggtgatcccttttgtgtactagttgaactaagcatggctaagcatttcctaaaccaacatctaatcattttgatacccaggttatcaatggcatatggtaaacaataaatggctgagtaaaaggacccatccctcattacattgtaaaagaatgcaacatttaatagaaatgcgggatatttgtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactacagaaaaaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataagtcccagggctgacgtcagcggaaggggggcggctgcgccgacatgcgggccccactggtcagcggctccaaagggagggaggtggcgactggcaggtgggccccaccaggcggtggctcaagggggaggcgagggaggcgccggcatgtgggccccacgggcagcggctcaagggggagggagtgggcggcggcatgctcggcacggctcaagccggccggccatggcgaggcgacgacggcgcacgaccgccggcggtgcggggagacggcggcggacgacgcgaaaggcggcggcggacggccggagcggcggcacggccaaaagcggcggcgcacgcgtgaaggggagaaaagggagggggagggaggcatcggccgggctcagctcggcctcaagaccgagcggggcgaggcggcggcgaggcacgaccaccgacggcggggaccggcggcgcgggaagcggcggcggcggccgaaaggtggcggcgcatggccgaagcgcggcgatgcacgtgcggagggcggcggcatgcacgggagagagattaaagaaagaaggagagagaggtagtcctcaccggcgatgtgggggaatcggggtccggcggcggcggacggaaaacgagcggcggccgaggtgcgggcgggctcggtgagcgcgacggcggcgatggtgcggcgcggcggcggctctagcggcggcggctcgcggccgaaggcggcggcaagcggcggagctcgggtgtgacggcgcgggcgcggtagggggcacgggaggagacggcaaatgggggaaacgagagagggagctcgggagagcgatgtataggtgcgggagggggcggacgtggccggggaggtggccgatttggccggcgacgtggggaggagagagagaaagtgggggattcaaatcccccaccacttgcgggcgcgcgcgcgcgggagatgtgggggggggaagagcggcgacgtgggcgcgaggtgcgggcgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggagaaggaacgggccggccccaggaaagggcgccgagcgcggggagagagatgggccgacggcccatctagagaaaaaggaaggaaaagaaaagaaaaaggaggaaaaggattttcctgggattaaaattgcactttggtgatttttaattggttaaaattatttccaaggctctgaaaattccactaaaaatcctgttaatatattgtgacatgtggaacccaagaaaaatcccacaatgccaattccaattattaattgcatttattaattaaggaattagctctaggttaattaagataatttcttcggccaatttattt

SEQ ID NO: 39597 - DNA, 5108 bp, Oryza sativa
ctggatgatgcaatgcatttttattgtacaattcaaaggctcaaacttcatgcagaccagactgtcctgtttaattgataactaaatgaggagatgagcaccataaatttgtaccaattaacgctcatatgaacagtgcaacagatggcacagttcatcgaggacattttgcatttctcaatagccaacaaacaatccccaactgtttgcgaaaatggccacagtgaaccaagaatgaggcaatttcttgttgccattcagccattctacctttaatatttcttcctgtaaattctagtgttgagttgctcatcactacaaatacaaggtgaaaactcacttactgcctacaacatcaaaatcctaccacgctatctaaaagtattgtgtcatcaacaaaattcgtctgtttcagcagaagcaacagtatcacgtctaaaagttgtactgttggctagcaaagttaaagaccatctctgatttagcctggtctcaagcatccaccagggagcaagaatctgaacttgtctgcgttcttgatcaaataggaaggcagatgaacagcagatcctgactttggtatgggtcccatcttcttgaagagatccttgaatgtgtactcttcaggcagcatgtcaaacaggtcctccccattacatatgaccctctggattctgtctggatttaggaagctgtcctgcttcacccggtctgcgtggctatatgccttcatcttgaaagcaaactccttgatgtccttgaagcagaagctacaatgccagcctgcatcagccagcagaaggttgctctgacgggagtggcggtacaatgtatgctcagtgaacacatgtgctgtggccctccagctgttgtagtctataggaaattcaaaggagtacatatagttcttcagctcgagatgcatgacttgcggtattccatcacaccacttgagcaactgcaccgtctcagggctagggatctcatcagcatcagccatgatcaatacatcccccacagcaatgcctgatcttcgcagcagcatattaagcgcacgacggtggccggcctcaacatggaagggctgacggtgagaaccgggatccatttccatgacaggaagcatgtcatacacaatcttggagccagcgaatgcaaagcgattgatattttccaagaaagagagtgacttcgggatgccagtgaatgtggcattagcttcaaggatgacaaacctgtcaacatacggaaggagctcaccgtagcgaatttctagaatatcaagttcattactgaagaggacggcgtcaaagacacggcgaggggtggggaggataccccaaccatggagctgacagagctgcggcatggagatgttgggggcatagtagtgtgggatgcggataaatggcttaggtggtgtgtcccacagtggccgcagaaggtaagagatattatggaaatactgcgtaacaacaataacagccactgaaagaactagaacacatggtatcagcaacttgagggaagcgattttccgtctagttagaggtggaaaaggagaggttctagccatgagaatatctgtctatgacaaagacaggaaatagatgagactctgataagcatagatgagaggtgtctcggatattctctactcctgggaagtgtagcaaacttcggaatgtgaaagtaaatctgtattatgcaagagacagaagaaagtaagcaaacagaaaaaataagtggcagaacaagcaatgtgatgcaagtatcaattagagaaagtactaatttcaaaataagaagaaagagatgaattgcaggtacaccctttatcttctaaatttgtaatgcaacagccatggatagaaatgttagtaggacagatatactattattgaatcatttcaataaaaaagggtcttaaacatcatgttcacgtattcatgtgttactgaaggaagcaacttctatcagcacctcatttctaacaatccccaacatgaaacattttctattttagaggacaacaaacaattaaagatgatacagtcattactaatttcagaattcagacctgtgtagaccacacaaatcagcattcaggcctagttcgttggatcgcaacattggaagaccataacaaatcagccttctctacaaatgaagatctaatctctatgcccagttcgttgaatgtatgcccaaaaatgcaattccatttcagcaacacaaacaaaataagaaagcccctatttgccccccaaaatcaaatcaaaacagcacctctactacccttttattcatttgttcatcaatactaacaaactgcagtctgcaggctaagcattacaacattcctaaagattagaaactgccgccaaccctaaagatattggcatcaaacataaccaatcagacaagcaccgccaatagtagatccatccaagatttgcatagcgagatgtttggagcactgggatggccaaagaacaagaatcacctcaccgcgaggacgaagaagaagaagaagatgaagatgaagccttcgccgtctctgctccaccaccaccgccaccaccgccgccgccgccgccgccgcggcctcctctacatcgcccggccggtgccccgccacctccttcttcttcctcctgctcgcatgtaaaccacctctcccacttctcctccgacaatctctccctatcctccgcctattcctgtcgccccgccatccgccatgggaggggaatccgagctttgctgctgctaaaattaggcgctaacaaatctcctcctctcttcttttttgcttgcagtgctctcactcttttccgtactggaagaagtggaggtgaagaaaaagaaactcacaaaaaggaaaagaactgtggatgcggcaatcaatcgaatcaatcacactcgcgccaccaggagcagcagcagcagatttcgctttgggtttgggaggggatcgtggtgggatatgcgatgattgctcagctttgggcggcgcggcacactggagactggactactgctagtgttgattctgattctctgcatggatcatctgtgtaggtaagagcagttacaatagcaggctatgagccagctacaaacatattttaaatagatggataacagcgggctacagatttatagtcagctgtagcacgaactcaaagacacactgtgtgtatgataagtgggaccaggtattaatagtgtagtatgtaactattgtatgaatgagctattaggttggttataaatgaattgtagctagtagttggctatactattaaacttgctctaagtgcaaggataatagtaaaactcactatctattattagcccgtcttagagccaatacatataatagattaggtataaggttggctataattttcttcttctatctctatctctcacttacacatttattatttctgtcttggagcttgtgttaagctaactcttgcatgagagccaacatctttgatgtttcgctacatctctcctccacataagcttataagcttatatagctcactattatacttgctctaagagcaggttcaatagtatcggagcaggttcaatagtatcgccggctgctggctccatccatctttgcagctattactagagccaacttatacaatagagtagctcctgtgttgatcatatatcactaatcaataattaattctgtacatatattaatgtacatgatccaagctgaagtcaattcctgtggccgtgtctgtgctaaattaacgagtcacgacaatcacgggccttagcaactcattgccagcatgtcggccacccgcatcaccatgaaggcatttcaacagaggagaacaagaaaaagggaaaaagggaagagtcgaatagattagacgatgacaaactcaaattagtttttaaaagaaaacaactcaaattaaacaaagctgcatagcatatcgcatgctctcgtcggtgattagaccaggagagcgagcgaacggtgctcaccacgcgctcaacgatggtgattgagcttttgcttccgcagaaccccctgctcgcgacactcgacaggtctcggccaattcgaacttcatttgcagctgcgcaatttgcagatccatctgcgggcgcccggcagcgggacgtacaaccgccggcgtctataaaatgttaggaggatatttggttgggggaagacgaagacgaggcgacaaagatgcaactagatgggccgcgctgaagaggaaaaccacataagatccgatgggcacgtcagtggacccacaaaaattgtttttaatcgctaacaacagctcccccgcgttgaaagaagcgttagcacccggcgatacatttgtcgcgcccgtttgtttctctttcctcacttctctctcctctcctatataatgatataaacacacgtgatggcctaggtttgcgagccaaaaacaaactgctcgcgagtcagctcggctcggctcatttcaggcttgggcttggctcgagcttagttagccaagcccaagctgagctcccaagctctagcttttccacccttaaatatggccgcccaaaattttaaggtgtttggatgatatggctaccacttaggctctgttcggtagcgagggttaggaaccctcactccccgacacacaaaacgaaacagcgttttagtgcgtgattaattaagttttagctattttttttcaaaaatagattaatatgatttttttaagcaactttcgtatagaaactttttgcaaaaaaacccaccgtttagcagtttgaaaagcgtgcgcgtggaaaacgagaaggaggagttggaaactcaaatggagccttagagcaggtacaatagcaggctataagccagctgcaaacatattttaaggagataaatgagaagagagaagggcagcgggctacatatttgtagccagctgtagcacggactccaagacacagtgtatgtatgacaggtgggaccatgtattaatagtgtagtatataattattgtatgaatgaattattagattgactatagataaattagataaattggagttagtaggggtgcagg

SEQ ID NO: 39598 - DNA, 2455 bp, Oryza sativa
tatttctttcattactttagatatggtttgctgatgtagcatcaggactaaactagtgtttgtcttttaatcacaagataactaaaagtgggaatttgtaatacaactttcgatgatactagaaaacactcgagctagtcagtgttagaatatcaatcctggatagaacccatctaaaacaagtgcagccgacaatgacaactttgagagcataacataagttacttagcggtggagattgagcaatagcagaacataggctagtgttatgggttagggttcataggggataaacaccgtcgggaggatagccgggtggcgacgactgctagggatgagagggggacttaggttggggaagactaattctgattcattgcttaattagaatgacgatacaatccatccttatatagatggggggaggacccaatctaatcctatccaaccgactctatccttatccctagggcctcgacccctcggcccactacctatgacacctagattgatttggacatagaaaagaaaaagacttacctcacaatagtaatttttgagagattaatcattttagaccaaagaaagattagagatttaaactaggtttgagggttagagtttggctagactagtaatttagggtgtttactgtttagggagagtatttgatctccctaaaataaaagctctcatattcagagcgaagggtcttaagcgtagaaattcatcatcacctctttcagctactgatgttagtacactaaaatcataaatatctcggagctccttttatattggatgtatagtggtacccaaaaaccaaaggtagttttgtgtagcaagaaaagatttttcatattattggcacaaccagctctctattgtttttcttcaaattcagtttgtttgagtctctcgctctactatttaatactgtataatgtaattaggggtggacagaaagctcgtggctcgttagctcgctcggctcgtgacaagctcggcttggctcggctcggctcgtttcatttttctaacgagccgagctaggatttgagctcgttagagataacgagccggctcgagctggctcgcgagccgctcacgagccttaacgagctaagccttggtaagttagcaggttgcagcccacaaccgaaggccacagcccattaggcccacaacatgaaaaccctagcttcctagcctcccacaggacagcatcttctttcttcacgcgtgcgcgtctctccactctccacgccgctccgccgtcactcgccaagtcgtcgtccatcgctcgcatcgatgttccccctcgcaggctagccgctcacgtcactcgccacccgccgccgcctctatggcagcgccgtgcgtcctcgtccgcgtcggcagtgggctccaagcatgatgtcgtctgcatcggcagcggcaatggcacaatccgcacgagcaggagcatgcaaatccactgttggcgccacgagatccaaatcgagagcaaaagttcaagcttgtcctcatcgccgtcagcaagttgatatgtttaattttggttggtcctaattcactaggaatctaggtctgcttggtttttggtttggttccaatgaaacgaggctttcagatctacgagcttggttctgttgatgggtacaatatttcaaattgatgtgtacaaaaattttgtgcaagactttgtgatttgtcgaatgtttgtgttgaatagtcacacattggttgtggaagtgcaaaggacctaagatataagtgggggagcccctcacctcaatggctagcttttggggtgggaaaggccctttacgatcctacagtttgatctgttatgcaattgaaaaattattgttggcagccacaatcttcgatttttctttgaagcgaaagatttttgatgggtcactggtgtattgactcgcgagctaaacgagctagctcgagctgccaaccgagccgagctagctcggtatccacccctaaatgtcataggcagagtaggaaattgacggatgtaagtaagcaaacagacggatgtaaagcagtaagcaagcatcagatccataataataaactttggcccacaccatacatgagaatgagatgtagaaatctccaaaagatagataacgatgagcaagtctctagatgagtttacctttggcgtggaggagggagagctgttaggggggtgcgtggcgatggcggatgagtctggagtagaggaggaagaaggatcaacgtcctctgttcctcccactcccactcctagtgggccaacgtcaccaataggccgtgctgggctagactcaactgtaagccggcccgatgaacaagggcgatgaggaatcttctggaaggtgtggtgccactccggcagtcgcagcctcctcaacatgggaatggcgacagttgggttgaggaggctagaggt

SEQ ID NO: 39599 - DNA, 2219 bp, Oryza sativa
agcctcctcaactcaattgccgacattcccatgttgaggaggctgccactgccggagtggcaccgcaccttccaaaagattcctcatcgcccttgttcatcgggccggcttacagttgagcccagcatggcccattggtgacgttggcccactaggagtgggagtggtagtgggaggaacagaggacgctgatccttcttcctccacggcggcgagggccgaggaggcgaggatggacggccatcgatgaagaacaaaaacctccagcctcctcaattcaactgccgccattcccatgttgaggaggctgcgactgccggagtggcaccgcaccttccagaagattcctcatcgcccttgttcatcgggccggcttacagttgagtctagcccagcatagcccattggtgacgttggctcactaggagtgggagtgggaggaacagaggacgctgatccttcttcctccttcactccagactcctccaccaccgccgcgcaccccccaacaactctccctccacgccaaaggtaaacttatctggagacttgctcatcgttatctatcttttggagatttctacatctcattctcattctcatgtatggtgtgagctaaagtttattattatggatctgatgtttgcttactgctttgcatccgtcaatttcctactctgcctattatattatacaatattagacagtagagcgagagactcaaaccaactctgaatctaaagaaaaacaatagagagctggttgtgtcaataatatgaaaaatcttttcttgctacatagaactacctttggtttttgggtaccactgtacatctagtataaaaggagctctgagatatttatgattttagtgtactaacatcagtaactaaaagaggtgatgatgaatttctacgcttaaggcccttcgctctgaatatgagagcttttattttagggagattaaatactctccctaaacagtaaaccctcaaacctagtttaaatctctaatctttctttggtctaaaatgattaatctctcaaaaattactgctgtgaggtaagtcttttccttttccatgtccaaatcaatctaggctatgttctgctattgttcaatctccactgctaagtaacctatgttatgctctcaaagtggattgatattctaacactgactagctagtatcatcgaaagttgtattacaaattctcacttttagttatgctgtgatttaaaagacaaacactagtttagtcctgaggctacatcagcaaaccatatatatcttcagttcaaattcgtatatcccatatagctctgtgccttggctaaggtcaactgacatcagtgtggcaccacttcttcctgttgctgtaacattctcttcttcagtttctgcagcaaccggtgcaaactaaagatggcgggattcggcagcctggcacccaagaccaagaacatagtggtggctggaggactctctgctttcgtccttggcgtgtattactacaccatgagagcggtgggaggcacagatgagctgcaggtcgccattgataagtttgaaggcatgaagaaaaaggatgctgggaactcatccgccgcgggatcctaagaacagggtttagaattggctccatatccgcctctatactgaactgtggttttgtacaataatggctcaatactaggttgtgcttatgctttgacgttaagctggaataatttttgactgaatcgactatattaaaacctccccggagttgctgggctgagagcgttttggactggtgctcgcacgcggcgctatccatttttattcacatgacattaagaaagagctttctgtgattgaactttaactaggttttttttgccttttgtatttagtattgtttcaatggtagttatcctctggaaatagctgtttcaagtatatttagctatgcctttttcttcacggtgttgatttggtgagtagagaatctgctatgtttgctactaatattatagttctgcccttcaatgaaatgtaaacaatgtgaattgaggttaatgtacgatagttggcatgtgactaggtgagattttctttgtgtatcctgagatatctacaatacatcaataaattgtgcattgtacacatggtcttcagattgacattatatttttaaactacattatggttacttttatgttgttggggtgcagg

SEQ ID NO: 39600 - DNA, 14792 bp, Oryza sativa
tctatattaagtataaaaaggaggagttctccgatttcaatcctaccggtgaaatcaacagttgaaatcttaccgtccatccgcggcactttcagcctccctaccgtccaccgcaaagacagaagtggctggctaagtctttgcgatgcgacggtgaaatcaccgaatccccatccgtaccaagtggacgcacgattccatcgcaataacaccgtgcgcttacctcgccgccgcaagctccgctccgccataagagcaatggtctttattagcggtctctcttcattgtcatgcaagtatatttggtgacgtggaagagagagaaagaaggaaagagaaagatagttgctatggagacgtggaagagagagaaagaaggaaatgtctctctttattgtcatgtaagtatatttggtgacgtggaagagagagaaagaaggaaagagaaagataattgctatggtgacgtggaagagagagattgaaggaaagagaaagatagttgctacgcatgacaacgacatagagtcgactcttagcatttattaggaaattttttgttgcattgagtctaataaaggaaagatgactagtaagaaagtattttggcacattaatggttagagactgtattgtcttaactattgtaacgcgatagtctctaattaacgtatcggtctctacctttgtacttgccgtaacgccgctgccgcgacctcccggatgatgcctctagagtgcagctgcgagcaaatcgactccccggccaccgcttgaacaccgggacatctcctcacagcacccttgttgacccgtcgtccatatcctctctagcggcctcctccaacaagcccaggtgtgcttgatctgcgtgttaacactctgggattttggtgtattgtttgatattgttcaactcaggaacacctacgctttctcaagcaaccaattataattcagctttgttactgcttccagtatcattcattgcaagcagttgtccaccaataatcccaaagtaggttgtccttctcccattgtgccatcctcgatttctgtttccatcggccgccctgcgatatgtaccggaggtgtacttgctatagcagtgtgctggtgtccagttgatgcacccaaggaggctcaaatccaagttgtgatgtggcgatgatgagcaagtcagacaagaacctatatcaggttagtcttctcgagaatttgcatatcaacttttaacattttgcttcaccttgtgaatttgatgtgtgattgagcttccagggtcatcagctgatatactacggctcccatcggttgccattttacctaaaatggcttatttggcttattagaaaattaaaattagtttataagtaaaacttttgtagatttattcgtagcgacttaaaagccaaaattaacaaaaattacgttaaaagcatttcaaaatcaacttcaaaattaaattcaaaaattcaaattttggcttattctttggctgtttaggccaaacgatagggctgtacataatgatattctgcggactaaagacatgatattctttcatcatacaattttttgagcttcatgtatttggctaatatttcttatggaacacacatgttgatttcagtctttcaaatttgttctgccctttttggtatggaatttctgttaccttggaacacctggtatgttctttcctatatactatatggcaccttaaagtgctacttattaaacagcgcgtgataaacactgcacgtccccacccatagtgtaactgcactccacccacactgatcccggctcaacacatccccaaattttggcagtcaaaattttactacttagacaaacacaaaaactcaccatataagacagcgtcgtttagtatttttttaactaatcatatatacatgcagttaacaaatcttgaacaacgggatatgttagggcagtaattttttaaccgaaagcaagttaggttcctttttttttcatcgaatgatgacatgatctagagttatttttttttactagacatgccattaaattattaatttttgattctttgtttccagttttttgaaataattgttttagaataattctaggaactatcatttttgtacataatgctgaacgagtaattttttaactgacagtaatatagcttctcactcacccaacggtgtcagtatatagagttatttttttactcgatacgtcatgaattttatttttttgttgaccgatgcaattagtaatttatttactcatagaaccatatgtatatatacagatgcggtccaaccttaccgtgtgtatgaaccacacacttttccatctctctccgtttcttcaggatctgagcagaccgggcgtccacccgatgattgtgttatgtatcgagttactgtagttgccaattgttgtcatttctcttttgtggtctcactgagtcaagtgtatgtctagacctggtgagtgtgagtcgcgacgtgccgtgctggtctggcggacgcgtcgggtgtgtgtttgacttgtacatataaaaagggaactctcctgtctgagagggcatcgaaattgaaatagaaaaatcactaccaactccttcccaaattgctctgttctctctctcaatcccaaatccttctgagaactctagatcaaatcctggcgagacgccacggaaaacctcggttcgtgacaatttggtatcagagcctaggtctcgctagcgaggaagaagggtcccaatctcatggagaggatggccgcggcggaaactgagctgggggatctgaaccagagggtggtggatctcacaagcaacctcaacaacatccttggatcgctcaccaagctggagacatggatttcgacggttgatgcgggaatccaaggcttgaacaaggtggtggaggagatcttggcaagggtgacgaagctggagagctcaccagcgacggcgacgttcgtggcgacctaaatgcctgtagggcccgacaatgtcgaggagcaccaaggtgatgcatccaaagcccttgcggctcaggagcgacccctggtcaagggtaagtcccgattgccgattttccccattaatttcgaattgggtgaaacctctgtgcagagttaatttagcagtcggtccaatagccctagattgccaaaaacagatttcccaaagtttgatggagataacccaaaattgtggaagaagaactctgaaaagtactttgatatgtaccaagttccctatgaaagttgggcaaattttgctactctgcatattgtggggaatgctgctctgtggctgcaaaccttgaggctctgcatagcgttgagacttggccagaactttgtgtagtagttcatagtaaatttgggaaggataaatactaggagcatttagaggagttagagagtcttaggcaaaccagtggagttaaggattactatagcaaatttgaggaatttatgcatttgaggataaataccaggagcattattgatgtgaattatttgctctatacttctaaaaatacaggctcaaacaatgttcttctagtacattgcctagacaaacttatactacattccgctacatttctccctctgcacacatgagtagctgattcgacctattttcttttgatgtgtatttgtatccgaccatatcatgcaagtcaggctattccagcgcagctatgaggtgagtttgactcgagcttgttcttaggctatttcccaactctaggttgggtgaaagacttgtttggtgcgagatggaagtaacactaatctttggctaagaataagattgagttggacttatcacatggtcacgctagatgagcttggtctagcttgggaataggcagttttcaatgtgacaatgttgtgtaggttgtttttttttataataaaaatgggttatgaggtagaacctcaaaacaaggatgacaagttgaggcagtttatgtaattttgcgataaataaaaagaacatgggagggactaaaaaaacgtagtggcagagtcgtaaataaattgagaatagagggaacagagaaaatgggtattatactgtctacatgggaaaccgaattatactactacaagtccaacaagaggtgaccgtctctgatgagaataatgagagattgagatctccccttcgcctcccttcccccgttaataagtagtaggagtaattttcatattttattctattagggaagtagtagtacgaaaataaactcgatcgagaggttttaatctgtcctccctctcaccgacctcgtctcctcttcccccgtcgttgccactgccgcctctagattaaagcagagctatagccgggaggaacgcgcgccaccatgtgcttggcaacgtcgccatcctcatcgaacacgtcataagacggtggcggtcttcgcatcttgatcgtcggaagatgagttattatatttgtcttattggattttgcagcggctggttttcttcaataaaatcaagatgagaaagatgagcttggtgcaaaactgtgtcgctgagaaaggtatgagcttgtaaccagatgagcttggttgtatgagcgtggtcaaagtttaatttttcaaccttttcttttaaatcgctaagaacacgtacataaaagttttattcataaattattcttcgtttgcaaatatgttgcttcgaaacaatggggccgtacatcatgtgttattaacaacttaacatacaaaaacgagctgggaatagtttgcttgcccccagatttcaggagcaacagaaaagctgagattaagaatagggggggggggggggggggatgctgcacattcaatgtacaagtatcatcactcagtttctggaccttgaatgtccatctgaacaactggtccatgtaagaatttttttatccactaccagcccatttcgttgaggaaaaagtccactttgactctcttaaaagtcatccgaatctaatccgtgaccctcaaccgtaaaaccggataggatgactccctgaactattcaaactagtgcaatttgactccctcaacggttttggatgacggttttactgacgtggcggtgttgacccggtcttcatcccacgtggcgcttatgtggcattacaattaaaaatattttgtggaacccacgtgtcatcctttctctctccaacccttcttcctcccctctctctcccttctctctcttttctcctgcagccgcacccgctgaacatgccggtgcagttgaacccgtacgccacctcgccggtgccggacaccgcgatgagcccgatgaacccttcgtccagccgttccttgacgcagtagtcgatggcctcctgcagcccggcggcgacgtcgcgcgccagcgtggagcgtatgatggcgttgccttccccgatccgatcaacggcgagtcgccaatgcgcccggtcatcttgttcgtcagcccgcccgtggacatggccgccgcggtgtggccgtttgagtccaccactgcgcaacccaccgtctccggcgcgggatacggcaatcaaactgcttgtaccaattaatcacaggatgtcacggttagatgttagcaattttcataggcgaattggtaacatgagtcaatgcgctgatcgatgaaccaagatgctgttggcctccttggctcctcggtgatgaagtagctattggctccctctcgttcgtcccaccctggcgcggcaccatcgtgggggacgcccctgccttctccggtgagctgaggccgtcgccgccgaagccgccgctcgacccgctcaagttccttcctctgcgccggccctcaccctgccgccgccgccgctccagattccgcaccgaatctggaggaagagaaacatacagagaagggagagggggggggggttaagaggatagatagaggatgacatgtgggcctcgtaatttttttttcatgtgaatgacgaatggagcccatatagttttttattttaatgcatataagcgtcacatcaacaatacagatcaggtcaacatcgtcacgtcagcaaaaccgctgagggagtcaaattgcactggtttgaatagttcggagagtcatcctatccggttttacggttgagggttacggattagattcgggtcacttttaagggaatcaaagtggacttattcctttcgttgatctctctacttcgaccaagaacattgggcctggcccatcaagaacaattttagtaggccctgaaaaattgatagcaaatccattcccctgccaatctggcatcgcagtgctatcaaacaaatagtactactttatcctcctcatttcagtttgtcaagctaaatcatacactgtcactaacacactgacattaagttgggcgctccttgaaaagtgaacctttattattttcccttatttcagtaacaactcatgctgcagaatttcttgcagttgtttcttgtgaggtgtagcagtaatgtcactcttctgaagaatgacagtttgtaactacagaaagtaattaatcagatgctgcagaatttcctgcattgtttcttgtggtgtgtaggagtagtatcaattttctgaagattggcagtttgcaagttcagatttcagaagttaaccgatgctagtagtactccctgtggttgccaacaagttcacagctgctactcaccatcctgacactgcaattcaacttcaatactactccctccatctaaaaaaaagacaaaacctggtttccgtacccaatgtttgaccgttcgtcttatttgaaaaaattatgaaaaaaattaaaaagacaagtcacgcacaaagtattaatcatgttttatcatctaacaataataaacatacgaattataaaaaaatttcatataagacgaacagtcaaagttggacacgcaaacccagagtttgccttttttgggatggagggagtacaattcaagtactgagatttagatagatgttccatggacataaatatatgctccaacctgagagtcatttctgatcaactgtctgtctcgctctcacctcccacacagacaggaacatgaaatgaatgcaatgcagcatgacatccttttctcacatcatcacacccctaaccaccaaaacatcaagatcaaaggacaacaaaattacacaaagaccctgcatgccctcttttgcagatgactactcctagatgagacagatagtaaagccaattaaccatatactagtacttctgtatttctgttgtcctttctgtatttctgtatttttgttgtcctttgatcttgatgtcttggtttttttttgtatttaatcctagaagaaattgtgagcgtgttgaaaattaaacacgggacctcagagttagaaaccacataccccttaccatttcactatcaagtgaatctcagtactaatataaatcacagaagggttttgtctcaggtggctcctacctaagtgatcatctggttgtgcatctcaccattcacatgtctctagctttgcatagaaaagggtttgattttttggggatccacaataattggttgcctagagacattctaccaaacaatgcatacatacccctatatcctccttccacctcagttagtgggagggacatggagatcatcacaaatattataatcaaaattgcaccattaattagtgtgtgagtgctactaaaagactactactacctaagtgtgtacagatgtgggctcaggaattatgaggattatgaccagcattagggagacatatataatcaactacatatgtaccttgatagggtataattcatgaggtatagctgaaattttatacatttgtttgtacatgcacatcatggacaagtatgtgtacttaatgaggattgaatattatgatatagactgaaaatgaagccatatctacatattgtacaaagaaaaatcagcaacatcaactcgcccacatataactacataataaatcaaagattctagacaaatataaatacataagatggatgggaagcaacaattattgagctgcatgaaaattaagccaaacattattcaaatctatccgtggaagttgaccgtttgatatgactttttgaaacaagctagggaatttcatgcatgactagggatcaaactcatcatatgtaaaaaagaaaggacgagagaaaacaagtaaactatagtaaacgtcccatgtctaaaaaggataagcattattttttctcatggtctactgaccataagtccatgatatggtaacaaaattcaatcgattaccaggaatttgttgttatccgtctctttaaacatgtgttgagcttggagcacattcataggtgtgtgtgctgtgtatatgtatgcacttgtggagattatgggtaccccatacccacacggcatagttatccgactagttataggggataacttatatatatggaatatgtaacagattatgacttgggtattacgtttccttgtatattacggaacggcctaaagtcctggtttgataagattgtaaagtagatctaggaaaccgatactgtattggataaggtttctatcttgtaatcctgccccccatcctatataaggtgggcaggaggccctctagaaggcatgagacaactagatcgtcagatctataattcacccggcggattcaaatccccaaacaggagtagggtattacctctcattgagagggcctgaacctgtctaaatcctttgtctccgcatccatccacttttaggtctcgtgtgctacccccttttattattgccgaattcatgtttcgacagttggcgcgccagataggggtgcgctgagttttctattgacaagtgtgatggaatatatcatcgccgctgttggcgccatcttctgatcaaatcaatcttcgaccccacgagtttgtcgctccaatctgcttttattatttggttgattcctaattgctgattgatgtacgtgttgttatttctgattttcatgttccaacgatatggctggatctcgcaatgcgaattcgtcgagatgctacggcgcggctgctcattgtgcatgcagagccgcatgttgggacaccgtgctacagatcgcgtcgtgcaccctcccggcagcccttaaaccacgtctgcaaatcacctgatctggatcattggtgttaaccatgattttgtttgcatacgtactactcccggagctgcacagtccaaacatgggaccgatcttcatgcatacatacgtgcatcaattaatatccataatcatctacacttttttatttgtttctgctactaatctctattcgatctgtggtttcttattttgcatgtacctggctgccccgagtctgattctctccgacttggattcgacccggactcggacctgcgatctatgtgcaggaccacggatcagtctaacgatgtgcatgtgtgaatgcatctaccacgggagattaattggctaattaacaatatatgcatgtggcatatatgcgttggtatgtgcagacatatatccgcaagattagttttcttgattctaattagagatttcttctgtctctttacatgtaccgccggccgccttcgtcgctgctgactggtttcttcgcctccacggtcggtgtgtgccgctaccattgctgatggagataacatcttcaccgactggcctgctccgtgctgctgactagtgtctcgtctatacggttggttggtcacaccaccgttcatgggagtcatcgtcttcaccgaccggttggccttcgccgccgccgactggtggttccgcctgcacggctggcctattatgccgccgctgttgggagtctacgacttcaccgccggcctgcctccgtcgccgccgactggtgtcctcgcctatacggttggttggtcacaccaccgttcatgggcgtccacgtcttcaccgaccggctggccttcgccaccgccgactggtgttttcgcctgcacggctggcctattatgccgccgctgttgggcatctacgacttcaccaccggcctgccttcgccgtcgccgactggtgtctccgcctacacggctggcctattatgccgccgttgttgggcatccacgtcttcaccgaccggcttgccttcgttgccgccgactggtgtttccgcctgcacggctggcctattatatgctgccgttgttgggcgtccttcgactattgtcctcacctatacggttggttggtcacaccaccgtacatgggcgtctacgtcttcaccgaccggctggccttcgccgccgccgactggtgtttctgcttgcacggctggcctattatgccgccgttgttgggcgtctacgactttatcaccggcctgcctctgccgccactgactggtgttttcgcctatacggttggcggacttcgccaccgttaatgggcttcatcgtctacaccactggcttggttccactggcgccgactggtgtttttgtcaccattgatggactacttcgttcccacatcggctacttttgctgtcaccgagggaatacgacaaagctaagtcatcatttattttattctttatataatattttgccttttcctttgcctcactacatcaactggttcgccgttgactagtgagtcgagggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttgggccgattcctagcacccgggggcttgttggatggaccgaataatgcaaggtgctaagtattattcggaataaatcaaaagcatagagataagataatttattttctgctcttaataattgcaaaagtacccgagtagtaaactccgacccgtgaaactttgttccattaatgacgaactcatgtcactcatatgcatgtttgggaagtgcttaggccgactcccggtgcttggtggctatgactagtcgggcagagtgtttaaacgtaatgagtcatctgctcggggaaatcaaaattgacaagagaaaaaatacatatttataaatattttaaaatacttgaatttttctcgagtattatatttatatcagatactactcatcctatatatttgttctgcaggatccagatccatatatgcataaaagggattcatggctttaagcttatctcttacgctctaggaatggatcagtcagaacatcaccaccggcttgcctcgtccgccgccgactggtgtttccgcctgcacggctggcctattatgtcaccgttgttgggcgtctacgtcttcaccgaccggccgcctcatccgccgccaactagtgttgattggccttatcgtcttcatcgccggtcgtctcgtttgctgctgactagtgccctcgcctctacgtctggtttatacagctaccactactgatggacatcatcgtctttcgtcgccgactggttatgccgccgccgaccggtgcttttatcttcacaactacgcgtcttcactaccggtttgcttctgttgccaccgactcgtgttcacttcatcacggctatgcaattttgtcaccatggtggagcaacttcatttttattatcttcggcatcgacaaactctattgcctctacttcaccaaccatgacgactacaagagtttcgacacctcggcatacgtcaccaaatatgatgccgtgttattttattacaacaagtggtgttccaatcttcaatatttatcttcactcaagcaatgactactcgacgacaagaagttacagttctcgactctatattcagttgtttcccaactaaccaaagagtcgggggctacacaaatacaagactcttaaaattcgacaagctgaagcaatcaattaatcagccaacgagtcaattccaggagtcattatcttcgtctttgctttagagcagagttatcaaccaatcagctcagtttcgacgagttggacaacatcatctactttcctccaagtgaagcatctgcaacagatataacaccaatttgatggattattgtcactgacatcatcaccagcacctctgcttcatcggccttgacatcaactctgttgctaatggatgactatgtcttcgccgacttattatttcactttcacggttgctatcgactggatcaccgacatcgttatcttcatcaacatcctgtcaagcctcttcaacatagcccactctactgctattgatgggcaacttcgtcattatatttgatcatctatgattgctgcttatcatcattactgtcggttgcgtttgtcgtcgccgattattttcttcatcttcatgattggtggatttcgtcatcgcttttgatgcgtgtctacatcttcaccgtcggcttgctttcgtcaccaccgaccggtatcctcgccttcatggatggcttattatgtcgccactaatgggcatcttcatcttcttcaccagctgcatcgtctgtcaccgactaattatttcgctgccatggctacacaactttatcgctgggcgccttcatattcattgctggctgacctgactgttgccgactggtttcttcgcctccacggctatgcaacttcatcacttttgattggtatcactatcttcactactaacaatatttttgccacctctggtgggcaatattatctctatattggtcgtcttgtctctatgccaactgcgtcagctaccatcaatggacaattgtgactacgacagaaggacaagctatatactcagaggcttactacctcaaacaccagtatcataccttcaatttggacttgttccggatacatgcaacatgaatttgataatcatgggtctattttctatgctcaaagactggactatttattattccccgtatgggttatcaactgaatacttgcgccagtcggaattcaattgttatatctattttggagtatcccataaaggataatcactcagatcagaagctattcatatgagctacacttggtctatatcacccgaaagatttattactcgggagcatgttacatgcgtcatcctttaaagggtgtcgaatgcatattttttggcctaggcctaatatgtctgcagcccatattttcaggtgtggcctgtcacgttcttttagggacttaggcatctttttgcttaggcaaaagtgcgcgtgattatgtgcccaataccttaaaattcttttataccgcagttacttaactttttaggagttggtacaatacattttaaaaggtgccaaacagtaatgctttatatagctccccgctgacttttttatataagtcaaggcgttgtttgggttcataaagcaattgattggatacaatatcattgctttttgccacgtaagtgtgcacttttattgaccaatattatggcttaggctgattatatattttggtcattttccacgcggttggtaaatcctttatgagtttatttactcggattttataccacatatgccatatatttccaggtgtggtggaaccatgtgtcttctagggacttaagcacatctgttaaaacagtgtgcgcatgatgtatgcccaatactttggaaatttctttattcacaacatacaagcttctttatagctggtttgctatgtgaattttcaatgatgtagtcaactttaggttacactcatcatattttacaaagcagtcggtatatcactcggatcatgttattcagggattcacaccgcatatgctacatattaatatcaagtcacttggttgactataattatcgaagccactcggttggttggattatttattccttgactatatgcttagtttgttcaattaaccacatagtcgagggctacacctattaggtgcatctagtcgatgcacctgactttatttttcagccctccatagtctttagatttggtaaaagtactcgggagaccatggcaaagatgattgaagcactcggctgtggagtaatctagttcgaaagaagattatcttttcgactgtgaaggtctcaggggctactgtggagattatgggtaccccatacccacacggcatggttatccgactagttataggggataacttatatatatggaatatgtaacagattatgacttgggtattatgtttccttgtatattacagaacggcctaaagtcctggtttgataagattgtaaagtagatttaggaaaccaataccgtattggataaggtttctatcttgtaatcctgccccccatcctatataaggtaggcaggaggccctctagggtgcatgagacaactagatcgtcagatctataattcacccggctgattcaaatccccaaacaggagtagggtattacctctcattgagagggtctgaacctgtctaaatcctttgtctccgcatccatccacttttaggtctcgtgcgctaccctcttttattattgccgaattcatgtttcgacagcactgttcgtgtaaaaaaaaataaataaagaaataaagattttctgttctgaaagtatgtactacaattaaaagattctacaattaagtagtacaacattattgctggtcgcatacatattgatcccattcacgcatgtggcgatatctaactagaggcaggtagac

SEQ ID NO: 39601 - DNA, 5855 bp, Oryza sativa
ttatcgtgtgttacttaaaactaagcgtaaattatgtatatataagactagcaattagtacacgagtcgttgtcagatgcatgtttgcattgttcagagatcgaatatgcacacgttgcattgttcagacttcagacaccgtcaccgtcttgcgcctagctacctcccaacacaaggtccaaattggcaggttaattaattgctatgactaattaagctgtgattaattacgatgagaagaatgctacactgcccacgaccattaaagacaggaaccacaccatcatgacttcatgatcaggttgttgcctttgcctgtgaaaagtaatcagtataaatcttttctcttttttttccttcagaattttatttatttttggctttttacaacttaatttgtaattaattaccacacagaagtacagaacatacacacccttttatatacacgtacctagcctagctatcttctgcaacaaacaaatgttagtatttcttacaaaaattaattaacaccagatggtccagactaattaattaaagtaccccctcctctcaaaattttaaaactaagcctttttagataattaaaaattaagcctagttaatcaactgatcattatacctcctcctacagctaatggatgacattgtaatttagcgcacgtacatacatacatacattatccaacatgattaattagtgggggaaaagttgattgattagtgcccaaaaagcagcgggttacacggcgaagctctgctaatacgacagaatccggtgttaaacccttgcacgatcaatggcctgtctttggactagcttacatgccagaaagctcttgtctgctaatgcaggcaactgtccgggtccggaagttaatgactatacttaattaaccaaaccatataattatccataattaattaaactcagatctatatgattaatactatatcgaaccatgcgcatatgtcgccctaaaaatctagctagggtgccgtcttttcacttattcttatacttatcagccaaactttaaattttcaatcttaaatttggagctgattttgaggtttttttcattgaagtttagtttttagcctttgcttttagatcgctatgtaaaagttttactcacaaattacttttcgtttgtaaatatgacgtttgtcttatttcgtgaataagcgaaacgatgggtccgctagaatgtatgcagttgaagtagctcggaacaataaataattacttaacataaaaacattaggactaattaatttcacatagaaaaaaattaatatgttggtagattattcgtatgtaggtagctaatatatgttaggatgtgatatagaaataaataatatgttagtgtgtacgcgtcaaccaaccacaagcacatctgtctatatagtatatgcagccaataatgaatgaattagcagatgtggttagcagtagctaacacaactacttttcgtgcgagaggtgttgtcgcacactaatgggaatgaataggactggatatatagagtatggtatgatggttaattggtcgatcaattaattatgacgcatcagtgtgatagctatatatatgtagctagggtaaatacaaatatatgttactgatcccaaccttgctaattaatttaattatcagagacccaacacttcaattaattacgtgtacgtacgatatataaggccagcccagctagcaacttagagctcatcgcttgctcatattccccactaataaaccgttttcatttattgaagaataaaaattaatttataaaaattaatttatatatatatatatatatatatatatatatatatatatatccgtggcgcgtctctgagtgcggagcttctccggaatttccgtttttctcccaccgagcaagactttttttcccggtagggtcacgccctctagcggcaggacgacctccaagtccctttttaattggtgtatcagtaaaatagttcccgagtaaaatcaggcctatgctcgacacgtagtaaaatatttactcctgtttgtttggggcttgataaaaatcatcggtcagtaattttttcactcatcgtatttcactgccttgttggagtacaaaaaattttcactcctcgtatttttcactcgtatttcactgctgattccattcggagtaaaaaaaatcactgcctagattaggtctcagtgagaaaaataccatgtcttatctcatgtagtctcatcgaactgtagtaaaaaaattactcatcagctaggttatttactaattaagatgcccaataaggaagggtagtaaaaaaatttcttttaatataattacatagatagtaattttttactgcacatgtttttacgtacctttcccacctctaccgtcacaagtaaaaaaattactgattcatctctaaattttaattttcctttcttgcccacctcgtatcaacactgagtaaagaaattcatctaccctaatttgtacgtggagtaaaaaaatcacttcgtcgtctctactttaatttgcttgcacaaatcatcctattagacagcaagtaaaatattgatcattttggatccgttaatagtaatatttttactcctataatttttatcacttttcggtatgttgatattaatatttttactcacgtctatttaaggtgcacaaaaatcacacccaatcaggattattcaatcgtgatcatactatccacattaaaaaaaattacagatcgaaagaggaagaaaaacagaaatgcatctccgctttctcctgttatatatgatccagtttttccgttcctccgttcctatccaaattccaccttttccgttatttccattttttcgctttctccttttccgttcctatccatgtagtaattcccattcctaaccacgtaagtaattttcttaagaaaaatctttgaagtattttttttactgatagtatttccaaaaggtcataatatgatattatcatatgaacactacgtcgtctctgtctctgtggaaaaactacaatatcatcaatcctttagtaacaattcttcccacgcgccgtcgacggagccgctgggagatgaggatagggccggcgcggtcgatagcccctccgtgcctcctcaccggtggaagggaaggaatgcaggtgattggaacgcctccaccgtaatcgcagcacgccgtttctcctcgctgatgccaaccatcccaccgctgctctcctcgtaccgtccacagattcgtataaatcggatggaaagaaaaagttggattagaaaatggccatagcggccatagcggcctcccagcagctgcgcgcacggcccatccgtctccgcgtcaagccagagtaagggcagcagccgccacggggttggccgccgggtcagccaccatgctgcctccctcccatggctgctgcaggtgaactaggacgcgaagaagatgaggagatcgtcgccgcttgccgactccacgccagatcttgccacctaccacctcataccctgacgccgacggacgcctctctgcctctccagatccgaagaaatcggtggaggtgggtgaaatgttctgggaacataaaccccatatatatatatatatatatatatatatatatatatatatatatagacacacacacattagagtaaaaaaattactacagtagagagagtgggggcaggggtgtggaacgagagtaaaataattactggtatagagggtggtgggagatggagtgcaggatcgctgtgaaacgtgctacttagtttcgtttcgtagcaccctacgtgctgtctagtagttctatatatatatatatatatctatatccaaaaacagccggcgcttgatttagaaattttaaagtcctactcggtactagccgtatgcctcacttatctgcctatttaagcaaccaacttcaggtatccctagtcatatttgaactagctaagcgtttaccatctccccaggcagttccacccgaggggaacacttctctacggatactggttctccagacgcctatgcaagatgcaggctaaaaacgagaacatccgagaggtttctcctatagggtccctagcataaacgcttatctagagcaaacaaatagggaaacttaaagaaaattacttcatattaatcaaataggcttacatacggttttccctttcgggaaccccgaaggtagatacaaacaagtttttctcaccttacaaacctttatattacaactccttgcttcaatatatattatgcaaggtaggctagaggaactactactaagaaagatggaatggagggtgagagcgcgcttggaagctttgctctgaatggtgtcttcgtggttgtgtgtctccggagtgaaggccaacgtctccttttatagaggccagggatggcgtcgcctgtgcctcctgcttatctcttcgctactgtatcttcacgggagctggctaaagtcgaggcctttccaccgaaagttttactcttcacagtgatatgtcattcaacgcaccctatattgtccccttatcctttatagggtgtccttctggattctttcttgggtaatcttctgaatttcttttattcttttattcttcattcttttattcttcttccacgcccaaattgttgatattctattatcaatatatattgaaaaacatatttagcttatattaatttattcatctggttgcccatggccaccaagatccattgtgtccaaatcagaaaaagaaacttctaatttctcatctactgccttttttatttgctcaaatttctgatccatttcttgttttaattctttaagtatttcttccttcaattccttctttaactgtggggaggcttcttcaaatttttctattatcttccaatcaatatattccccatctaatggatccactccttttgttaagcattccttgtatgtgggttttttaaaaaacccttcttcttttatagtcatcttaacgggtatttctgaagtcttctttcctttagcttttttgcatttttgaatatattcttttgcagcaggctctagataataatttattcctaatatttttctagcttggcttaatgcttcatcaatatccttatatttcttccaagatattcctcccattaatttagcatctattttttgagccacaatttcttcaaaagaaatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaagatgcactcttgaacttcatctaggattatatggtcctttggcttaaatttatatgaatttggtgggaatattctgagtttgttgtcatctccaaatgtgaagcactcgactccggcgtaattcattgatcttttcatacctgaaatatggttaaacgagaaagcatgtcaggtaaactattatctttccccttaatatgttcaaatataactctataaccatttcctgtaataatatcttcaaataaaatccatcttctagttgagcttttcttgctattaagctggttataatatctacagatggcttcacaatcagttctaaccgtgaattctttaaaccctaggtataacctaaaggcattaattgcattgataattgccatgatctctctatctgtattattgacagtttttaatttataacttccaga

SEQ ID NO: 39602 - DNA, 8388 bp, Oryza sativa
gtacacagtccacatgatacacacaggagtccatattgattgtgtcaccactggcttgttgcattccaatgcacatttgcaccgcatatattgcatctgtcacttgacagggcatgcatacatatattgcaatattgcattgcaagcagaggcagccggcagagccaggtactcgatctatgcatacatgcacttactcctacagtgccagtgtgctgcaggccagcactcaccaggtcagcatacagcagtatatatactccctccgtcctaaaaagagacaaaccctaagccgtgtccaacgtttgaccgtccatcttatttgaaaaaatataaaaaaaattaaaaagacaagtcacgcataaagtattaatcatgttttatcatcttgcaacaatgaaaataccaattataaaaaaattttatataagacggacagtcaaacgttggacacggaagcccaaggtttgcttttttttttttttgacggaaggagtatatatgctcctacagtgacgccttaatttcaagtcgaggctagctattgcatgctctgcatgccactccatatctctgagactctgaatcaattcgatcataattcagagctggtagctatgcatttttttgcagcgacttcgcagtgtgtcttgttcacgcatggatcgagaaagccagtaaaaaaaaaggaaatttaagtttttttttaagaaaaagacacggtacaaagacaaaggttgacgcacgtagtcaagcacacctactactactgtatgagcatcttcgaaaaactgtccgaccagcatatcttagtgttaagacttgagagtgataaaatcactacagatatgagcatatcttaagagattaacgaagtcagcataggtgcttcatgttgacgcgatcacctagctaccatcgaaagaacaattagcaatagaatacgagtactgggataggatggttgctaggaacacttaatttgtcgtaatctgccatgtaggttagacgagtttaaccaagaaaatttgaccagttgtgataatatttgattccaacaaattagctcctacaagtcattgacttaaaaaaatgtgacaatattttcttatccttgataaggtgtggcacatatttaaatcaattttagtaggcaaatgacatagtaaagtgtagatgagtagcgtagatgagtttgaagacagtttgttgccaccttagaagagtatttgctggcaaaggacgataaactatggctgtacaatggaaccgtcaattcgagtatacctagttgccctaagtcgattccaacatttgccaaccaaacttgaactatatgacttggcagacaaattcggacggacggttagagtgacactcagtttgtgaatctaagtttatatcacttatatatatatatgattaatctacatgtgcagcctgcagttacggcacaaattaataaattgttgctgaatttaattcaaagccacgatcgaatttaatttggaacgaaggtgatttaaatgctgggcacatgtacagtaccaaactgcagtgtacgtagaacgtactaggtactgtacgcacgcacacagtacagttggcacttccatgatctcgatcgcggtgagctcaatcgcccgtccgtacatcgatcatggtcatggattattattgggtgatgcatgatcaattaatggctaattaaccacaaataaatatatgcatgattggatatatgggggatcgagcgagattgatatacattgtgcatgcatcctttaattttgttaggagggaagaaccctactagggcacgcccactctactagtgtagtgtgcaccccaagttagaacacaataataatgcggtagaaattagatatattatgtcgcaattataacacatattaatggattttcaactaattctgctgctaaattatgaataatggatcgacaggcagaatacatgcattgatgcatatagaacatggatctactggttgttaaaatatcatatcatcatatagggagtatttcgaagcgcttggacaatagaacatgtagccacaagaaaaatcatcagggtgagattgatattgtgttttttattaataggaaaaaacatcatttatttatctaacaaattatatgtctttgtcttaaaatataagaaattttatccatatatattttttacattccaagataaaggttatagtatatgtcagttttacataagtggaccaatactaaagaaagccaataactatctcatactacatttactctgacaacaaactcaatgtatatataatccttactattttctagctaataacaaattagcaagacattgcatgttggttgtaaagagttttgtgcatggatgtatacacttgtccattactcttatgcacaaataataaatagacatggagaatgaatattgatataacgataatttaaaaatagcataaaaatgttatatgatgatcaattgaaaataaaaatattatatgatgaccaattgaaaataaaaggagtataactcaagtgaatgggcactgcaggacaatcgtaggagtaccattcaccatgcctttcctgcataaatgcaacaaccatcaactcaaaagcagacaacaaattactgccaggtcaccccaaccccttggccccactgtcagtgactaacccccctccatcgtcctggcccactgaccccgtggccccacccaccatcttctactccctccataaaaaaaaagacaaactctggtttccgtgtccaacgattgaccgtcggtcttatttgaaaaaattattaaaaaaattaaaaaaacaaatcacgcataaaatattaatcatgttttatcattttatcatctaacaacaatgaaaatacgaattatgaaaatttttcatataagacggacagtcaaagttggacacggaaactcagggtttgtctttttttttacggacagagggagtacccatgatctgcctgtccatccggccccaccactccacaggtcagccactgtcctctctccccccgacacacctgccccgcacgtgcgctccactgacacgcgggccccatacctccccaccacgtgtccacctcccgatccgcatccgacggcgaagggaggctgctctcacggcgtgcgtgtatacgagtacgacaagcggcgtctcgagccacgtggcggtgaaggcgtattctaccggaatacgccttcgcgagctgggacgcgtacttgccgccgtttataagcttaggccgtcgtcctctccgcgagggagaaaggtgagcagtagtaaattggacaccgcaccaccaccgaaaagctcgcactctcctaaccatggcgtcgccgccgacgccgcagccgccgccgccggtcgacgtcgacctcggcaagctcagctacgagatattctccctcctcgagagcaacttcctcttcggcgccggcgccggcggcggcggaggtgtttgctcgctgcctgggacgcccgggagggcgcttcttggagggaaggtgagggtgctcgcgatcgatgggtgtggtccgggaccaggtgatgctctgctggcggcggcggcgctggtgaggctggagacggcgttgcgggagaagtccggcgatggcgatgcgagggtggcggatttcttcgacgcggcggcgggggccggggcggggggtgtgttggcggcgatgctgttcttgaagggggcggatgggcggccgcggtacacggcggcggacgcgctggcgttcgtggcggcgagcctcgggaagggcgggtggcgcggcggcggcggcggcggcggggggaggaggtggtggggggtggcggcgctgttccggcgcgggtcgtcggcggagaggtcgtcgctgcggcgggtgttcggggacgccacgctgcgcgacaccgtcgcgccgctgctcgtcccgtgctacgacctcgccaccgcggcgccgttcctcttctcccgcgccgacgccgtcgagagcggcagcttcgacttccgcctccgcgacgtctgcgccgcgacgtgcgccggcggggccgccgccacggccgtccgctccgtcgacggccgcaccgccatcgccgcggcgtcgggcggcgtcgcggccatgggcaaccccaccgccgccgccatcacccacgtcctccacaacaagcaggagttccccctcgccgccggcgtcgacgacctcctcgtcgtctccatcggctccggctcctcctccgccgccaccccttccaccgccgccgggtggcgaacgcctctcccctcccgctcgccgtcgcccgccgagatggtccgcctcaccgccgagggcgtcgccgacatggtaaaaaaaacacacacccacacccaatcccaaccctccatctcgaatccgacggctcccatcgaaccacgtcactaactcaccatgggtaaaaccgtaaattcccaggtcgaccaagcggtggccatggctttcggacacacgtgtgggcgcaactacgtccgcatccaggtcagacccgaaaaatctaattaccgaattacccctccatttttaccattttacccctcatttttactgacctcgtcggcgatgtgtgttcactgaccaggcggcgtcgccggcgtgcaagacgaaggcgctgagctcggtggacgcgaagaaggcggcggcgatcgccgacgggatgctgacgcagcggaacgtggaggcggagctgttccgggggcggcggctgtcggagaagtcaaaccgggagaagctggacgcgttcgcggcggagcttgtgaaggagcacgagcggcggcgggcctcgccggggctccccaacgtggtcatcaagcaggtggccgccgccgccgccgccgtgacgccggcgcgcctctcgtcggcgaccaccacgtcgtccgccaccgccaccaccgccaggaccaccgtctccagcatgccgtcgccggcggcgtcgctggactccggccgccactagcagcggcggcggcgatcgccggcgacgtcgtacgtgtagaagttttgtacatttgccatccatggacagaccgatcgaggagatggttatttaattttttttttatttacgtcttccgatgagtcactgacatgcgggcccaaccaagatggaaatgaggtgaaatatttataaacttaagttatataaatatttatgtaacttatatccatcaagcaaggatatgaatgttatttattcggttagttagtttcgtgctcgaatggtttcgaattcttctataaaaatgggttattaagatatgcaagaaacttgtgcaagttgcaaagcaaaagcagatgatgccttgacaaagtctcctcctcatcatcatccattcatcctcctcccaaaatttttcaattcattttccctcccatcagattgaaattgacaggattcggatcatcactgtcctaatcagcgattagttcctgatgttaatagactactaatcctactgccatggattgcaatgtttaaactcccatttaatcaaattcattagcctccttttccgtatcagtgtagtacattttttgtccagcatgaatgctgcacagtggcagctaaactagctatatagctccactacaacactgaatcaacgatgaacatatagtgataaaaataattaatatccccttgacgattttaattcaattcttgtagtagcttgctttcaagtgagaaaaataggctggggaagatgagacttgaagtctgcataaagttgctgataacttctacgtactcttcagctgcatcattgcctgccatggacactgtagtagcttcagattgttgtaatcctttcctgtactccatttcttgtagccttataccgtataggcgtatatacacagtatatacaaatagttttacaatggtctctctactaagtagaagtaatctagaccattcatattttgtaacataatcgatttatttatacttccacctcaactaaactttcaatggtctctatttataccattatctcaacaactgatggtagaataagtatttttttctattagtagtataactcataaattaacggttgatatcgtttttattggtgataataccaatagtaaaatattgccattatatacaatcgtaaagatatcgtatacggagtatatacgtagctgaagaagtaggtactgtgtgtaggcagcaagcccctttctgacactttagtttgatccaatccaatcctgaaaactttaatactgtagtatagtagactagtagtagaccagtagtagtttgattttggtagtccactagtatcaagcaaggatatatgttgttttcaagcctatttatttttgtttctcaccaatcatatatacatttccccataaggttggaaaaagaaacatggaaatcattcttgagtgaggacataactatatctgagctaataatatgtacaaactcggttcgaattagttggccttctcaaccagagtttatgcttttgattttggcgaaaattttggtaggaccaaaattttgtgatttttagcacttttcaaaccaaaaatttttgagatttcgacttaatttgaataaacgttgaccaactttaaaaaaaaaagagaaaacctgaaaatttcggttgatagatttgccggtggggtccaaaattaccaaaattttgttctcaacattactgaggattcatctggaacataggatctcacataaagctctacaaattacatatgattttttccaattttatatcgggacgcggaaaaatatccgtgtcccggacgaacttgaaactggaactgaaactgacaaaagtggacgctgatgggcaagctacgatcctccaacccaatagctgccatttgaactaccagctgggttacttacatggactttttcttcagatcacacggatggagaagactagcagaaacagcacataccaaactctttctgttcttgtgctcaaaaacagtggctgctgcagcatctgaattctgcatgtaccactactcaccaaattcaccagctgcatgcacagatgctactgagatttttacaggcaactcgaagacaagaaaaaaagatgagcatctcttcagttcagtacagtactgctgcaaatctgggagattcctgtacttgtgtttgatatcttaaaagattgcaaattgcaatttgttcagggctccatgcatctcacggcgctgcatttggcccaatgctcttagctagcttcaaccgcggttaattcctgaactaatttagtatctgcacacgatctagtaatctacaaaggctgaaaaaactgcatcatttttttttcagaatggaggtaaataaataaattacagtcttagagagagtgtaggtaagtttttttttcccaagagataaactaactaaccaacgccatagatctcacgtcgcccaattaccaacgcctgatctgagtgatcacctcgttaaccatcatctctcctacctctaagtgcgattttttcaccgcctccgagcagttgaaagttgttgtcactgcgatcctcggatgctgtggcctgaggatttctttttctcagtggcctcttaattgctcgagcatttgggaatttgggagcagagagattcagagatcagagagcttcactggaaccttccatgtggtgggcaaatccagcaagattaacagctttgtttaaccattcaggtaacgtgatcgagtcagacttttgtcgtcgagttttcgcggcaaatttcgcttgcaatttgtagcatgtcgagacgaatctgcagctttagtttttagtttcagtgtctgaatattttagtttcagtgaagaaacacattgatctaggagagctttgcttgattcttatttttttttacctctgctgttttcaaccaaaggtcagcgttgaaatgttaggttaacaaattactactagggtcagctacacataatgtggttagttattgttaattactgcatggtccatggccatgggtttagagggcagtaaaaaaaatgtaaaattaacactgctagcttgtatggcatatttaactagaattaaccagctcaagatcttatgagggtctcttccctagtcatatatggttgaaacgacatgaccgagatctctgaatgagtagttaattcaggttacctgctactgctagttaattagctcgtgaagcacattttttttcctgtcatgtttttccctttcagaagttcagagacttgagcaagcccaggttgtactaaactagtaatgcagccaaaatcactcagaaaaaactactaattt

SEQ ID NO: 39603 - DNA, 8523 bp, Oryza sativa
  unsure (1)..(8523): unsure at all n locations
aaaggcttgagaacctgttcttgcagtcttttgtccttgatcaattggcttcagagaaaatgtacttgtgctgttatgcacttatgctgatgaagtgaaaggaatttaggccgtgtttagttcacaccaaactttccccaaactcccaactttccatcacatcacattacatccaaaactttcctactcacataaactcctaactttttttccaaactaccaactttccctaaacttctccctaatttcaggaactaaacacagccttacaaagaaatgtaaaacaccgtcatcgacgcatgtaaaatggtcggtcaccgaaaaacgctattagttgcccgaactccacagcaccgcaggctccaccactggtgaaacaattttggttatggagtgtgtcagtttgagtgagatcccgccttgtcatgaaacgcatggatacttccattgtccctcaaaaagacagtgggtagtagtaaaggtgaaagcatggctaatttataggtgaacaccaaagcaaaagtgcagatgtgagtagttacacttgtccccatgaaagtggtaggagctcaaaaggagaaaaaaaaaagagagcaggggtcattcttccattgcctttttcaccattggtaatctaacctaaacatgatgcaaaagtttgttcacatgttgacacaaaaataaactatccttatgcaaagccatttaccccttttcctgctacatgttcagctcatgtatgtactgatagtacactatactttgatgttcttctatcatttgggggcatgcatagttgagtggtccaaaaatcacaatgggctttatggcatattggcatcctcattaataccttttctcactgaaattcagaggcatccatccatcaatcaatcaatcatcatccaagggacccaacgccaagcagagataaattcgagatcaattctatgctctgtttcagacagtccttttttatggtgtagtagtacttgtaccagtatcagcttccatgctgcattaaaccaaagcaacttctgctcatcaactaaagcttcagtctttcagaaaaagaaaacttcataatttgttttgcctaatttgcagaatacgtactttcttactaactcatatataatccataaccttgttaactcattcatagatataattatataaactttgaacaagagaagaaatgaaagaaagagagcaaggaatagcatatagtagcagacagcaggaaaagcagagccaagctcaagtcacgagcaagatcttgctgctagtagtataactttgcatttgaaatttgctcctaattcgttcgaattaaagttgacagcagtcaccatcagccaatgattggatcattgaagattttgggaaatggagactggagagtgcagaaatgcagcaaagtctgaagaagaagaagaactgaagaagggtttcctttctgatctcgcacgccatctcgaggaaattttgcatgaccaaagtcagaaattgcgaagctaactatacctaagtacgtatgtacgagcatcctttattctgttagtctcaaacgaatttgaaacggattggcaaacttgggtgatgaccattgtgagagtccttgcgtttcatcaagagtgtacgcttgggtttgtgacaaaatttcatgctaaatgcatgcttgcttgggttcgcagcctacatgagccaaagttttgtcatttgaagacaccatttttatcctgatgtcaaaattttggtaaaatcatcttcgctgtaagttcacctttttaatctgcagacgatgtcaaaagttctttgattaacttttcacctacagcttcaatccaccgaggcctttgtttggataggccccgaaatatacatccaagtttgtgggccaggattttagcccaagtatctagcccacatatggatgggctagaactgaggcccatataagcaaggccctgagactgttaaccaaaacaggccacaagcccactcaacggcccaagaggacaaccaagcccacctccaagcactgaataggctgagtttgaggcccaaccaaacgaggcctgaggctcacaaccaaacaggccaacaagcccatcatcatcaacacaaaggcccatcaggcccactccacggcccaataagacagtccggcccacctcccaaaccgccataacttttcctccaagcaatacatcccaaccaaaccgtcccgaccccttacgccactgacaccacgaccccacacctcccgtaccccacatgtcatcctcctctgaccccgcgactccacgcctccccacatctacctccacccatcgacctcttctcccaccgacacgtgggcccaatgcacgcgtggatcggtgggtcccacgtgtcagccactgccctcccggggaaaatatctcacgtcctgtgccttttaaccccattcgcctctcccttctttttcacttcgtctcctctcccctccaaaaccctaaaccccccaaaccctagccgccgccgccgccgccgcagtcgtcgccgtcgtcgcagcagcagcggcagcgtcaccaccgcgaccggcggctgcagcgatgtactctatccttcgccgcgcggcgccgctccggcggcgcgccgtttccgccctggccgccgcggttctccggcgggaggaggcggcggcggaggtggtcgtgtcgcggcgggcgacgatcccggcggcgtggttccactcctccccggcgtggctggggttccgggagacgggggccgcgggggcggcggcgaggccgcagtacgcggcggatgaggggttgttctacgaggaggataagaggggggcgaaggcgggtggagttgctgcgggcggcgcggaggaggggttggaggtggccaagctcgggatctcgcccaagatcgtcagccagctcgcctcgcgcggcataaccaagctgttcccaatccaggtatcaggagccggcagtccccccatcttctgttccatttccaattgaatcgtgaacaatttgttccttgaatcatactttcgtagcgaaagtttcatcctcttttacaaattgtggcactcatatgccaagctgcatcatgatcgcttgagctaagatttgggtcatgtagtcaagattgaagtgtgatcaataggtgcagagatattcagtgcttaagaaaattagtcagagtatctgtgagggggttaattctttatctgccctaaattatgcttctttttgtgtgctgtacactgcttgatgctgaattaccagcacttgttatgggatttctatattcagacatttaagttatacattgaaatatttgctgtgattattgtgatatccactttatataactgcacaagtagacaaatgcctggttcagatattttggtttgtttaggagtcacggggaagctgtttttggataaatatgtgcgtttgtgtgtaaataggtgtaaatagattaatagacataacacagtgcggcaattcaatcatttatatttttttattctcgagcttatagtggctcatttatagtggcttctccatgtatgctgtggccaagtttcaatgttttcctggcaatagcataggacattcaagttactttcatatattaagtcaacggttcattttgttcagtaataatcatggacttatgttttgctgctctgcgcagagagctgtccttgaaccagcaatgcaaggaaaggacatggttggtcgtgccaaaacaggtacaggaaagactttggcttttggaatccccatactggacgcaattattcggcacaatgaaaagaataggtaagttttggtcctattgtcttcatatatttttttctttactactattggtttgttcctctttgttttttgggtaacctttgagcctttggatgcaacagccctggtaaatttcccttggctattgttttggccccaacaagagaactcgcgaaacaagttgagagggaattttctgattcttccaatgtggaaacgatctgtgtatatggtggaactccaattagccagcaaataagacaactcaattatggagttgatgttgttattgggacaccaggacgagtaattgacctgcttaaaagaggtgctctgaatctgtcagaggtccggtttgttgttcttgatgaagcagaccagatgttgtcagtgggttttgatgaagatgttgagacaattttggatagagtacctccaaaacgtcaaaccttgatgttctctgcgactatgccaacttggattcagagactcacccagaaataccttaagaatcctgttacaattgaccttgtgagttttatacttgctaaactcctttgctcttggttttacacataatccattgcatagattgtggaactatatctgtttttatttaaaatgcactctcctcttgctgtgtttcaatgcattagtggcattgtcagattgtaaactaaattgccatgataactgtagttctgttgtatttatattttgttttgctagatgcctgatccttcaaaccttaaatgctactcttgaattctgttgaatcttttatattctaattaatatatatttcattggtgcaaaagaccaatgcagtataagaacttgaggtattagcattaattatttccagcaaggtataaaatttaccttgaagtacattttttttggttcgtttcattcactatcttcagtagtataactgccaaatgaaaactattgaggcaaatatggtccagtttaatctattttgaattatacagttaaaattgttcttatgtctttccattaagaagtcattggcacaatatctggtactactttatgatattattccttttataggtgggtgaagatgatcagaagctagcagaaggaatcagtctttattctatcgcttcagagggccatgccaaacctgctgtccttggagaattgattaaggtgaatgtagtttactgtcattttttatgtttgaccatatcgaccttaaatactaatttttactataaaatgctttaaattaattgttcattcatttcaggagcatgcaaaaggtggtaaatgcattgtatttacacaaacaaaaagagatgctgatcgattgtcctacaccatgggtcggagtttccagtgccaggcccttcatggggacatcacacaagcccaaagagagagaacattaaaaggattccgtgaaggccattttaatattttgattgccnnnnnnnnnnnnnnnnnnnnnnnnnnnnncccaaatgtagacttggttagtgttttccttgattattctgctcttctaattttgtatgaaatagctgtttctaggttggttttctttcgctgtgttttaggttgtttttttttaaataaaaatagcaactacactttgtgttgaacagtgcttgagtgacttcccttccttttacaggtgatacattttgaattgccaaactcctcggaattgtttgttcacaggtctggccgaactggccgtgctggaaagaagggtaaggcaattgttatgcacattttatcaacaaagtagaagctatcaggatggttgagaatgatgttggctgcaaatttacagaggtaagacttgattgtatgcaaatgcaaagctgagagccaatgtatcttagcatatacagctttctatgcaagttaattttcaaaccatttctcatacatgattctaaaagagctatccaatttgatccagcttccaaagattaatgttgaaggttctgacttgatgagtggtggctttgattccttcggtggtggtggatttggtcgtgaagggggtgggtcctatgggcgtcgtggtagttttggcagctcttcaagccgaggcggtgggtttggtgattcagggtttggtcgttcaggtggtggatttggccgttctggtggtggaggatttggccgttccagtggtggtggcttcggtgattctgggtttggccgttcaggtggtggtggtttcggagactcaggatttggtcgctcaggtggtggcggttacggtgattcaggatttggtagttccggcggtggctcaggccgttctggttttggccggtcaggtggatttggagattctggctcaggtaggtttggtgggggatttggtaactctggctcaggcagttttggcaactttggcggcaacaattctggacaatccggtgggtttggctcctcttagattggcagcttctatactagggcaaaagtaactacagttttttatctatgctatgggtgcctgctacaaatttagatggacggttttcagatattgtccaccaccacagaagggaattcctgaccaattgtttgttttccggaatcactacaagactggatatctagtgcaaatagcatatgcttatcgttattatgggtgaagggaatatgaaggcagcagaaaataatcacgagtcttattttgtttttcttagttattcctcctgcaggcattcatgtttgcaggaggactttagtttctggtgctcgatctagctcatacctgtaaaatatggcagaggatcttctgcagatgatatattataagtatctttttttggtagtagttctgtattgtatttaccggtgccttctagactataataacctagatacctaatgatcagaattgcggcttcaattctgtagtagtgttcatctgcaatggaaggatggcggctaagatgtgaccattgtctgaagtttctcgtgcttcttgcactggttgatgcacatgccagaaccaaaagaaatgggatgctttctttagattttttttttcttttccactttgacgaggctgcattctttcaaagaatttctttgatatcctggaaaagcattttcgctgaagaaaatgctggacaagctgtaatgctgtccccctcctgatgaggcagaatttatgttaatctcaaagaaaatgtgtatgccggttagcaaaggcacagcttcagtgcagaattaattaattaatgcgagcatgaattgttagtgtatgtactgctgctactccgtggaccatcagaaacgtacatgagactaaaatgtcaagagtgtattacttgaatggccaaacagtcagaaagccgagttattcaaagcgtattgcttagtacaagtcagtggccatgcgtgcacaatggccagtacttcaaagttctaactacttctaagtagcttatcaaataacacaatagtgttaaccgaaccagcaagattgtgtgtgtcaccaggatcatgtgcagctttcaagtcatattacttctctgtcggttgattggtcatacactctagcttcatttgttccttgcttttcttactcacaaggatagggatgaacatggagcttcatttggttcttggcttcttgctcttctactcacaaggatatggatgaacatgtaaatttaaagctggaaatttggaatgcaaaattgcattgtcacaactcacagtcccattactgataaaaaaaaaggtatacatatgtatagtcatggatatatacaaggccaacactgcatcgacaaggataagggagcaacttgataggagtgaatttcacattgtgttatttgagggactaagctcccaattcaaaaagcctgcatatatttgattggatgtagagacgggtaaaaaaatacctctctagaaaaaaaggagcaacttgattagattgtgacaaatttccacatgctgttactattagtgacagtatgcctaatctgtttgaccagtacttgcctgaacttttatttcttgagagctgtacttttctgaactggatagcattataaaccccttgtcattttcttatcatttgtatttggcttgcctgttcctgtcagcaaatagggctccatgtctacagctatggacctatccacagtgtcttttctatttttcgatgatggaatttaacttggcctctaaatccacattatgacaaaaggcttcgcttggcatgacatcagtttgggtcattttccttccatggctagtggacaatgaattatttttgggaggttttgctttctttttcacctcatccagaagcaaggatgaataaaatgtcctcatcatgtttaaccaagttgctgccaaaagacaatttggtcagagtattacaaatattctctctcaaagagtgtaaaatatttgctttttcaaaaaatgcactattgtttgttaagacaaaatatttaatttcagtgttttttttcaactttccattttctccaaaagactagtttttgtcaattgttttttttttcggtataactcttgaagtcaaggtaatgaacaatcactatggacttttcatgtggtgcattagttatatacctctctagtcaatcaattaataaatgtatgatatgttctaaatgccaaaaatgaaactatataaactccttcatgaaagacttgggggtat

SEQ ID NO: 39604 - DNA, 860 bp, Oryza sativa
tggtcattgaattatctgttaaaatcttttgtctgtactaagtgacaatgacattttgcatgctcactgtaatgcagaatacattgttcagaagtacaacccaacgcacacctttcagttgtattaagaggatcatcttgttcacttatattagtcctaatcatggaacagcggtaggaaaacttgcatgtcaaactgcagttaaggagtacaccgacatggttgtttccgtggagcccttttgagtggattccatgaactatttagaaatattgtttatgcttgtaattttttcagtcttcaaaatgatttatataaactatacatttttcttgatgaaatggatatttctgttatacaactatattttaaaactaaatattaaatattttggaattggagtatatatatgcctttttgggagcaagtccttttctatttacaaatcaatttcatatggtctctgaagtctgaacagaaatggcacctcaaacagtgtgaacgactgctaagtaacacctaatccatcaacctatatccatctatagtataatcaactcaagatcttgggtattaagcattaagaactaacttaagaaatatgtgaacacagacacttcacaacaactctaaatcaccttacatcattagaataacttaaatctgattcttccgagaataagaaatgtacaaaatattaatttgtttatctttgtttatgcttgtcgtttccttgtgtgaggtcagcactatgtcttttccatgctacttcccagagttgcaaccagctaaagtcaatcccagtgggacatctgctggtggactcccatatattcagggattcagggcagagagcagta

SEQ ID NO: 39605 - DNA, 1950 bp, Oryza sativa
agcatgtgacagaacctcatttagcaaattagcagactgatcctccagaaatgtcattattagacagctaaattcagaattagtaagaattaagggaggagcagtctaagaatgttctaaaaatgcaggcttgcaacaacgtgaggaggacaagaaagtgcaatatatcgctgattaccaatctgggattttctgtattactaatgatgtaatagtagctactgacgtgtggacctggacccatatgtcagtgactgttactacaccaacaatactggagaggatgatatatgccgctaactacttttaggatacttgcatgtcccatttgatagatgaagacaagatgaagagctttttttcttgtgatgtatattagctatggtggttcatctccctcatgggcacattggcagtggttcagacaccattgcctcctttgagccagcactttcacaccaaactgtaacaaccaagaacatgaaggtgagcctccagatcagtgaaaaagaacaagaagaagtgagtgctaacctctgaagtttctttcctaaatttcccctttttgatcacttgcaggttctcttcaaaggtagaagcaccaaaataggcttaggaaaaacaaagaagatgggagaaacaagctgcatatatgtgtggggcccacaagcaagagagaaagagagagtagaaaaagaaaaggaaaggaagaaaaggctaatatgctcatcttttttcatagattatactccatatcagtagtatattgtgtcataaagaataaaagagatatcagactgccccccctctctctctcccctttctcttgcacacaatatcatgatcacactatatttttagtcataggaagagatatttgagaattttgacagcttcctgatcttaggtttctttattgaactgatcttcttttatcagtgggataaaatgttgccctatagctatatttacaaggacaaaccaaatgttttagtatataccagaatcaaacatgcaacaattaattaagtattatagaactaaaaccactttgttaaaagcaaggtctaaattatctggagaaagtaagaagcaacatgtgatatattataatattgtctagtttttgtactaaggtgtgtgttgcaattgatgcaagtggggtgtagcataatccatacaagtaagatgccaagaatggggaggagagactgtgattatggcaggaacatgctcttaatcagtatacagaagtactactactaactacttgcaattactccaatctctctcttttctcattaactgcaatgcataatccgtactatcccgtgcaagtaactcaaaacttaaggcctcggttagggctactaaatgaactatctgcaaatcccgttgttctcccgttgacaatcatatacttagcatattactcattgcttgtttgttagcttatcaagcacatcaaaaaaataaaatttttaaacttagttttaagttatcttgaatcatcgtttattgtcaatattatctttttgaaccgtcaataaaaaatataaaaaattatctatgaactttcctttttctgcttcattcttttttatggcttatcagccatagttcaaacgatccaccgtagctcaaatatcctactactaattatttttcagctaaaaaagttagcttccattttccaaccttacaatcaagctaacacagtcactgtcatataaatagtatactcaccctaatcaagctaaatcttttattttcctaatgactgaactccgaaataatattaaattagaaatctaatgatctagaagatgaaaaccacctcttttctaatcaagctctcttttgtaaccacccaccaccacagccatcaacaccaccaacagtccaacactgcccaattgcccatgctccagacttctttctactcctaca

SEQ ID NO: 39606 - DNA, 2938 bp, Oryza sativa
tgatatccctctctctctctcacacacatctctttttgcaagatctcttcttgttcatcatcttcttctttttttctcccccttttgcttcaccaatccatcttttgtcacgagatgtggccgagctgaagctagtagtagtggagcagcgaaagcaagtacgccaagaaaaaaaaaaggaagaagaaagaagaaagaaagaaagaaaaaaacgccagcttgagggcagagggcaaaagcggcgacgaggagcagtggccaaagctcagattcttcccgtgggctatttttaccacccgcatcccctctctttgagccccttggccgattcattcaccgacgcaaagatccaacccctcttcaggtgtcggcagatgccgcctttgtgaggtttccagtggggggatttctcgtcgtttcttgcgtgcggttgcgttcttgatccagtgagcgcacggatatatccgccctggtttagtagagagagagagagagagagagagagagagagagagaggttcttgattgagttccaagtgttggattgggttcttggagctgttggattgggtttttttgggagagagatgggggtttggaggtgtgtgggttgaccgaattggatcaagattattgcgggaggggggggggggggttgcaatggcggatttggggctgtggaagcaagggtggaggtgggtggtgtcccagaagcacatcctgacatgggcgcacatggcggcgagcggcggcaccgagaggctggccttcctggtcgaccggcattggcccgccgtgtcccgggcctgcgtgagctccggccgcctcgcgctcgccgcgctgcggcaatggcgcggctgcgcggcgcgcgggatcctggagatggctagcctgggccctgcgtccgtgttcgtcatcctctggagcttcttcgtgtgcatcacctcgccggcgtgcgccctctacgcgctcctgggcatggtacggcatgcaagtcttgcttgctttgcgctttcgccttgatgatgtagtggattatggataacgatttgtgcgcgttctaaatcttgtcatgtgctcgtctttctttttttcttctttttatcaagggtggattgcatgttaggttacctttcttttcgaaaagtatagttaaagtggtaattggtggtacaaaagtagtatgtcattacactttcatgagattgatcagtttgatgtgtttctagattcatttatgctttagttattgcaagtttatactacacttcagtaattcacacgtgctgtttctagatgttattttggaaccgttcacagtattttaagcagagaaagttttatctagtttgtcttgctagaggaaggagcacatggaaactaacacttgcatatttagggataagcactactggttctattcctattttgtgtatgttagctaatgtgtttcttgctgagtggttcagtttcaggttcattagcagattatcttattggttgatttatgtcaaaatacttaaggtcaattcgtagtttgcacagtgtacttcaataacatgaatgcaactcgtttctttgttcagcctgatatttatgaaaaatcttataatgtgatactgtgtttaatatgtatgaacctgtctagagaattactagctagtgaaattctacttgtttcatttcacacaaagtcaactatgggtagactggttcatgaccatttatttaggctctggtacacctgtaactactgctgtagttgactatatgacttacttctgctggttttctactgtggtatgagtttctccctttgggataccacctgtgttcagtggaatgtcaggtagtatctgaccttttcagctagattgcactggataaattatactgaaataagcaataggaatgaattccaggactatgtctcctcttgttctctccttgcaattcctcttattgcaatgcagactgaaccacttgtttttactatcatctggcatacttgttcagttagtaacttctacttgcgagtaaggatgcaagatttcccatgtaagatggatactataaatatcattttgtctaattgcttaatacctttcttttttcagggagctgctggggcagtcattcattacatgggctatacgcctggtcttttcattgtaggattatttggaatattgattatgtggatgtatggctatttctggattacaggaatgcttctgattgctggaggtttgttttatcttaatatttaagtctgttcataatgataattttgtgtttttgtttgtcaaatccataaatttttcttcctccctagttgcatccgtttgattcttttgacctaaaggaggatcctctctggtaatgcaggctgtatgtgctctttgaaacatgcacgatttgtgatacctgtgttggctatgtatgctgtttattgtgtggctgttcgtgttggatcgcttggtgtcttcttgacattgaatctttctttcctgacaaatgatcttctgaataagttgctgcaaggatacgagggaagcacagaagaaagacagtttgaagagccaaaacattctgatcctgtcatggatgagttctatcgcagttgtgaatttccctctgctcctgatagtgaacctgagactgtttcttctgcaaagcccttttgctcaacacccgtccaggatgtgttgcatgtacagaaagaggcatctcctagcaaagtagtgaaatcggattctgtttcattggatgagatgaagaggatcatggatggtttgacccattatgaagttttgggtattcctcggaatagaagtattgatcaaaagattctgaaaaaggagtaccacagaatggtaataaaccacggccttctatacaagggaaaatgagaaattcatgttacaattacttcatt

SEQ ID NO: 39607 - DNA, 707 bp, Oryza sativa
ttcctgcacccctgtttgacttagtgcttatactcatataagtcaaaatttaaattttacagcttaatctgaatttgagcttttggttttctggtcgtagtttattttaccgtatctgtcttttagacactaatgacacgtatataaaaacttcacccacaataatcttttatatcgggtgtgtttagttcacgcaaaaattgaaagtttgattgaaattgaaacaatgtgatggaaaagttgaaagtttgtatgtgtaggaaagttttgatgtgatggaaaagttggaaatttaaataaaaagtttgaaactaaggctgtgtttagatccaaagtttttcagtcctttttccatcacaatgatcacatcaacctgtcatacacacaatttttcagtcacatcatctctaattttaaaaaaatctaaactttacgctgaattaaacacagcctaaactcggccatgataataaacgattgggataaacatataaataagaaacaacgagactcttgatgtaccaagccgagtctgaagaagagaaaagagagagagttcagaaaaaggaaacgaccctattctgatcagaaaaattcaatctttctctctctttctctcagaaaaggtcgagagagaaagtggatgtcttcatgtgaagaccagagagaagacgagaggcgatcgcagtggagtggagtgaagtact

SEQ ID NO: 39608 - DNA, 886 bp, Oryza sativa
aggattgggttctctagctttttctctgcaggaactttgccaacgcatcacgataatcaaggttgattaaaatcacgatcaagatccccaatcggaatcggaggtctctaaagtaggatcgcaatcatataatcgtaaaaatcatagattctatacctactagaatcgtagaaccagacccccttaattaagatctcaaagttgtaaaatccgtacgatagaacagggttcactttctctgtttgggacttttgattgggggtcaccgaaatttcggaaatttcggtccgaaatttccgaaattttgagcaaaatttaattgaatttgaacaaatattatccaaattcatgaaaactttgaaaaattgaaaaaattcggccaaactaatatcatatcggtcggtccgaaatttcggtccgaaatttccaacactgcgatagaatcgagatttcatcgacacacccctaataattattcagtatggctctaccaccttgatgtgtaatcgtctgagttcaataaaagcttccgttatctaaaaacaatccctgataattgttctttatgggattcacagcactaaaagtctgaaactgaatcatctgggcactgaaaaaagaagaaaacttttttttggtttgcattgcaggtgtgtttgcagggacagtgaggacagaaggctgcggcgacaccttcttcagcaggacgtacaagtcgctgttctgcaggaaagggccgtgcagggagcactgcgacaacgagggcgccgatggtggctattgcatcttcttctacctcttcgtccgctgcatctgcaacgagaaatgcagctcaaaatagtggatcctcctcatcctcctcctgctgctgctggtgatgatgata

SEQ ID NO: 39609 - DNA, 8695 bp, Oryza sativa
aaaaaaaacaaaatcagctctaaatttaaagttgaaaattcaaaagttgactgataagcattagcattagcgaaaagataaggccgtatacaaaaaaaaaaaaaggtgctactccctccagttccaaatttcatgtcgttgaagaaattttgtgggtagaatgaaaatttctgtcgttcgataaattaatgaacattttagacgagtccaaatttcctgtggacccaatgaaaatttcacttgtcgaatatattaattaatttttcatatgagtatactactgaggtgagtttggttgggtgaagtttttaaggagggattgaaagtttagggctcattcagttcagaggattttcataggattattgtacgaattgaaacattaggagttcttttctcatacgcatcattcattccataggaatggatcataccaaattcctaagaattgtagttccaaatttcataggattcttagaatgaggtaaaacctctaggaaaaattcataaggaatggagtgcatgtgacatcttagttttttttctattcctttgatttggaaatcctataaaccaaataagccttagagggatagggttattaacggtttttatcaggggacatgtatggattgaaaattgtggaaggaactcgtgtttttaactacctaggtaggtggcgagagttgggaagaaatttcttatttacgtgcctaaacaaatctctaacatctaaatgccttgtcatgtgcactacctttaccaaataaaagattggcgaccttatagaaagggattgggagtttaaaggagagaattggtagagaggttggtcatggtagttttatttttactccttgtccctggttaatgctgctgtggtttctacttcccagtgagaaatgccaagttcaaaaggcaagttcaaaaggtatttaatataggtaggacagaaaatagacactaattaattgctcctcgataaataagatcatgttcaaaatgaccagaaatatggacaataagacaacacataattcacatttcacaattgattcaccataagaacagcatgctccattgatcaatccaaatgttcagacataggttcaattaccatcatccatgcattaaaatgctatagacataacaagtggaccaccctcacacggttttattattgtggttttgattctttcacaagcttttacataacaagatcatcagcaacagcgcagcaaagattcttcaggttctcgaatgcgccatcttggagtgtgactgacgccattctgttggaaatttcattctcagaagctctgtcaaaatcgtacttggcgcgataaatgaagtagccactgcactcccaggcagaaagacaacatccagtagccagattcttcacctaaagccaaagatattaacagtattcatcctcttattggttgctgaaacaaaaaaagtttgcaaaggaaacactgcagatcaacgagtttcacctgtggaaacaagaaaacctttgtgccattgttggagatcagcaggctgtacgcagtattattgtcatgcagagttaaagatacttcactgacaaaattggcaagcgtgtttacgtccttgccagttaacacaagagccttcataggataatcaattatttcatacaggtgaacggctgatgtggctttgccgtggtaaattgcaacagttgatgcagactccactggcaacgggtttgcgaagtaacaagcctgtgatttttataattttgcaaataaataaataaataaataaattctccttcacacaacctttgcaagtagagaattacagtatctcagctacatattattacagagaacttattcactcactagtttccataccgaacattaaaccattcaaaaggcaaacggtacaggatatcatggctgtattcaaatgtactgtttacaatcttacatatcatagcaaattaaagtagaagattacaaacaacaaaaggcaaagattaaatattgatatatgctgcaaacactagagatacactataacaaaaagtacaggatagcagttcaatgcttaacatgagtgttctacttaaaaaactgaatgttgcttccatcaaacagggatacaggatgcttaagtgaacaacgcatgattgaagtaatagaaagttctttgagcatcagaactagacagtattacctgaaaaaacatgtggtctggcatcgtggatgtgcaactatcaaagaaaacccggaatgctgcactatttacttcagaggcaatccttgcaatcagactaaacatccttttgtcccagaagaaggatagctgattggttgcgcttgggaccaagaagatatgaccatattcaacaggatatgccttcagaacaagaaaatgcaggtgtcaactagcagttatatagaggaaggtaaggcacgagttatttgaagctcatcctgcaacttacatttgcaatcagcagtagtccatcctttggtggttttgttgaaggaacaacttcaggtatatccttgtcaccttgagcaatgcacagaagcaattcatcataactattcatacagtttggcttcaggcatccaacaggttcaaggaacttgtcatgttccttgaggacacatgaattccacttatcattcagctgaacaacaaaactccatccaccttcaacaacctgcagaaacaggcaaacacattgttacaatcaagttcatgtctaagggcatcacattgacctagagatattgctaactgggctggcatccttttttttataatggaaataataatattggtttcacagccatgcaaagcctctgaatgcctattaatgatggacggatagtagggaggtggttatatatccaaaagaaaaatgtttaattatatcgtgttcaaaaagcaacttaagcatgccaattttacttatggattgcatatcataaaccactataaacaaaaggaatttaataattttctatcatccaactttggaagagatggatgaacaaaaagatccagtaagcaccttgagattgcaagcagttacgtcatatccaaaatggcccttccaagcataatcctcccactgttacaaaggaaaatccatgtattacaaatggggcaacgagaactctgaaaatgatgtggaatcctggatgatacaaacctgagaaagaatgattgtatcaagcaaacttgggctgccctgatcagtatatgcaaagcttttgagggtaccattttcatgttctgcaccgagacggtaaagatgtgtcttcacacctgaaaatccaaagagttcatgactattgcaatattaaggataaaacttaactgaacctatgctgttattctaaatttattcgacgtgcttctgagaacttattttggtgttctcattctaaactaacccttgtagaaggaaggcatttatcatgaattaaaactgcaaaacagctagcttatctgactcatgtcgtgtaacacagaattttattgcaaatgcaatattattcagcttacacaggctaatcctattgtgatattgctgtgttttcagtgtcacacttgagtagcgagcactcccagcaggtaacgttttggcagggaatagatataactcagaatataggagtaaagaacagcatggatcagatagacaattattgcttaccttcaaattgatcaagaggagatttcttgcttggcaacgaatattcacctttgaactccgtggttgataccatacttacaatgcttaatatctgtactactactaaaaaaatatctacaatgctaaagcctaattcagacttgaacagcaccaccaccggcaaggtaggtcaaatcagaaggatgcccccctgcagatgggagggcaccgcgaccaccgtggaaagaaggggacgcaagaagaaacttaggaaagcgatgggcacattgtgttccccttcttagtgcaacacgggatcctttctttggagccgtggttgctcttttcaagccagccctaccggaccagctaaccacctgagcaagaccaacttggttattctttaggagcctccaacaagttcttggattatgatggagcctttatgcagcctcacagggcaatctggcacatgatagaagtcagaatcaaatcgagcacttaaaaggagtagtcaatctgaaaatgagttttgagcattaaaagaaaaacaatccatgagtggatctatggttgcatgaagaattcgcataaatatactatattcatatgccaaaacactgtagagatactccaaacagatcagtctcctaatacacctggacacttgtaagcaaagaggggaatacataaatttgtctcaagtaaaggtagtgacttctgaaatcaccgtgtatattggattatattcacatatctttatgcaacataatatctaacgctgaagaattcttattactgtccaaaaaggtagacacctatgcacattcttcaaaacaatcgaggaaaatatagcaattagagtatgtataacacaaaggtagattttttttccttcttttgcatgtattgccgcatcaggtgtgtaaaaccagaagcctttgaacacacactatcatcagaattctaacccaataaaattgggacgtgacaaccgtagaagctaccagattgctccacaccacggtgcaaaacccaatctttccccccacaaatccagattggaccaatcaataccaaaattttcccacatccgccaccaatctcgcccaatccaaacaccaccaaaccaagaatcggcggtaaaggtaaaaaaaaaaaacatgcatgaacaggaacccaagaaattgcatcggatcaagaagaagggttggggtaaagaattggtaccaagaatgaatcggcggcggcagagtgcgcgcggtcgtcgtctgacccaagggcaggaaggggggaggaggaggaggaggaggagatggggaagtggacgtgtggacggctggtcgaggagggagagagagaccgtgaaacgtgcggacgcctccctctcggccgctctcttctcctcttcttcggccttatctacagtgctccccagcggtgaaaatcttaagccttgttaaatcacgagtaaatttcacttttaccatattttattactttttttttgtttggactaccctttaacaaatattttcattttgaattgaataaatttaccctggtagcactttagaccatccttaactcatctatccatctacatcaatttgtcatatgtcgaaacgttctaaaagaatatttctttgaaaaacattccataaagatagtttttggctgcttgaaaccgtggcaacccaatggccttcagaacccaattaggcaacaaaatcgtcatatagggatgcatcggaatggtaaaaaagacacatagcccttccaaatcagtagatgattgtggatcttgtcgataagttgttgaaagaatctttttgatgaaaagagggatacccagatacttgcacgggaactcggccataataaaggggaagacatcatgtattgctagcaggtcgctccccatgcagtagatcggcgtaatttcaatcacttgtcaaagttagtgaagagttctgatgtaactctaaaacaaacaagaatatcttaatgcctttcatgtgtcaagggagaaagaaagagcattaggtcatctgcatatagagaatctcgatgtgagatggcatatacgttcagtggttgtaggatatcgaagtctcccgtgcttcacaaagggagagactttttgataaaaaaaaatgcaatccattgagttggatttagaggagcatagttagccataaattaactataagcccatacgagaaagagagaaacaaaaatatgaagcgttaactctaaagcaagagctaactatatacatactcgaagacatatattaaaatcatagtaatagaaagagagaggagggaaaaattagagtaattttatagctaatctattcagtgccttgctctaacctgagcaacatgtgatacttgtgctaatcataccccagacagggagacattaactagttctagctgcctgaaacggaggtaaactggtacttggcttcttgattctacatgggcttcacggttttgttcactttttaattaaaaaatagttgtttatttattacacttttgtattgatccgtgcagaaaatgcctgtaactagaaatgttttgtgggatatttaccataaatgacagttatttccctttttttcttttattattttcatggtcagttgagagactttgtaatatcacactttacacttgcatttgcacagttttatttcagaataccaggagacgcaaggatcaactgaatacacagatttcattaattagccacctgatattacaactcctacctactgccttccattccacaaagaatctttacaaagccatctaaaaaagatcactgacaaaaccatctataactatagcaagctgcactttgttgcatgcagacaagtaaactactcacagtgaaacctgaaactacaaccaatacaaatagaccctataagcctgtactactgtactcacaacaccactaactgaacactgatacaatcatataaatcaacagatgcggttggtaaccctatcaatggaacaatggtagctagctagtttactatgctttgcctttgtgtgttaagatcttaatctttcttccctgtgagacaatgcaaaaaaaatttgcctacggcaatcaggtaactgaagtattgaaaaatctcagtcataattctatccatgtcaagccttttcatgaatagtgttaaggtttttcctgatcctactaaatactttctcctttcaatgctttctgaaccagattcaaaatctctgtaacctgaaagcaatatgaaaggaaaaacgtctttatattgaatcttgacagaaaagaaaagcatattcaggacatcaacaaaaaagtgctaaatcgttgtcaggagatttatggattaattgtcttaccccaggataatgcttcaatacaggagaataatgatcaagtgctatgtagatcttcccaagaatactaagaagagcatcaacttcatccccaagtatatcaacctgggtcacaatggtaaaaaggttgaatgaatgaatgctattgtcacatgaataaaactttattttgtaaaataaatattattgtgctttagtctctatatacttcgcttattattttcgataaaattcaagcatcatgtgatcactacttcgtgcctagaagatgaaaatcaactatagttttcaaggaaaaaatgtttcttagaagtttaaaagtgaaatgaacagaaaatagaaagagcataaagagaaggttaaacctcagcttctgctttctggagattagagcatttaatctcgagtatctgtttataccagaattcttttttctttaatacagcaacttgctgcaccagtgggttaaactggcaaattatattagtcaacctgcatgggaataaaaaacaaagaactcaataattggcaagttatactagtcaacctgcatgggaataatatatgccaaaatatgaagtggacaatttaacttagctagcattcactaacatgcagaatattacaatacattaagtgatgagttcaaatagtcagacaagtgagcctaacttatctagtattgctctaagtaaacaaaaacgaccataacaaatattcaaggatattaattaatttacatacctaatttcatttctcttcatactttgagccaatctgctttcaaaatcgctgtatgatttagataacttctccatactaacaagggcatattctaggtgccctgcttgtcccttatgactgttaatgcttggcgccgatgttttcttcatttcctggatggtggcatcaagtgaggcattctgttctttggcttcctccaaagcaatagacatggcagttaagttgtcagtcagaccatgtatctcttgcttgcatacattaatttgctgcaaagcctcatacaagctactcttcattgaattagactcactcttggactctaagatcaacaactcttgctcgcacaccttctccctaaaattggtaaggtcattaaccaagttgacttgctcatggtgctgcattaatgttgatcctgcaattgctacaagttgattgttttcatactttagcttctgtctgtcttcatacataatactcaactgctcttctttttctataagcaactctctgaggaaggtctcctcctgattagcatcatcaatatgattctcataattatcaaaaacttctcttaatgtcgacagctccaataaatctttaatgtggctctcaatctttaaatcttcaagttcatggctaagcttctcaacttgtttcacaagttttaactcggacaacgagtgctgtgccattttcctctctgcatctaatacttgtaaagacagatgtttagccaccatttttttgtcagctagcaaaccttgtagttgttcattttcatgaagtaaagagccgattctgtcctcaaatccgcaaacctcggcatcatcataattatcacaataagggttatcttctctca

SEQ ID NO: 39610 - DNA, 754 bp, Oryza sativa
tgggctcttcctttcggttcttgtgcttatcatcagttcatctatttctgtttgtaaccgtcagttcatcttctgaagatcaacggtcacaccgcaaacttggttactctacaattcaatgtgaatacaagtgttttttctcatggattttgttggacaacatacaattcttaactctgactgggacgagtgtttctctgtcagatttgcatacttcatgtctttatttctttgttacaatttttctgagttttctagagattttgttcttcgtttctgctctctgggctcacagcaaggagaaacacaagaaaagagacggtgtgtcttttcttccttgagggcatgagttttgcccttttttcttgaaattactctagaaagagaaaagtaggttcattgtgtagaatttttcaacaaagtactacattatctcaatctctttttatcgatcgattattttctctcaggtttatacttttataccaagagtacttttacggtgatctctacatgatattctgaagatatagctgaagagtcctagaagaaaaaccctgaattacagtaatgacttgctttcctgcgttctggagaaacaaaaaatccaggagtcaaattgtgcagcatgacaaaggtaaaccctcacatttcatcaaattttcttcttctgaaacatccagatgccttcttctgattgatcttgttctttcccagatacaccgatcatcagaaatgtgaagatctactcctc

SEQ ID NO: 39611 - DNA, 12625 bp, Oryza sativa
actcaagaaatacttatattttgggatgaaagagtacacaaattccatatgatttgtacatagagatggattcagacggagacaaggacaaccaaaaaaatcacagggggcaacacagcccacagcactaataattaagcaagcaaggtggcgtgtggacggcggaataattttggacgctgcaaaaagccctcccctttgaaccacaatcatatcccaacacgccacaaaaacacaagtggccaaagaagatacaattttgtacacaaactactacaaagactcatgtcgaccgtgtagagcttctctggaccaccaccggttgcggactcggcgaaaattatcatctcacaaacacacagaaaatgattgactttgcactataaaattcccagctaggactctagctaggaggcttaaatcacaagtgataagctctggctgctgtgcagaggaattttgtaatgagttggttcgcttgtttctgaagccagaccggattaccaggatgttagtctcctccaaatggcaaggatctgaaaagcagaaggaagtgaatagcgcggttaaatgttgcaaatgtgagcacagatttacctggtacaggaaagcattgagattgcataacacagttctgacaaacaatggtacattgcctggaaattttggataactatttagaaatacctgtagaaaagagtaatggagttgtatgtaaaaccatgcttgataataggatgactgctgtacagcacatcctatatattttggtcctatgatcagtatacacaagggtagtttaggtgcaggttcatgcgaactttgccaatgaatcattgtcactgctactatactgtcctcaaattttcatcgtgattatctggatagtgtcataattatcatcttgcaaataaacttgtggtgcatacaattctatcgaagatattcagcaacaatagtgaaaatcaacaaataacttatggggcgaattattgtctaacagaagtttaggggctatttctaggtattgatcatgaaaatgtctaacacaagtatgtttaatatcattactgcaaggacaagcaaggcattgaattcatattcagctcattacctaaattatgactcaagactcaagagcaaatgatcagatagaggctcagtcattcaattctccttctacatcatttgccttttcttgaacaaagtagagaacctaccccccacgtaattacagaacaacaaggacattagcctttttcccaggcgagttgggataagcttatttcccaacttaattatcgaacatatttcaaatgccaagtttgcagacataacatatacctgaattatatcatcctaatatgcaagtcacaccagagctaaaaagaattttatccaaatatcattgaacatccaagattttacacatgaactgaggtggcataatactattgcattgcaactaagtcagatttttttttatgcatgagtatgtgtatcatttcattaagaaggaagaaatgacaggggagtggctaaagcgccttccacccccaaacaacaacagcagattgctacacaaacacaactcacttgaactgaccttacccaactggagtaagcgactttctaaggaactcgccgagcttagaggcctcggccagaaatggcatcattcttacccaaaaaactgtgggaacaaaattggcatccaacattgtcttgaatccatgtattactgatcatctgcgatatcctgtcacaaaacgtttgatgtctgcaaagtctaaaactgcttcaacatcacgaaaagaagaatcccacttagtctgtatgaaatcgacaagaaactctgactgtttgttgccgtttgtctgcatcatagacaagagatctttgtcatgttacatcttttggagcaacatgtcaaaaactgaacatcaatgcaagtccttcaggacttgcaaagcaaccaaagcaaaaggaacaaggtacatctgtcccatggaaggaatgttagtcaaggctcgctggggtcactcaggtgggatagacaagaatcttaatagatgtaggatcaatccttttactgtttcatgtcatgtgagatcataatgaacaccactctctctaagaaaatgtaccagacacttgtactgagtaaccaattgcgagtcataagaaacaaatttttcccttcagcttaagatgaaagcatcttggtagaaaattaaagtttcaagtaaccgaaacatcttgaatttatctagtgatatttgcagcggtaaggtacaatacccagcagtaaacaaacatatatacataagcaataaaagactaacaacacaaaatctaagacatgccatcaatagatattttacctcaaaaacaaagaaaccaccaggcttaagtactgatgacaatccttcacaaagatgaagcagatgctcaagtccatctttgcctccatcaagtgccagctttggttcatgccacccaacttcaggttgcaggccaggtagatcttcagttggtatatatggagggttactaatcacacccatgagctttcccttcagatcttctagaggctcaaaccatgagccatgccttatctcaactttatcctaattataaacatggacaaactcaagatcaccaatgagtgtctttgcatttaaaaattgaaaactatcaactcaattatttttaaaagaaaactttgtctgtttcaattgcaaagctcctcacctgcatcccgtatctctgaacgttgagccgagctacgtcaatggcgacctcgctgacatcagtggcgaacaccctcccctccgggccgagcatcctcgccacggccacggcgatggcgccgctgcccgtcccgaggtcggcccaccacccggcctcgaacccttgcaccttcgcgaccatgtccaccaccgcctccgtctcggggcgcgggatgagcacgccttcccggacggcgaccaccaggtccctccagtgctcgttcccgacgacgtactggaacgggcggcggtcccggacgtggcggagccagagggactcgaggtcgccgagcggcgcgcggaggagcgccgggtcggcgcccgcgtcgcgggcggcggcgtcggcgaggagccagcggaggtggcggtggaggtgcggcgcggagtccggcacgagctccgccgcgcggcgccggaacgcggcgagggaggccgccgcgaccgggtgcgccgccgggcggaggaagagcggcgtggtgtccgcctccgcctccacccccgcgccgccgctccgggggctcggcggcgtcgacgcggaggacgaggcggtggcgaggcgcttgagaaggcggggcgtcggcttgggcttgagccgccccgggagcaacgcggcgacgccaacggcggcggcggcggaggcgagcatggcggcggccagtgaggagtggccgccatgtgcaatatagatgggcctcaatttggaacgaaatgggccggcccaatgcagtacagataggcctccatttgaagcaaaatgggccggggccaactgcaaagtgagtacttcagcaaagagcataaattttaatacctatatagaagatcgattttgctatatctcactcgaaagattttttcttatctctcactcgattttctcactcaaatttacagtgcattttcttgtaagttacagtgtaattaatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactcccatagaagatatagatttgcgtatgaagaatagggaggctagtaggaatcggacgccggatttttgggtgaaaaatcggactcccacgtcagcatgacgtcatcaagcatgcacgtatgcaaaaccattttaaactatttcatatcttaaattatttatccaaatcatgatccgattacaccattaaattcgttgcaattaaatcttaaaaacaagaccacgcatggatatattccgatagaaaacaaatcagcttattattgaattatttttaaatgttgcacgctgttccaccgagtatatcgaaattgtttcactaggtagataaaaaatgtttcaatcgtttaaattaggcgttatttcaccttatataaaagtaatgtttcagtaaatagcgaaaaaatgtttcaagtcactgcaacatttgatccatacaaagtttgatccatacaaagtgaaacattaaaagtatactaggagaaacattttggtggaacaaaaaatgaaacgaattcccttaaaaaagggtttccataatatgtgggtgatttattgcaaaagattgtttcaattcactgtaacattaaatttatacatagtaaaacattgtgaatacactaggtgaaatatttttaatggaagaaaaaatgaaatggattagggtttacaaaatatgtgggtgatttgttttaacggaatatgtggtgcggacacgtgacagcacgaaggcgcgcgtgggagagacgtggacgatacagtatgcggcgtggtggcccctggaggcagcaacccggcggctggcattctccgtccgatttttacctcgggcccgacgtccgacagaaagcattcccgaacaattattgtgtaattacccaaaaagagtaataactagactagtactccctccgttttttaatagaagacgccgttgactttttctcacatgtttaaccattcgtcttattcaaaaaatttacgtaattataatttattttgttatgagttattttatcactcatattactttaagtgtgatttatatcttatacatttgcataaaatttttgaataagacgaatggtcaaacatgtgaaaaaaagtcaatggcgtcatctattaaaaaacggaggtagtataaattaaaatgatcgaagcttaataatttatctagctataggtagtagtaagcttggatttagcgtagaaggtttcggccaggttcttgatgactaaaactgcgaacaaaagttcaggaccagcttctccaatagctccaacggcgccggcgtagacggcgagcccaccgacggcgaagccaccgacggcggcggccgccgcgatgacacggtcgatccgacggctagtctcgtcccacacgaagtatcccgttccgatcacccgcgtcctgaactccctcgccgacgagcgcgacgcctcggcccaggccatggagaggagcgtgcacgacgcgacgacgaacacgctatggatcagcagctcgtggatcaggccgggatccaccagcagcttcgacggcggcgtgacgtagtagacgaggccgcccaccgggtaggcggcgccgccgccggcgtccttccacctgccgagcaggttgacgacgaaaccgccgccgccgccgccgctgctgtggaggtggagctggtgcgagacgtacgacgcagaacgccgagacggcggaggcgtgcagcatgatgggcatcgcggaggtgtagagcagcttgattgggacgaactcgtcggtgccgcggcgcggtctggagcggtacagccgccggaggtgggtctcgtcgaggcgcacggcgaggacgaacataacgcaggtggtcatgtagttggagaggttggggaggtccaggcggagcagcgtgaagaggagcgccccggccttgtgccgccacgacggcggcgcggcggccacgcggtgggtgacggcgaacacgggcccctcgaactccgggccggcgccggcgaggcggagcttcacggggctgaacaggtgcgacaccgcgcgctcgcaggcgttggtggcgatgagcaaggaggcggcggagacgccctccacgccgtagcccgtctcgtggaggaggtcggccagcacgacgaccacgccgccggcgaagagctggagcacgacgagcgccgcgttgcccgctccgccgctcccgcacatcccaagcgccgccgcgatcccgatcaccaaccgcgacgcgttcctacgagagaccgtgacgtgtgtaaagccggagagaacgtgacgtgacgtaagcgaggcatcgagctagtaactcacaggaggccacggtggttgaggagtcggagtcgaagaggagggcggcgaggaggcgcaccaccacccacgacgtgacgacgggggcgacgccgagctccatcactgtgccgcggggcgcggcgaggaggggccgcgcccagaacagcgggtcggggtcggcgtcgccggcgccggcgtagagcgggacgtggctcagcgagagcaggagcagcagcgacgccgccgccgtgttccgcacctggccgcggaacggcaccgccgcttccctcctcctctgcatccgcggccccagcacggcaagcggccggagcagccgccacagcgccgtgccgcgagcccgtgacttctcctccgccgtgcgagccatatccgccgccgcgatggctcgccggcgatctcttctgcctcgtcgttgattcggactgttcgatcgataggccgagttgatataacatgacatccgcgcatgtgcgtaggccgagttgggctgcaattgggcccaaggaggggaataagttcaatttttgaccctcaaaagtggtcgaaatctaatccgtgaccccaaactacaaaactggatatctcgaccccctaactctcgaaatcggtacaatttgactccctgggtggttttagagcgcggtttcgctgacgtggcacctacgtaacggtgttggctcggtcttctttccacgtggcgcttacgtgacattagaaataaaaaatatttgggacccatttgtcatacacacaggaaaaatgtgggagtcactgttatgtggagcccacataatcctctcctccccgtcttcctcctcccttctctcctctccacggacgatggagtctgcgccgactcgccgccggccaccgccttggccgccgtcacagacggcatcaccaacgcccctcccccgcgggttgtcgtcggcctcccccacccctccccgcggagccgttgctagcgcacccggcggcgggcgggagggcgggcgctggagctgctgcgacgacgaccccttgtctcttgctctccttccttcttcaagcggtgtggcgacgaggagcagccgcggagcatgattcctgcggcggagatggcgatgacgcggtggaggccggtcggcctcgaggtagcgcgccgtggcggcgcacggggtgaggcaggcgtggaggacacggtggaccgggtggaggaagaggtggaacgcgtgcgggggcgcaggaggaagcgaccagcatcaattatcacgacgagctgctttgggtgtccgtccacgccgacatcggctactgcttttctgactcgcgccgcctcagcctgccataactccaatccaacatccaggtacagctcttactatacaattaaattaaatctgccattagttagtaactaagcttgataatatttgataatcagcgagatgtacagaggatcttggccatctccgagatatacagcggtgacgcctgcatgacaatcatcggtgagatgaatcaactgatatagaatttctccggtatctgcgccacagctcagagaaaggcacccgcccgccgccgccggaatcatgctccgcggctgctcctcgtcgccacaccgctcctactcgtcgtttctgtttcgccggaacatctccgccgctgacccccgtcccacggccgcagctcgccaacggaagagagaggggggagaggatgatttatgtgggccccacatatcagtgggttccacccatacttttggtgaatgacaaatgagttccacgtatatttttttatttctaatgccacctaagcgccacgtcaacgccacatgaaaagaagtccgagtcaataccaccacgtaggctatcagcgaaaccgccctccaaaaccactaagcgagttaaattgcaccggtttcgagagttagggggtcgagatatccggttttgtgatttacggttacggattagatttcgatcacttttgagggtcacgaagtgaacttattccccaaggaggacgcgaccgttggatcctattcgcagcccagctcggcgaagcaaatggattatttatttatttatttatttttattattactacaataaaaatgcccgtgcgttgcaatggatgaatgctattttaattttattattgttgtacggtttagctagaatgaaattcactttggcaattcgcctagatatttgatgaactaagtctgattttcattttaagttagcagtatttttaaagagatttttatatttccaaaagtaaacgaatttaaaatccgactcaaacacggatctgtattttaaaaagcgaacgaaattaaaaaccgactcaaatacggatgacgtacgaaaataccagcaaaaacatattcaatttttataatagtagagatagagattggattgtaatgagaaacgtaaagctattcttttgttatctgaaaagtatgtctcatattttcattgctcgttggcttattaattgcagcccaattttaaaatatgaaacttaattttagagttgtttttctcattgtaatttgtttttcaacgttggctttaaattattaagaacacgacataaaattgtactcataaattattttcgattgattatctattaattgccgcctccgcctccacgccctcggcgaagcgctccaccaccttctcctcctcctcgctgctgctcatgtcttcttcttggcattcttcctcctccagctgctgatctgtgtccatggcagagatcgccggagaagagatcgctcgacttgaggcccgcggcgtcggcgtcagcgccggctgcgaggcaggaggtggtggatcgacagacatccgcgcacgtgcgtgggccggtgataggctgagttgggctgcaactgggcccaaacaagacacgattctattcgtggccgagatcagtgagcaggacgtagcactgagaaaagtctatttgggctccctcaactatgtaccacaatcagcaaaggataatggtttaagctgagagcataatgagccggttttgataggtagaaacgcttttgttttagtttaacggtggaggaatacgaatcacattcagcaaatacttccttcagctacatatgcatcaacaatggttcagcacggcataaaccaaccaaggtaactcaatgccgattgctcaaagcatacacacatcacacaattcatagcattagcatagatagatagagatacataggtcctgaaacttgttcatccacacagcagcagaaaaaaaaaaaccagggttctaaaattttaagcttcaaacatggagagaccatacacacaggtgctagcactagctaggataaagcaagcaccatgcatgtatggacgcatatgtttaatacaatacggtggtggtattcaggtctttgttcagtttgccacaatggcacaaaagcaaaagcactagctggaagctggaaaccatggatggtggatcacatgaaggtccagttgacgagcatgaaggcgaggcagtgcggcgcgtcgtcgtcgctaagaaccttccacgccaccgcctgctcatacgatgcctgccgccccatgctcgacttgcagacgcctccagggagataggtgaaaccctgaaagaagatagacagaccccaaacaggcttgatcaggaacattgctcatggtctggtagtactctgatggatgcgtcaccgattgtcgcgaggcagggacacggtggttttacctgctgcatgatcttggggaactccgagcacagcgccttccggccctcgtcatccaggatcatctcgagcgagatgtcctggaggttgaccagcgtcgtctcaaggatgtcgaggccggcattgttggcgaaggtgaacataggagcaggctgccagtagataaccaaactgaccattagcaaggtttccagaacatgcatgtgatgaaatgagcataaaattagtgggcagcactactaaccttcagagaacagcacagtattgcgtcgctgtgcttccacaggagcgccaggggagaatcggcatcttcggtatcagaccaacggatatctgctccggtgtgagccctgaaagatccacggaaataactagtgcattaacatcattgatcacaacttcagatgtggcaatgtgtaggtggttctgatgatgaagaacctgagatagacttttgctaaaaataagtattttacttacctatagctcctaccaatccagctagcaagtgtaagcgcctcaggagaggctggagggtgcttcattccgatctggggtccaagtcgagaaggagctattgccacagccaccctctgcacggatgccatcacagctctgacataactcctagccattgccgccacgctctcacgaaggtggttctcgtatgagaattggaaagcaatggtcaggactgatctgttacatgtgccagatgcttcaactgaagcacgcgaagctccacctggtccaacctcaagggcggatgcaaggtcgagcgtgcgtgttgcagatggcccatcctgcaggtttgagtgcataacggttaattggtgagccaacatgggaaagacaaggcctctggaataagattatggaccagtcataccatttttgtatctagtggtatcacacggaatcctgagggtaaaagtggtgcatcatcagcaaaagattcgtcaataggagcaaagacaagctgtgcagatgcactagtagcattctcatcaaccccgctgcaaagctgcatagaaagcaatctctcagaaccaggaaaatgcaacaaacaggtacaacttaaggcaattgtcatgagcaaggattatgtggagaagaatcgggatgaatggggatagattggattatagtagatgaaataacaaggaatacggtcctgaacctaaacggcgcgacgctctccgtcgcactgagaaggcaggccgatgggcactaagataaatcttgatctaatgcctaattgacctgagataggatccctccttatatagatggaggactccttaatctaatcctaacaaaccttatctaatcctaacaaaccctaatcctatccaatggacctaggacgcccggcccaaagcccatgacattactcccccctttttgagcagctcgtcctcgagctgcagcacaccctgctagacttaacgaagcaccataacctaaactaagactcttaaaccttttacatctcagcttttattatgaacaaaaataaaaaataattcatgcgcaggaggacctgatccaccagaaaccctgagcagaaggttaggcccatacggtggccaagaacagcagcatgcctcccaccgaagcccacttgtccagcccaacagcaaaggaataaatagttgactcggatggtccacaatacctgtagaaggtacatatcccgtgatagaagcacctcatcatggctgaaaccatgtccttcgagcctaataacctccaagaactgcaattcagaatgccaggttgatgcattaatatttgccattcattgtggaaaaggagctacaagcctacaaggactcaattacaacattacctcttcatgctctaaggtatgagcgaggggtagtataacctgactgcccataaacccgctggtccttaagcctggaactgcatatgggctggctcgcaaagaagcagcagaataagcatcaacaccaggatcagcccattcagaacgatgctccctcagaaatcgcacaagtagagcaggaggtacattctacattataaaaaaaatgacattttgtaaagcttaattctttgatttggaacaattttggtcaaagtgaaacaaagatagagacaatctataattagctgagcaactaaatagagcctatgtcaacctgaagtagcattgatgcctttgcgcacaagatgccacctccaacagtagaaaacagagggttcgggctgacatgggatccaacaagcttgtttggagacgagtttactgaaattgtaatgtcctcactaccatcactgctcaacaaagaccacccatcatctggaaatccactaacagcatcattgaaacctctgcaaattagagtatggagttcagatgcgtgagcaatgagacatgcatggaactgtgtcatatgacagtatgccaattggttctaatacatgggaaccctcaaatagctacagacctgctgagcctttgactgaaggtcctgaaaacagcaggctggcgaccagcaccgtaggggatttcaccgcttgactcatgcgcaatttgcctaatgtgtcgcaatgcctgaacagaatgaaccatgtcattggtgat

SEQ ID NO: 39612 - DNA, 2496 bp, Oryza sativa
actcccatcttcaagtccacttgtgtagcggagagtccaaaagtcgcgtggtgccgccaaagttgtcggtgcatatgtctaaggaattgaaaagggcaatggttattaccaaaaacaaagagtagctagtgatgcttgagaaaaatgcaacacatgagtcacgattgggtatatttacctgcatgtagattagctcaatggttccgccgttacccgtagggataacatggatgatatctacgcatcggcaatcacggtaccaagaggggcgatccttgaggatctctgcaacctaaaatgaagcttatcagggtctgtagcatgccagttaatgggaaatgtaacacaatatcaaggaaaacaaatcatacctttgtgggctcaaggctcaccaggccgcaagctcgtgctgctacgccactgcaattgtgcgaaacagcgatgattccaatggaatccggaccaggctgtaatcaaattttcatttcagttgatttgaacaaaaaaaacatgaatggaaagagaaaatcaacatactgcacagttttcttgtacaacgaatacattaccttcatcccaaccatttgcacccattcgacagcagttcctgtcgccttcgacatgaactctgccaaggtctcctcagcaatagcgagaagactgcgcaaataaaatcatctcagcaatctttcatacaaaaaagcacggcctaacaaaagaagaaaatagaccaggttttgtggataccctgctgggttgttcgcatccctttgcggatgcagaactgctgggttttgctgttgatggtgctgaccacttgtcaccacagactcacagcttgtatctgtggtggctgcagaaggctacaaagtacatacaaacattactgattaagaaaacaggatgatcaaaatatgaagcaattgtaagaacaaaagcctgtaagcacagggagctcacattgtgcagttgagtccgcatgtagccgttctcgtagacgagacgggacacctgcttctgcagccggtcattttcctccatcaacagcttgttcatcgcattcagcttccggttcacagtttgcagccgggaggcctccttgcgctgcttctcccggcatctgccaattacaaggaaggcacaatttcagtggcaaaagtacatgaataaactatctaaaggatggtgtcttctaatacacaagattccaatacttgttaatggatactgattggcacagcccaaatgagcacaaaggaagttaggcaaaggcattttagcaaatattccccaaggttaaaagggggatcattgaacaggaacaagcaaaaggtcatttgcaaaagagacaaatgactatatactatgcaataacagttagtattccatatgtgaaaatcattgcctaattgacagtgatgtttctgtctgcatctgtgaactcaactctaaacaagagcatcctctacctaaaaaggattcttgatttatatttggccttcatgagtacagtaatagtatataccaaacttgctcaaaatgttgcccttcacattcttccacagtgacaccaccagtgacaaaactattgccctacttgtgatccactgaaaaaagaaagcgagatgataaccaggaggtgatgcttatggaggcctatagcaagaaaacatgaacactaccacagcccacaacacagggttaaaaagatggcccttaaaatggcaagcacaggaaacaagaaatgacctaaggcaattttgctccaaccaatcattggtcaccacaagcaacaaaacaatcagagagcatatatttacaatttaaaccaaacaaaattaactgtaaagtctgtacagagatccaggatatttggctattcacatcaccacaaaatccaagaggaaaccaacgaatgatgctgccatttcgctccctacccaccacacaacccagcagaataatgcagcgaagaacagtgtgggcacaggaactcaaatcattgccgcaaagttttataaaagaaaatatcctgataaatttcaagcaaacagattgcgcttcattattgcacaagacgaactaaaaaaacaaaacccatcatataggatgcaaatcccagaaatgaaccttctcgtcaccaatccaacacattgcaagccctaaaatcaacacccaaaaagttacagacatctacaaatcaaacagaaaaaaaaaactcatctcaagaacccaaatcttcctcacaaaggatcccccattcccacaagaacatgaaaaaaaactgcaaacaacaaagcaatcaatctcatcacattacacaaaaccaagaaaagaaaccgaagaacacacgccatggctgctgaacaaacccgagcagaaacagatcgaagagagagaaggagatgagactgacctgcgattctgaaaccagaccttgatctgcttgggctcgatgttgctgaggatggggcactcccggatgagctgctggcg

SEQ ID NO: 39613 - DNA, 6252 bp, Oryza sativa
  unsure (1)..(6252): unsure at all n locations
ttgcaaaaagaaaaggttgtttttttagttctttttttttcttcagacttggcaaggtacagcaaatctcttttctgaaatgatagtactactttttttcagaattggctatagcaagtttgaactgactgagtaatttgcaggattttgcattaatcttgaacagatcacttctgcacttctaatgcgcatgcacactctcttttttaggtttaaaacagggatgagctgtccaaaactgaaaggttttttgggggtaagtggcagctttgaacagtgtaaagctgtctctctctcgagagagagagagattctactgtaggcgtggaggcaatgcaagattagttttttatttctctgaaatgtactgctgcttttgagaactctgtgaggttattttttttttttagttttcgattgaagcatggtttctattctttccaagtgtttgtgtgtgtggctttttctgttataaaaactattttcagtgctggatatactcctacatgaactgtctctgaaaatacagcggtgcagctggcctgccacctgctcagctcagctcctctgtactcgtgtggttgaaaagtttatcgccatttcaaactaaacttaattatcttggtttgcaaaaattccggactaataaagcttgagagataactgaaaaagagagatctacacaatcttcagtcattttctccctcagtaaatgaacaagatgtcggtggtaaaatatttgaatattagtagtaggatatatttgaatattagtagtagaatagtgtatgaaactctgtgtacactccagtgtcaccccatcgtccacgatcgattatactctggatacagtccagtgtcaccctagaggctggagaagatagtactttatccgtttcacaatataaatcattctaacatttctcacatctagattcattaacatcaatataaatgtaaaaaatattagaataacttacattgtgaaacgaagagagtaatacttattagcgtttaggataaagcaattttttaaaatttctctagaactttgacatagcgttcttagcatcttaaaaaccaatgctaaaaataaactaccatgatgaactctaaaattaagttaaattttaattttgttatggttgataagatgaagagcaaacgatgaagcaatctgtttgcagataataaataatatttaacctttttatgtctgaattatttaaaattaagccttggctgcagataataaagccaactaagacaacatttttgcacaatggctcattgaagatgaagaggcaaaccacactagctaagtcctccatgtcaaaataaatcgaacaatcttaaaataaagcaaaaggctgatatgatatatatcatatttcgtatcaggccttgtgtagtttctattttttttcccagaaacatcataacgaatctttggatacatgcataaagcattaaatatagataaaaagaaaaactaattgcacagtttgcatagaaatcacgagacgaatcttttgagcctaattagtcttataattagctataagtgctacagtaaaaacaacgtatgctaatgacggattaattaggcttaataaattcgtctcgtggtttacaggcgagttatgaaattagttttttattcatatccgaaaaccccttccgatatccggtcaaatatcggatgtgacaccaaaaaattttcttttcaccaaataaacatggactgaatttatttcgaatcggaggtagtacgaaaaatcaaatgatgcggtagcttgcatcaccgatcgctcaagctcaactttagtccatgtcactgttcctgtgcagncttgcaaatccaaacagtctctctctctctctctcactgtgcctcacctcaccagctcacctagatcttctgagttctgtctgatacaccgcaatgagtagcagcagcagcaggagtatactccaagtcgatagcatcacaagccaagctgccaaacacaagcatccaaacattacaatcagatatactcctcctactactggtacgtactagtagtagaagtaacattgcaatatcattttctttcagggtctcttgatttgtaggaaaaatatataaattttgaatgatttaggaaaagaaaatcctatgaaagcatttgaaacaaatgattgaatcatatccaatcctttaaaattcctatagaatgggtaatcctatgcacattttgaaggaaaattagcaagagatctaacctcttggaacatttcctctgagtctatctctctcatctgatttctgcgtttttcctgtgatccaatcaaacgattattcctgtgttttgcaatcctctgttttacaattgtattcctgtcagaatcctgtgttttttctattcctcttttttttattcctacgatttaaaggggcccttacaaatgaaatatgcttcgtacataaaatcagaaatttgaagtttgtccaacacattataatgtacatctgcaaatactcatcgctacggctatttcattgtcatgacatggttttccaccggtaggagcggtcgaccacaaggctaataacaaatatgtagatgatgctacacatgagccgtagcgtccgaaataagcagacgggattgtagtttacttcctataaagaaattctatcgtaaatcaatgaaccttatattttccctcctaatatcaatcaaataaggtggaaattaactcctaaaatccctggtgatcagtccaaaaaacaacgctttcaacttgtgacctttttgccaaaaaaaaacatttatcagaatgtgttgctacattctaagggtctgttggcatgcccttgttctcagccccctctcccttgttttccgcgcgcacgcttttcaaactgtaaacaatatgttttttacaaaaagtttctacacgaaagttgcttaaaaaaatctaattaatccattttaaaaaaaatagttaatacttaattaataacgcgctaatggatcgctctgtttttcgtgcgaagggaatgagttcccatccacaacatacaaacacagcctaatttgacaaactatcaagcttccattcatcgcaaaagtaaacaatgtcgaatatttgcaaaaggtttaagtctttgggatgtgaagctgttgctgctgctgccgagcagccacagaagatccggagaacagtgacagtggcagcagtgcgcgtgcgccgtacggtcgaagagagacgggctacgtggaccgggcaatcgggcattgaccgatcgtgagccgcaggatcagcgtggccgttagggatggacggttcagatccgccctggtgtggggattaattaatatgataataataactgggacgcgattcgtcctccccgacggcggatctcggccgggatctcctctgtcgctttcctcttttcttcctttccccactactccccctgttaataatacttgttatcgttctgaataacgatacgttctttaaaaaataactttaaccattattttctattataataaatatataatattaacaaatatatgattttactaaagtatttttaagactaatctatacatgtagtcacaatatttaaaagataaatattttaaaaacgattcacaatcaaagattctaaagtttaacatcactcttatctaagacgacaagtattattagttaggagggagtagtatttttttttctcaagtaggagtaatgttatagtatgtactatccaattttataacccatatataattagagatatgtactaaaccataaatcaattaaagaagaatatgtcatatgcactgcaaccgtttacaaacgttgatcaaattcaattctacgtgagttggatagttaggtcgtatgcatagtaaatttcttttttttcttttctttcttgctccatgagtagcccagtgaaagaaatcattttcatatttttaaaagtgttaggtaataagatatttaatatgaaaatgatttttcataggtacttgaatatgaatatgaaaatttttgaaaatgtcatcttttctttcttgtttcattttttttgtttcataggtagtacatgtaagagataaattgtaagaaaacaatgttaacatggtttcataaaaaaatactggtatgacactttattatttttttatcacatcatcaaaaatactttcatgtcacctaaatacaacttcattttagttctccattaaaaagaccaacataacttggctctttgtctctattctctccctgactccctctttaatccatttaagctctctttgatttataaataaggcgtatgaaatttggagtatttaatattgcaaggaaattttgtatgaaatactttgaaacagatgattgatagtactatgaatttcaaagttgaacatgaagaaataaaacaaaataaaaagtagcagcggcgaaatactggtacagtggcagtgcactgtgcagcatatgagagacagtattacagcactgtatccatgtcgtctctgcttttgcattgcactgcatctgtctgttgacgtgacattcaactgcacactccgccgtatcatttcgggtatacgagaactgttactgtgggctcatccatcctgattcgcggtttgattcgtactccctctgtaaaaaaacaaaacctgcgtttttccgtgtccaaacgtttgaacgtccgtcttatatgaaattttttataattagtattttatacgtgattaatactttatgcgtgacttgtcttttttttatatttttttttcaaataagatggacggtcaaactttagacacgaaagtctagggtttgtcttttttttttacggagggagtacgactgtactccatgtacataatgaaaagtatatatcacatgtaactataattaagaattttgttaggttttactcttagcaaaatttctactcataattaaatctaagattattaagagtgctcttaacaaatcttagaaatctaaattttttaatcctttgatagattttaagtttacaagtgtatgtcctctatactacatttcattttatatactccaccaaaccgttttagatgggattaccatcacctcacggtttgacggtaagcggttaccaaaaaaaacgtatgggtaccacgagatatgatatggttctaaaaattgaaaatattactgcacgtggtaaccgtatgataatcgtacggttttgtcaacctactatgtatatgcattgtagtgctccacctatatatagcccgtgagccctgattaatctacactcacgagtaatcaacagcatcatttttattctgcatattactattgtactatacaaaagaacttcagatcagatcgcagattaattgatggataatacgttttctcggttgaaaagtttatgttttgctcgggctcaggacttcaaccaaacacagatctcataggcttgcctggttaggcataaatcatcgaattctcaggcttgcatttttctcagacattactcagggcgccaatcaaacatgtcgtaggatataatggtagttaatattcgttctttttgctaatgaatgtttggatttgttgtgccatacatgcgtatgattttctcaatagtctatagaattgtattaattaactttatattctactccctctatcttttttttaagatgttcaactaaccagcgtcaaaaaaacaacaacatggagtataatatttagtaaattcatgtattaatttatcagctgataagtataatcaaacgggacctcatgtagcaaggtcccgtttgatatagctgacattgatggataatctgattttgtgttagctagtaatattaatctggggatatgcacaaatgagtaggaaagttgctttagaaaaaacattcggagaaaaattagcatagaaatttttttgcatgaaacatgtggcttatgcacccaatttagttctcctttagttctcctatatgaagtgtccctagctctccatgtaggagccgatccccttttcgagtcgggaccatggccttacgagggagcgcatcgctctatggggtccccttgtgcctcggctccacacattgggcgagccatgcctctaccttgtggtagtccatgtacaggaaggaatatcacagggagcatcaatattcagttattgctcctctccatgaactgaagtca

SEQ ID NO: 39614 - DNA, 7545 bp, Oryza sativa
  unsure (1)..(7545): unsure at all n locations
ttctgttaaaaaaagtttatttttcacccatacatcctatacataacagtaaaaaatcataatacttccactttatcaatcataatacaattaatcctcgttttatttacttccattgcattcatcatctacttttttaaatctgatattaataattatttaaaaatagatttactttaaaataaacggacgaagttaaaacttaacttagagcttgtttgggggagtttccaacaaccgaagattcttctaaaacctaccgttgccagaaactcccccaaacagtccagattttcacacagtttttaagaaactcctccaaacagcccagattttcacagcggttttaagaggttgtttctcaaaaaaaattaagctttccaaacagcatcttattttaaaattgaggaaatactcctatatactgtacggtactcgagagatgctccatgtcagtactgtacagtacttactgtacagtacttgtttaggccgtgtttagtttcaaagtttttcttcgaacttttaacttttctatcacatcaaaacttttttacacatataaacttccaacttttccgtcatatcgttccaatttcaactaaacttttaattttggcgtgaactaaacacagccttagttcacaccgaaattagaagtttggttgaaattggaacgatgtgacgaaaaagttgaaagtttatgtgtgtatgaaaattttgatgtgacggaaaaattggaagtttgaagaaaaattttagaactaaacactgcgtaactactactacttacatgcaaggcaaggcaaaggcagcagagttaagcctgcacagtaacgtactcacaagtagcaacagatatgttgaccaccacccatagccatagccatagctaagctgcatgcgcgcgtgagccaatctgtttcaggctggagacacgacgacgacgacgacgaagagctcgatcactgccatagccatggctggctcatgcagctactactccgatgcagacgtatagataggttggagtagataggatagcatgatagcagtgagccatggctgctctgatctgaatcttctgttgttcgcagctgcttttgtgcctgcgtcgttgtaacttccatcccttttgcccccccttctgctgctgtctgaattctgatcgatgccatcaatatatgcttctgtctcgtgatcgattcatccttgtgtacacattgaatggctggcctgatcgaggacgatcgacgcattcatatgcatagcccgctgctgcagggccattccagtatgctatactcatcggtcaattgctggtatagcatgcagctgcatatacactgctcgacagattaagtcctgtttggatcattgaagggtgtgtttagttcacgccaaaattaaaagtttgattaaaattgaaacaatgtgacggaaaaattagaagtttgtgtgtgtaggaaagttttgatgtgatgaaaaagttagaagtttgaagaaaaaatttggaactaaactcggccgaattatactactccccttatattaaaatagtacccctccattctaaactatagtaatatgaaaggtattagtaagacataagctagtacaataaattaatttaaaattctgaacaaaagttgcaataggttaccagtatattctaggacagaggaaagtacatgaaactggtaactctattcggttgaacttttgaaactttaacatcagtatatctaaatcagaagtcataagtacttgtaaaatattatagaatattagtacttaaatagaccaaatagttttgttatatattatcgttatatgcgaataggaaaatagtgatcgaagttgcacaccatagaccaaatgaagtgagcagcattattatatatttaaatacggagatagtaatacaaagtactgtaatttttttgggtaatgttacgaggtactcctatacgacatgcataaaaagtgtgacaaagttttttgctgcattagaagcctgtcaggacggggctagctgtttggatgtagagctagcaagcaataatccctgcatgttggtctcattacatcataattaggctatgcttaagcgtgcagtagcaatgcacggcctgtgccctagcacttaattgatcttttccgtagcttaatttttacagtgctgctcctgcttagctgaacatgcatcaacagacagaaagacagacagatctcactctacacatctctagacaacatcaacctaaatttcactccatgcttggtaatctaattaactgttggtctctctccactatgatactgacagtaaccagtgattagcagtaagtaagggcgtgttttgttctttgccaaactcaaccataccaaaattttgtcaatagcaaaggtttagccactgccaaaaaattgataaggttgatcatttgatttctaatttcttgccaaaatttttgaaatgtgtgtgctttacttggttttggttgctaaatttttggcaaagcctgttttggcaacaaagcaaatggaaccatcattcattgtcattacctttttttttttgacatggttgaattggacaatgaaccagaatccaaattctaaaattgaattttccatttgctcttcagcttatccgccacagccaaaatttaaatttcaaaacttaattttagatttgattctgatgtttcttgctcaacgtagtttatttatattactgcctttttaagtcgctaatagttgtttcggtttataatcggctataggcaagtttggggagtttctagcagatgcggtttcttccagaatcaaaagctgcctaaaatagttcggttttttattcatattccgagaagctagacttacataatttcaaaaaataaactacaagtcaggagttatgctttcttcttcagatttctaaagccggctacctatcacccgcttcttaaaatcgtaaagttcaccaaacagaatccatggtagcctgaagaatgaaaagagagtgaagagaggatgatgatgctacaggcaatgcttggataattggactccctttggcattttatagcattagcgttgggaggagtggtgaggtagcaccaccatgtgtcgtgctcgctgctgatgctgataccagggttcgccataccgccgttatccgcgcggttactgcggttaccgggcttatcgcagggatacggtaatgtaaataccgcggtaacctccttaaatttaaataaatttaaaaaataatttaaatttttgatgaattttgcacggttttgtacggtttttcacagttaccgcggttaccacgcggtaaccgtgcttaccgcaggggcgcggtaaccccggctccggcggtttgggaaactctagctgatactgctgctagcttaagctagtagtactagctgtagctggaatcgatcagtagcagcaagcagcatgtagtagaggcgcatcgagaggcgagagggtccagatgcagatgagatgaggttttggagcagaggtgtgtgcgtcgggcgggcgggggtcaggctttgctacagcctcaggcgacaggtcgcagcgcacgccgcatctcccccctccacgtcccatccatcgcccaccatccacttcttcttcctctcatcagtttttgtttccactttgcatatttctgcagctcggatcttgcaaaagagattcataccacgggtatgtttagttcacggtaaaattgaaaatttgattgaaattgaaacgatgtgacggaaaagttagaagtttgtgtgtgtaggaaagttttgatgtgatgaaaaagttgggagtttgaagaaaaagtttggaactaaactcggcccatttcttgtagtactacctaataatctactctcagcagaagtatagagtagtagttactaccttgttaagataattcattctcatcagaagtttcagcaggattttttactgcaagttcagtttcagcagaaaattttagttcagtttcataagggcaacaccaatgtatcttgtttaactaggtaataagtagcagggctaagtagtaggtctttggaaagtgggtcccatgaggaaaaaaatactgctttttagttgctttttgtccaactcagcatgcagtagtagcacatcttgtgttggaaggagagagtgagagagattttaatgtttttttattcttatgagtgggtcataagcttactacctagcattagttactacccacttccacaatgcttattactagatcatagaaatattatattgcttaatacctgctttttcctaacattgtggatgccctaagaagatttcagctcagtatcagcagaaatttgtaactcagtttcagaacacattttagttcagttaaggtttcaacacaagtttctagttcagtttcactacaaattcttagttcagtttcagtacaaatttttagtacaattttagcagaaatttttagttcagtctcagaaaaaagtttagttcagcttcaacagaaaatttttggttcagtttcagagcaaatttcgggaaataaatcctgcatttgaaacggtgcctttgctgcatatgatcttgttgttgatggtgtcagcgagaggggctgtgaatgcccgtatggatggattatccagagttcagagagagagagagagagagagagagatagtgtttgctggtggtatgcgacgatatggtttcagacttttgatccctttattcttgtggactgtggtgtggtgcaaatgtgcaatacttcagaatgtcagaatgggcatgctcaggaccacttggcaagaggaatatttgcatactttcttgtggggttgcctcccttcatgctcctcccagtcattttctgtttctgttttactatccattttttctttgttttactcacatcctgctcttgtttgtgcacaatttattcagttacaaacttacaatctaggtagcattcagcaacaaagcatacttcttatattgatgcgtagctttcctacgtgttcgagaaaaaaaaaacaaaccatccaaacttctcaaattgttatagcgttgagtgagatgatgttcttctggtcttcctatcaaaatccagtgtgcattgcaaatgagactagaatacataaagttgtacaaattccaagatgaaatggtgagagaaaaaaaaacaagctttttattagagcctcaagtgccaaatgggggtaattagtggggtgcttcttgggatatgatagtttttaatccacacattgcagttgtcagtggagcacccagcctactgccctggtgttaggggcaaggcaatggcatgcatgatacatgagtgagtttagtgagataatgttcatcgggagagattaaataaagagattagtatacattagcaccttcctattgggctttgctggtgtgccttgcatccaaagtgatgccactatctccacaaatgcaggctttaccccatgatcaccaaatatgcttatgggaaaaggaattaaaggagaagattttggccagttgaatgagtttaattgcactgtttattctttcagtgttggaatgaaatgtgaggtcaaaattgttctggtgatgtattcagtagtagaagatttttactctgaaattgaccgttgtcctgaagataaatgactgtgaacagtaaattttttacacttctgtaataactgttgctgacttgctgtacctgtacatcattaacctgtctaaaattttttcaaatctttacacaagcagaacaattgatgctccgtggccgtaaaattgtctctcttgtctgattcctgcaatctttggacattcaatccagatctgaaattcttgctgtttctacacaaacaaggagtatactattatgcagttgccagtggatttcaccatcttaaaattgtttgcatttacatcagcacaatagacagaaacatttctatgctgtactacaaagatgacaagatctagcattgcatcaagaagtatctaggaagaacagaaaacaggaaactgttcttagatcttctcctcatcaggtttcctcactgaagaaacttgcaatgctcatctctgcaaaaggttgatgcatatgcattgaaacagctctccaaaatgctacaagcattatctatattgaccaaagatctgttctttgcatctgtacctcacagaagagattgcttggaacataaaaagagctaagggtgaaataatttccatggaaagtgtcatgctcttgttgcttcagaatggcaggcaagggtggtaaaagctgatgggtgcaagatcctgcatttaagcacctgggtgcagttaatggcattactcatgagattgtgtagatggatgtgaggcagttcaagtgcctctgctgggtttgaaatggcatggcaagcttctggctgacagagtgacagagtgcattcaattggttgtcattgctgcatatactcctctctctacatgcagggtactaggggttgaaaatgtgcaattttttatagactttgagatgatgctaacaaaacagtaacacctgatgttttttggggttttaggatagattcatgatcaaagagttgcaggctattcattgacttgagtttcaactggttaaccaccaattggcatgtgtagtcccattcagagatatcactgtctttttattatttttgagaactcattgagttgcttttgggtggtcagctttttcttagagggtaacaaaaaggagggactactggctggctgagtgagtggcatgaaaataagagaaaaaaaagaaaggcaaagcatgcactcctgcaccttgctactacattacaaacatagcctttcaaatccagagcaaaagcagtttgtcaagatcatgcagtcagccaaatggacatcacatttcttcagtgtttgttgatcacacacagatctaagctagtgatggagtactatcaacagccttaacccctaaaaaccctagcaggacccctactttgtcctgaaagccactttcttggcatgaagagagtgaggcaccaaccttcactttccaataaatttctttctcctctctttcactctcatcttccatctctttttcattttttctcttccatgggtgacaagtgaggatgttggccacccatctcccttcactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39615 - DNA, 1609 bp, Oryza sativa
aagagacgcaggaaaggaaaagggggcggacgcctgctttctctttggattttatcggcacgacccccgcggccgcacgatgggaatttccgacagcttttttatttgggtagattcgtgttattataatttttgtggttttgttattataatttttgtggtttggggaaaaaaaacattcttactgtttagtactctgtactgtttttgagtggttatttcgattcatgtcattataatttcacctttattaaaaatacgctaatttttagatcatattaccctcatattcttccttcatcctctactctctttcatattcatcttctccaccgctagatctgacggagctgatgtcgttgaatggtagctctaagcagtatgtggtgggaatagggcagcgttgttttccctcgttggttgaccctgctcattgacctatttgcatgttcacacctcgaagcccacaaccctcacctgcacgaggagcttcccaactcacagtcccaaaccccaagaaggcactcacctttgagctctcccgcgatatgggttaggatgtgctcttgccgctacctaggaaggaggaaggtgaagtgggataggtgtcagagctcgcggttggacgcgacaaatgggaggatgggagaatggtgtggccagtgagggaggggatgggaagagaagagggccctcccatcgtggagcttgtcgcactactctgcaccgttttcactacatggaactcgtcggtccgagtccctgatctaccacttgttggcaccgggagaagcaagggcaatggtatgagcttgtcggcttgcgccttcatgatccactccgccatacgccatagtgcgccgaggagcttgcgggagaagggagaggtacggtagcagcagaaaggggatcgaggggagaccggccctcggtccgtgagatgatggggactcgtcatccgtgccatcgccaaggctcgcttcgttaatttcatcaggttggccgcctcaatcttgagaaatgaactagagatgaaaagtggatgaggagaatgaaaagggtaatatggtccaaaaattttagagaaatatagtaaaagggtaaagagtggcatattttgaataacaacttcaaaactgtaaaataataacatggatccaattaacccggtatggccgcggtacactagcgtgtacggtgaccccacctgtcggcctccatcgctgacgcgagttcatcgacctgggtgtgttctgcatctgcacatccacagctcggccaatctttggaaaatcataatttagggaatttgggcttttatgatgtgcaacataagtgagcccatcttattcttcagacttactgttgggccactcatcttaccttcacgtcccatactgccatctaactaaaggaataagttcacttgaagtcccttaatttgtcgccgagtcttaaatttgtccctgcaccacaatattagatagaagcatctttcaactaaaaaactactgacttcgatagttgatggatgcaacatatctgatattgcggtttatggatgattttagacttgacgatgacttagaaacctaaagtgaacttattc

SEQ ID NO: 39616 - DNA, 11278 bp, Oryza sativa
taacggacgagaacgcgccgcccaaattccgcgcctcgtcgacctcggctccggccaccgatcgatggctctgccggtgaccaccagggcggcgccggcgatgcccttcgcgccgcagccgcgcaccgccggcggcggcctcctccggcgaccgtcgccgcctgccgccgcgctgcgcatcgcgccgcccctcttctggccgtggcagaaggtcccattcgcaacaaacccctcttgatacctgcatgattacactagttaaattagtctagttcaaattctgctgcacttcttggagatttgcacggccagttcgtgtgctgtgaaagcttaactctaccgtgttgtcttcttaattaaggaggcaaactgttttggtgagcttgtagccatgtacagtagaactcaagctgcagttttttttttttcttcttcaagacagtactgctactacattcaaggctggaacagagccacagtagcttttgctcgggaggccctgcagtaggtttactgattttgtgacatgacatgagctaaatgtactacaactttgccattaaacaagaacgcaaagtaaatgaggcaccagtacaagcctcatgttctgtctgaatgtgcacaacttttactgaccgtagatttcgtgcctccttgagcacaaaccacaagaaggatccgatgaccatgctctctctcccctaccatggagctatctctagcaaagaaccaggaatgtgattagattagtagcactgacagtctgctcctttttggtaaccagctatggatcaaacgaaaattatttgttaatgtttatcactgatgctttcgttcctctttatcgaagtcgagcacggaaacccaaaagttccacgctgtgtgatttctgttggaaataacgagctagatgcatggcacaagtttgctgttgttgccatgcatgggctgtgcttattttactcaagatgactggaaagctactgacattgtgttcgtagactagaattagttgatgctatctgacaagaggaaaaatcaagagcaggatattggcccaacaagctttgtattcgcccctaaccaaattctgtcgaacaactgacacattgaaattcagactttctgaaagtttcaagtaggatcggcatgctaagccaaattgtcaaatgtgcatcttgttgtgctcatgtttcagtctgaagtatgaaccataacatgttacagtttctgaagaattagatgttatcactagtacatgaagttttcattcataattgatcagtgaaatcctttgaaggttatatttttgttgataaatataggtgaaagtcggtcccctttctgtttcgcctatgggatttggaacatgggcttgggggaaccagctactttggggatatcaagaaagcatggatactgaacttcaggagtgtttcaatttggctctgaagaatggcataaacctttttgacactgctgactcttatggaactggaaggttgaatggtcagagcgaaaggctcctcggtaaatttatccgcgagtatgaaggttagcctagctagtaattcagaataatttcttaaattatgggatagtgtttctttggggggagtttgtctagttgaaatgacttcattttccctttttgtatgacagggccgatgaagtcccctgatgatgtgatcattgcaaccaagtttgcagcatatccttggcggctaacatcaggccaatttgtcagcgcctgcaagtattcttccaatttgtttgcttaatgtacatgaaccatatttcagcttgttccgtgaaatttttactccatccaccaaccacgaatgtgctgaaaaacatagagctaactgaatattgaacatataactgatacctataggcctctagcgtttaggtgacttacatcagtgccaattttcaggtcttctttggaaagattgcagcttgatcggctcgggataggacagctgcattggtctactgctaactatgcacctctgcaggagcgtgctctttgggatggtctagttgagatgtatgaaaaggtcaccaaacttccgattgtattgtcattgttcaatgttctgaatcccaactgtatattcagctctacaaaccatatatatctcagttaggcaaatcatatctcagttaggtacacggacagattctttggatgaagatattgtcctcctttacgttcttgatttcttagaaatttgactgcaaaatggatttcttgtagggtttggttcgtgctgtcggcgtcagcaattatgggcccaagcagcttctgaagatccacagccatctatcatctagaggtgttccattgagctcagctcaggtaccttcagaatgcccatacatcttgtacagttgtactcattcagtatagctgtaactgaaattgtcatggaatgcaggttcagttctcactactgagcatgggggatgagcagatggagctgaaaactgtgtgtgattctttgggcattcgtctgattgcttatagtccacttggattaggaatgctgacaggaaagtatactacttctaaccttccaagtggaccaaggtaacgactaatgaccaaaggaagcagacaaatatttctctctgaattttatgacaattgatgacggaaattcagttcatttgttctctggtctgcaggtctgtgttgttccggcaaattcttcctgggttggaatctctgctgacttgtctgaaaagaattgcagaaaggaaggggaagaccatgtctcaagtaagtattgctttccaagagcaaaatgacctgcataacaagtgattcatgcatagatcttgccaatctggcttcaaattatcggaacatttcatcgtatgagtgataagtttatttagctcgttgcaatacctgaatgcttcagagatgcaacacatgaagaaaactgacggtgacactgtgatctgaactcaggtggccataaattggtgcatctgcaagggcacaattcctattccaggtgtcaaaacagtcaggcacgtcgaggataacttgggagcactgggctggaggcttagccctgctgaagtttcagagctcgaagctgcagcaatggagtctccgaagagaatggtccagaacatattccaaactgcatgagcacacatatatataaggatcgctccaaccatcagtaattcagtgagagagaattagaagtgtgcatttctcctaattgagaattcatcactgtaaatacatattccagccaagtgtttcagtctgaagaatatatatagactgtgacacgcacgaagtgccataatcttactgagaaagaaggttgctgcagaaacattgtccatataacatttcaccagcttattccaatacactcagtttcccagagaacaagcagcttagctgtgccattcaactatctgaaccagagcgatcagatagtactcagtttaacagcttaaaccttacttataggtagcactagtaattacataataaactatatatacaaaccagcaacacggggcagatacaacaaatcggatcgtcgctaatgcgcaccatcaatggcggggctcgtgacgtcacaccttgcagtacttggcggcggcgtcgcggtcgggatgctgctgctgctgctgctgcatgagcgagagcgcgcgctcgaactgcgcccaccgctgctcgagcgtgccgttgtacccgacggacatgcggacgaggccgggggagatgccggcgcgagcgcggtcctcgggcggcatctcgctgctggtgctgctgccggagcacgacatgagggtctcgtagtagccgaggctgacggccatgaggccgaagcgggtggtgttctggaggtggtgcatgaggcggttggcgcggtcctcggtgcccatgtcgacgcagagcatgccgccggcgccgtagcccgggttggcgatggcgaggaggcgggcgtggtgcgggtggtcggggaggcccgggtaggcgacgcggaggccgaggcggcgcatccgggacgcgtactcggcggcgcgccgcgagtgctcctgcatccggagcgggaggtgcgggaggcgctccgagagctcgaaggccaccttggcgttcatcgtcgggcccagcagcatcagggccccctcctgcaggtccatcatcgcgttcaccaggctcgccggcccacagatcgcccctggaaacaaaatcatccacgtaaattttacatcttgcgtgtgtgatatacttcctccgtcccaaaaaaattgcatttatagctctaagattttatcccacaaaaattgtatttctagccatgtggggcccagcaaattgattcatctagataagtttccttaagttttctcagcttgtaatttaagtatgctaattatatgggttaattctctcaaacttccttttaatcatttgtatatatggaatgtgtgcatgcaatgggtttattaaataaggtcattgtggtcattttccaatcctactgttttgtcctaaattagctagaaatgtaattttcatgggacggagggagtatcattttacacaggcttattaatctcttgcgttgcgttgctttttttttaaaaaaaaaactaggagaaccaagcttgttttgcgtagctcagctgcacgagcaaatgtgttactgtgacagatcttcgtgtctatagcacgtaagcatcatatgcacttgatagtgtagtagtaatagtgtgtgtttttaacaccgaagtctcgtgtttaattctcaacacgtttataatttttcttaaaaaaaatatatttctgtcaacatttcatcgaagtcgaaataaagttacaaatatggagaattcttgatgtatcaaaaccgatttcataaagctaatataataatgctattgtttctaaccattttcatgccgggtcaggcagggtgcaacgaatcgggggtaaatgatatgcgctattgaatcacgggtgacactgtggcgcaaatgagcgccacacatcggcaatgattcatttgatttggctagacgtacgacgcatgcgaaaaaagcaaacaaatccgtcatttagctccggcgatccagggccgtccatggtgatgggtagcttttggcttggcagacatgcaacacatggtgggtgcagtgcaaagccatgccaaatgggcagtaggttccgacctagatgggtcaccaccacgtcaatctgactcactgccttgtccgttccgcctcgcgcgttgtcggcacgtgagacgggtggtaaaattcttactaccaagaatccaagatttaacctagtaggagtagtagtttctttttttcgatggattaaccttatagtaatttttttcctactagtatgatgatgaattcgtgactcgtgctactacatacttcatcatgttttttcttatgtaccattagcacttctgcgagatttaattgccgcacgtgtgctctattaatcctaatctattccgggggaaattaaacgtagagtaacaaataggggtacgttgtccgtatcctagtcgcgatcaccttattaattaattaattaattaattaattgtttatttagcttaatccactagaccccgtgagtatgagtcatgacggcgcaagcctcacccaaggcctggggctggcacgtgtttgggcggctttgagccccagctaccttggaacgacatggtaggtgacagtgcgatacacgagtggcacacgacaaagacgtacacgacgacgacgctgatcgtgcacgcgcgctctgatgctcgcgtacactgccgctaacgtaagagctagcctctttaattgagcgtgtcaagcgtgtgtatgtgcatgcaacacgtcacgatgatatagctaaaaatggagaacggctaaggcgtccggcgtattcgtccttacctgcgatgatgtcggcgccgccgctgatgaacttggagacgctgtggacgacgacgtcggcgccgaggcgggccggcgagacgaccatgggcgtgaacgtgttgtccaccaccagcttggcgccggcgtcgtgcgcgacgcgggccagcatcgggatgtcggccacggccagcgtcgggttcgacatcgtctccacgtacaccacccgcgtctcccccgggcgcaccgcggcgcgcaccgccgcctcgtcgtcagcgtccacgaacgttgcgcgcaccccggacgcgcgcggcaggaaccgggacagcagcgcgtgcgtgccgccgtacaggcaccgcgacgccaccacgtgcccccccgcgccgacgagctgcatcagcacggaggagatggcggacatcccggacgccgtgcagtacgcggcctcggtgccctccagcgccgccatctgccgccccagcgccagcaccgtcgggttgaagtggcggctgtagatgtacaggtcgccgcgctccgggccgagctccccggagaagaggcggcgcatggtgtccggctccatcaccgtgaacgtcgccgacgcctcgatggacatgttcaccccgccgtgctcgccgaactcgtggcgcgccgcggccagcgccgccgccgggtcggcctcccggcgccgcgccttgggcttcccgtcggcgttgccgttgccgttgctgctgttgtcgtcgtcgttctggaaggggcgcttgatggtggcggtgacgagctcggaggcggccatgacgtgggccatttgggatgcgtgtgtgtacgttcgagacaggagagcgggtgcggcgtgtctgtcgaacaggagtcgcgggcaatttatagacgggggttggatcttctgcggccagaaaagaagggagacgcgtcgctgtgacgtggtgtgtgacggttaggtccgcggctcgtggaggaacggacggctgacactgacagcctggggcaatgaaccgggcccatttttacggccaggggggagaagggacaagattagaacagtgtaaacaagcagcatttacgtggaaagataacgtaattcaattactttaattcctagcggatatacaggagtactcctggagtagaatttttcgagtagaaacaagctgttcttaggctcatttctttttctcaactccaaacttcaactttctgctttttcgttagtatattttttaaaatgttactttaattcctagcggatatacaggagtaagttggtactcctggagtagaatttttcgagtagaaacaagctgttcttaggctcatttctttttctcaactccaaacttcaactttctcccttttttgttagtatattttttaaactgttaaatagcacgttttttaaaaaagtttatgtacagaaattgtttaaaaaatttaaataaatatattttcaagtttataattattaatgcttaattaattatgtgataataaggtttctcgttttatgtgccttaaaattctgccttcaaaacggtcgatcgaacgcagccttaaaaagaatctcaaaactcttacaaatactgatgtagcatgctatgttaaatctaaattttctgtaatttttatcttattaaatcaaaagatggataacttgttctaattatctacaagagctttataagatagtttttcaagaaactttatttttttaagtacctatagcagtgttttttcccctgaaatggcaacatgacggatcaatttagccactagagcatgtccactgtataattcctgaaggaatcttaaggtgagacccacttacgtcatactagcaactactccattcattctaaaatataaaaagttttgtttgaatgtggtatattctagtactacgaatctaaacagataacatattcagattcataatattagaatgtatctctttaaccaaaactccatatatttttagcacggatggagtaggagataaaaagtccgccaatgtacgaaacccgcaattgatccttatcgtacggatggatcagcaaatatgtgtatggcaagtgggcctgaagattctccctgctttacaacctggtactgtactatgcatgacgccgactccttcctttggagcagctagcaaaaatagtgcaatatatgggaccggaccggttcgattgtcctctctccttttgagacctctcaaaatccataggaagtcacagggaacgtgcgtacacctataggtccagtgcactttgtcacggtgaaaagacgggcaagttcaatgaaccaagctcgatcactacaggcctcctacccccgtgaggtcgtgactactactggtcaggtttagtctaaattggctaccatgctaactttggcacatcatataagcctgtagaaaaggcagagttctaaacttctatgtcagggcagttctgaaccacagaatcatcatctatcttgttagctcaaatttcaaatgaggccttgaatcgtttccaaatttggatggaaaagacggcatatgaaagccaacatgaatttggatgctgcattgaccaattgtagttatctagtaggtggatggatggcgatcaatccataaacccatcccttggtgccaagcgttttgactaaacctcgcttgtcaacaaggcaaaattgctttgtactactcttttccaaatacatgggtgtgttttatcaaaaaactaataaaaatacacgggtgtgtgcatgatgcgcacaggcattaacaggttcagtgatcagtcagatcagatctccagggctgcctaatcatccagttcttacaaaatttggagccttgcatggattaaacatttactaatatctgtgacaaaaagagcacgtgtaaacggagatgatacttctaaatttagattcaggagtcaggtctaaagtggagttgtgatctgaaattatttatttaagctccaacttcaagagaggtagagctagaggtggagctgtgctaactgccaaataaaccattattaagattttatagctttaaaattttaaagtccaattaacaaagttaaattttgaggaagccaaagattacttcgtccgtttcaaaatgtagttatttttgaggttggcatgagtattaaaaaaagtatgtgagaatgattggaggaagtgtgtaattggttaaaaagataaagtaggtgaagaagaatagttattattggttgagataatcaagtaggtggagaaataatttcattttgacaggacattgagctagaaatagctactgtagtacattttaagactgagttcggtgttaaaatttttttaagtatacggacacacatttgaattattaaacgtagattaataataaaataaattacaaatttggactgtaaactgcaagacgaatcttttgagcctaattaatccgtcattagcaaatatgagttactgtagcacttatagttaatcatggcgtaattaggcttaaaaacttcatcttgaaatttatatgcaaattgtgtaattattttttttctgtcacatttaatgttccatgcatatatccaaatatttgatataatggagaagtttgaagtttttgaaaaaaaatgttggaatctaaactgttcaaattgcagctgtgggcttgggtggtgggcagcttgggtacgacgatgaaactttggaactcaccgcggacgcaaaagccccgaagcatcgcgcggcggaaaacacgtggagccgggcgtggcggccgctttatccgcaaggaatccgagtatccgacccacgcatccggcaatccgcgacattgggatgtggtgcggtgcacagggccacaggcggccagagccccggaggcccggaactccacgggtttaggatatgatttgtcatcgtgtcttatcgcatcatcatcaccagcgttgcatcgactctcttatcttttccatcttctagtagtatttcttttcctaaccttttcattatggcatatgtggtgcactattttatactcctgggccctggctaggcaaagataatcccagtgccggtgtttgtttgcgttaattaggtgtatatgatggacaaaacacgttatcgtacctaaacattctggattctgaaattttgatcttcattctgaattctgaaaggagacagcaaatgaagatctcattgttttcattatgtagagagcaagagaggaacttgtacaatagcagtgaagcaagcggcctgtcaagtgttatgtcaagttgtcgagacccactcaaagtattttgcactgtggagcatgtatctttattggggcttgggcctactccctttataaaaaaaaatctttagaattgaatgtaacatatcctaataaaacgaatttgaacatagtcatgtttaaatttattgtattgtgacgtgttacatccagtactaacttgatttttatgacaagagggtcatcaagtactacccgcactgctatatcgcactaataaaagatatcgagcctgccacttgtatcccgttctgtcggccatttgtcctaatttattcaaacccttttttttcaatggaataaccggtgtatctaaagccagacaacttaacttgctttcatgagaatggcactgaaggatagagtggagtgaattagcacatgcttatcagataggggcacactagtacggacttcctccgtttcacaatgtaagactttctagcattgctcatattcatttagatgttaatgaatctagacatatgtatgtgtttatattcattagcatctatatgtatgtggccaatgctaaaaagtcttacattgtgaaacggaggagtaccacttagaatgacgcgatacacgttggaaattacaaaaatcgaacacaaccaactacttccgttttatattataagtcattaatttaattttttttcttagtattttaaagtttgatcaagtttatagaggtatatactaatattatcaatacaaaacaaacatattatcataatatattcaatgttaaatttaatgaaactaatttgatatagtggatgctgctatttttcctatcaatttgaaaaaatctaaagaattttgactaaaaaagttaaataattaaaaatataaaacagagggagtaataagcattcataattcaagcaggaccattactttggcagattcgattcgatcctgcgctgttactgtcattctcccgtactactactgattaaggcgtgctttttgttggaattaatgaatgggccttagcccactcgaagattaattctttggaaa

SEQ ID NO: 39617 - DNA, 13519 bp, Oryza sativa
aatggtccgaaaattggcaaattggcgtcgaatggtctgcaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaggatatgcgaaaatcaatctagggtttgcctcctactctgtactgcgccgtcgctcgtagactaatccatcccgctcgccggcatgcaccagcgatcgggagagcaggtcttcggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtatgtgttcaatatgttgcgcatatttaatctgttcatgttattctgcgtagtttacatgtgtagatctaatgatgcgttcatactagttttcatctgtaatatcatgatttatttatggaataaattaaatcattatatgcccataatctcaacacttttcgtgccgttcactgtgggagatatgatgatctatgcatgatacgatggggatcgaagacgttatcattcttaatatgctaatgtatttagggtcttaaaatggcattatcgtttaggcttactgtatcttaatttgaacgttgaatcttagagagggacatcctgttaaattttgaacgggaaagagtacgtgcaatgcgtggtgcatgtgagcaaatcatttatagtttagcgagtcgtagctctagcaatatgtagtaataattaataatgtccgtgaaataaccatcgtcagtttttgctatttttctgtctttccaggaaaccggtaagattttcttgtccttctgaaagcagttcatgattttttttttcatcgcaacgtgacatttgtagatagagcaatcgaaacagtagcagacaagctcacaagtcacaaggcagagggatcttgacaaagccgtcgtccatatcgagcttttgagcaagccacctgtactatccgcgtatatgcactcttgtctaaaaaacccactccttgatatgactctgggcaccagattcatacacaggagaaatgaggttttctatactgtgcttttggatggaatcaaatttggtgtatgattcaatggctcggattaattcactactgcttcctccatgtcatattataagactttctagcattgctaatatttatatagatatcaataaatttagacatatatagaaattttgaatgacaatgctagaaaatcttataatatgaaacggatggaatccgtattttctatttaaatatataagtatgtttattttatttggtcacttttataaaacttagactatgaatatatttcaaaatattcagtttgagaatatgtaaatcttatgggtcgttgtatttgttagatattatcggtatattttgatagaaaataatggtcaaagtaacatattaaaacccgaataaaggtactaccgtagtaacgatcggttgagacaaaaattaaccaaaacaataacatgttttctaaagaaatacttagttcatcgaaagccaaacaacttgctttcatgagaatgacggtgagcatgggccacggaatggaaccaagcgcatgcccaaaccactcctaacagaagtttcattctcattgaatagagtgttatgtcaatatttttatgatgtgacaaggaattaataaagagagatggacggatttcatttaggtgaaatcatgtatgcattatttccaatataacttgtgtttgcatgtacggtctacgaagaggttttttactctctttgaggttgtgcagtatcaaatcctgactgttgatctggcatcattcaacggttataaatcgtccgtacctcatcgtactgcaccttctcattaaagcggtaccgtgggtggaaggatatttctgtactttcgcgtgggcatctctttctttcgcgttcgcttccttcccttttcacgagaggaaaacattgctggggaagagcagcgagagatggcggcaagaggcaggggcagcgagagattgcaggacggcgaggacctcgatgtgcgacggcagcggcgcggcgggctcgacgggcgacggcctcgatgtgcgacggcggcggcgcggcggcctggatgcgcctcgatgtgcgacggcagcggcatggcggcctcgatgcgcgacggcagcggcagcggcggcctctcttttcctcctttctgctatgaattttgttgacggcggtggcaacgacggcctgtctcttcctcctttctgctgtgaattttgttgttggatttgctgaaccaaatgtaaatggctaaatggttgattaccagcttactcttgaattgcaagtttcgtattgatgaataaaaaaacaaggttcagaaattggatctgctgtaaataatatcgattcatgagaaagtctcgtgtactttgagttacgcattgtttttcctcctaaatccttcctctacagattaaagttgcaaactcaaattgagcatctcctcctggtatttctctgttcagattaaagcagcaaactcaaattggttgcctccgagcaaggcaggctcgatgcacgacggtagcggcgcgacggcctcgatgcacggcagcggcgtgacggcctcgatgcgcgacagcagcggcaagctcgatgcgcgacggcggcggcgcgggaggctcgatgcacaacggcggcaacagcctcgatgcgcgacggccttgatgagcgacggcggctcgacagcctcgatgtgacggcggcagatggaagagagagacctcatttttgttagcctgatcatacccagctaaaccaacggttagattagattagattggtacctcgtgatatcttcttaaggatgggaaaaatgctcgtctacgaaacaaaaaaaacaaaagaatgtattctatgaactattttaaccatcaattaaatattttgttgtttctgtagcactattgttggaagcataaaaaagaaaccacccactaggtggatggcctaaccagaaattcagaacaacgaagtactctttcttttcaaattacttgccaatttagcttttttactaagttaaacgcttatgtctttgatcataaatatctaataagttatatgctttcattacataaatcataaatatttatgtttttatattatattacaataaaaatactttcataatatataattcgtatgttattaaactatataaatccccttcttccatatgtatacatgcatttcctagaaacaggccaagtttggattgggctatggaagccacggatgccatttgctggccctgtccttgggccaagtttgcgctgaggtttgcgttactaaacactaacgcattatggaagtccttacatgtgaactgatcagcagatgtgtagcaaatccttttattaaaaaattaaaaaaaataaaaccataagaatagcatgtatgtaccacaaattaatatctttttgaaacactcagcatagatagtgcgatatttctattgatatagcagaaaaaaaaatacaagtctatagtcctcataagctatagtcatagagaaaaaaaggacaaacaaaccattcgtctacgttttatcatgctaaaaaaacaaaacaaacacacaacatcctcacaaatagatcttctaaacgatgtctctaaatagaaaacgatgttaagattgttgtcgccgtccgtcctatagaacacgggttcgctcctggatcgtccgcgcggacgcggaggaatgacactggggctgttcggctgccatttttcctagccgcacggcaacacagctgtagccgcacaacgcaaggttgcagccatatgacagctgaacaagcccactctaagtactttaccacaaaattaatattgcacccttgctaatgtcacgtgcctttgctttaggaacaagattagcaattcgtcactgcatcacgttttttaggctgcgttagttacctcctgttccaacttccctctcttatttttacgcgcacgtcaaactgctaaatggtgtgttttttttttaaaaaaattctatacaaaagttgctttaaaaatcatattaatctatttttttaaaaaagatagcaaatacttaattaatcatccgctaatcgctactctgtttttcatatcaggctcccgaacgcagccttaattagtttcaccacaatagtcagtagaagtaaatattagcctcccctgtatgattgtgtgcaataaaacgagtagattgagaaaacaagaaaaatagttctaatttggtagcagctcaactactaactatttctggccgtcaaaccataccgaacatgtactgtactcctttctaatacgaatagattgagtatgttttttttttggatgacgcttaattaatgcttgtcattataactcctttataataaattgatgcaactcacatgaagacaaaaaaaacaaaggaaaaatgttgtcagttattcactagattaattaacgattaggactagctattatgcattttcattataactggaaatgtgtttgttggggaaggcttttgcattgtatagtcttgaagttgttgcatttcccgatcggttcactgtgcgtgactgattgcgtgcagtgcgcggctggggtgttgaaacaattaagcacaaatttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctctcgcccttcctatttttgttcgtggcagatggactgtcattgctgctgaaggaaaaggtggcccagaattctttgaccccttttaaagtctgcagagctgcacctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctggaatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaagaacttttggtgggattccatgaacggccagagaaaaacgcattggaaagcctgggattcgttaacgaaaccaaaaagcttgggtggccttggtttcagagactattggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggatccatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctgataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagacgatgctcatgctctctgcaggtgcattcaagctagccagctttggtcatgtatgcataaatcgggaagtgtttcagtagatataaaggcctctgttttaggaaggttttggctgtttgattgccttgaaaaaattccagaatatgaacaggccatgttcttgatgactctgtggcgcaactggtacgtgaggaatgagctaatacatggcaagtcagccccgccgacggagacgtcacagagatttatacagagctatgtcgatttactgttccagatccgacaagctcctcaggctgacctggtaaaaggaaagcatgtggtgaggactgtacctctgaaaggagggcctaaatatcgagtgcttaacaatcaccaaccatgctgggagagaccaaaagatggctggatgaaattaaatgtggatggatcctttgacgctagctccggtaaggggggtcttggaatgatcctcaggaatagcgctggtgatatcatcttcacttcttgcaaaccccttgaaagatgcaacaacccgctagaatcagagctgcgtgcctgtgttgaagggcttaagctggcgatccattggactttgcttccgattcaggtggaaacagattgtgcctcagtggtccagcttctgcagggtaccggtagagatttttctgttctagccaacatcattcatgaagcgaggcatctgctggtgggtgaaagggtgatttctattaagaaaatatgtcgtagccagaattgcattagccatcatcttgcaaatacggctagagctgattttcttgctggattttggttgggagagagttgtaatcttatctcacatttattaagcgagaactttatgagtgagtaatatatttctttccccccgcaaaaaaaaaattaagcacaaatttggctgctcaaccactcaatttccaacccacgcggatgccgcgttggccgccatcccttttaaacccattgacggatgtacactgatcaattaatcgatattatgccaaaaaatgatacaaatactccagttataaaataacaacggaatatgtataacccattctgaaaaaactctcaattataaacttgacctatgcaatcggaaataaaaggacgtgtttttaattcaactggttatctatgaagtgggtgcaacttaattggttttgactcctagagatgtaatatgtccactatgcactggtggagaaatgactttgctgggtcgacccaaaaccacaataatcccggttccaaaaagaaccagaattaagaatgatctttagtcccggttgaaaaccccagaggcattctaaccaagactaaaaatcatctttagtcctggttcatcccctatcaaattgatgtccgggggccgaggatctttagtccggttggtgttggttgggaactaaagatcggtttgatctttagtcccggttgggaacaccaaccggaactaaaattcgaagcgtagtatataatccctatcccttatcctctcctacacatatcgaatctctccccttctttcccttcctcctccgcttcctacatcctcatcccgatccatcccctccacctcctccccttcctcatccgatcccctcccctctcctccacctcctcctctcccctttcctgcccatcctccccttcctatccggcaaccggcggccggcggggccatgcccggtggcgggccggcggccgtggcaggcggcggcgggccggcggccatggcgggcggtagcaacggagttgttttctcttttttttaatttgtgattcacatgtataattttgtgatttattggatggatctgagatgacctgtgatgtatttgatctgtgtgtaattttttagaatttgtgatgtatttgatttatgtgtatatgtaactttatgatttgtgatgttactttatttgtgatgtgggtttgggatgttactttgatttggggatatgcttcccacttgatttgggagaaaataaaaaaaaagaaacggtaccatctggaactgccgtattctctctttactcccctaaaaagagggattttgtagcgcccgttccgccgtggcgcctagcgggaaattatctcttaaaaaccctaattgcgaaatttgtttcttcgcttgtcgtctagggtccatgccatctcaagatctcagtccccgatctatcgtcaagttcaaatccgaatccaaatctttccaaatcaaattcctccgcaaaagtctattttgcctcccttggggtcgatgggccgaatttctctcggcccatcttcccctctcccccggccctctcctctcccccggcgagctcccgctctccctctctctctctctctctctctcgccccctcccctcccccggcgcgctccctctccccctctcgctccgctccgctccgccccgcccgcgcgccgcgcgcgcgagtgcgcgagcgccgcgccgagcgccccctccctttcccctcgctctgcccgcgcgtgcgcaagcgccgcgccgagcgccccttcccctcgctctccttctcctctccctagcaagctccccgctcgcgaagacggcccccgcgcgcgtcgttcgcgcgcgcgcgccgcgtggttccccgcccgagccgcgtcgtctgcgccgtccacgtcgcccggccccgctgctctgccgcgcctgcagccgctcggccccgcgagccagcgcgcgtgcccagccgcgccgcccgttgtttcccgcgcgcgcgtgctgagtggccgaccgcctggtcgccgccgccgtcaccctctgccgcgccagcccgcgcctgtcgcccgtgtcgtcgcgccgctccaaaccgccccgccgtcatcgccgtcgtcatcgcctcggccccgccactcccgcgctagcctccaagggacggaggcagagcctccctcctccctctgccgcgacgcccccgctccctcctccttttcccgaagaggcaaggggacaagcccccttttctctccctcttttcccccttttccctcccgccggcgtcatcctcctccctcctccctgtcgccgctttggccgcgaccgccgagcgctagccctctcctttgaccgccctaagtcggttcccaaaccgacattgccatcctataaacccgagctcccccctttttcctttcctctcccattcacctccgcgccattgccgcccctctgtttcgccgtcgccgttcgtgtcggaagagccgacacgagcaaggacgcggaaggggacttcggccgcgccctctccttcctcttccccggcccgaggccggagagattactcccgcgccgtcggcctctcgtcacagcgccccgacccgcacggtagtgcctctctccattcttcctcctcgctccatctcccccccttagttttcggtggtagcacgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctaacatcggattcccgtagccgcgtagatgctctcaccgtcgggaatcggcccctcgtgacctcgtcgccgtttccctcttccctccccgccggttgccgccgccgcgattcgccgctgtcaagcttcctccggcgaatccgagccgttggctcgtctcccctcgtctcgtgcaaccacccggtgtgctcgttttcgccggtatcgccgtggttcgctccgccgctcgccgctgttgtccgccgtccgttctggccggcgtcgtcgtctacctcctgccagcccacgtggcagccacgtaggcgccacgtcggcgccagctcagccgaggtcgggacgggccgaccccggtcagcccctcccgtgcgcgcgttccaccgcgagccgtgaggctgcgcgtgggcccaccgcatccgttcctccgcagaccgtgcgcgtgcaccgcgtccctcccccgcccgcgcgcgtgcaccgcatactccctccgcacggtgagacgagccgctgacaagcgggtcccacccgggaccgcgcgcggtgagcccggtccaccggctctctctcctccctcccgcgcgcgcgaccgacttgggccggccggcccacccatttagctcggccggaccgccccaattctcttgggccgcgccctagccgcccgataaaagtctattttccctccctcttttcttttcttttcttttcttttccaaaaaggatttaattaaatccttttcctttagaccaaaaatccaataatcttagaaattcaatatcttcccaaccgtaaatccgtttgactccgtttaacttccaaaattcctcaaatctcgagatctatctaatggcatgcttagaggtcattaatagggctttatttttcgccgtttgttgagttgtcccgtttcacgtgtagttccggagcccgaagacccgcagtgcgaggatttcgaggatcaagctccagatctcgagcaaggcaagccacctttgaacatcttgagcctatatttgaaatttaattatgttgcttgaaaatattatgcactgataggatcgcacttaatctgttgtcccgtctgcaaggcagtttggcggacctacctaatttgttgcattgatcctccctttgttaattgttatatcatgtccccttgtaaccatctagatgcgtctcgatattcgtgcaccctgtgcgagtatcgacggacgccttcgaacttaaaatctgaaaaacaatttgggtaaaacttgggttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctagcacaatatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaaaatcagcagctgacgggatcagctaggcccgggtggccgtttgaaagttgttgtcccgggtggccgtttgaaagttgttggccgggtgccaatcttgatcaattctaaagactgatacattgcacaaactccgaccggacgagacgcactgtcttaaccgtgtcgtttgagaagcactcacttagttattttcagaaaggtgtacaaataaaatcaattataaaaacaacagcctttccttgaagcctgcattaaacacttaattctcatggcttgctgagtactcccgtactcacccttgctctatataaatatccccccctcagttgctgaagaagatgaagcggatcctgttgatgaggagttcttccaggagcaagccagctacgatgagttttagggtttcggcctagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttggagcgtcacgggctagtttcggtcgggactagttcggggcgtgacagatttttagtcccggttggtaacaccaaccgggactaaagatccatctttaatcccggttatttgaaccgggactaaagatagcgatctttagtcccagattcgtagtcccggttggaaaaccgggactatagggggttacgaaccgggagtaaaaatcacttctccaccagtgatgtttcaactctagatttgacataagtgttctcatttatagctaattattttttcaatgataaactatgtaaaggtggacacttcataatctcaagatatgccgtttaatcttttgaggtgcttataaaggtggggtgtatgtataaggcatgcatacgtatgttcatatggatagcgcgtgcgcatatgggcgtctatgtttatattatgtttcgaaaaaaaagctagctatcttttcttgaggacttcttggcatcacttggtattctttttcccaacaacagaacttattatgtatttattggcatatgaaggcgatgtaaaccatgtctactataccttaaactagaatgcactatttacagccaaattatccattttttttctactgcgtatattgagttttgtaattgaatttcagtatacatagtggtttggtatactcctataacaatatactccattatacatgaatatattgtgtttggtgagtaaaagcgcacaaggtggtgatgtcttctctcaagagactaaaaattcgtccgcaatattttgtttgattttattcatgcagaaattaatcgtgattacatatatatgcagacccgatcataaaccgaaaaaacaaaacaaaagaagaaaagatacatgcacgtaaccactcacgacttcttgcgcgtcacaactcgattacaattctcaaagcaccatgatcggtcgtcatcgatcactcgttggccgtgacggcggtggctgtggcggcggcttctttctcggcggcggcggcggcggcgtctgcttccttga

SEQ ID NO: 39618 - DNA, 19590 bp, Oryza sativa
agcccccgcagcggcatcatcccctccgggaaacccagcgccctcatcagctccatcgactgcttgaagcactccaccgccccgctcaccacctccgccccctccctctccttcccaacctccgccgccgccgccgccgccatcgtgcccgtcgtcaccgtcgtcgtcacggacgccatcgatcgatcgatcgccgcgcgctgcaggtgactgctcgctcgcgcggttgtgatgagatgagagttgggttgtgtgttgcgtgatgcggtggtgtgcgagtgaggggttttataggggggagtgatcagtaggtgagtggtcgttgagctaacggtaaatggagcaaaattttgagggatttggtcacattagctcaccaagcgacctgggaggagggaggaacataatgttgggttcggtcacgttagctcaccagcatgcggcaaatggatcagcactcccttcccgatcccgggatcagaacagcttcacctggcagattggtggttgcaggcaagactctgttttcagaagggctacagggacaatttcgacagcgcttgcatgctcatctgttggcaaatttggaaagatcgcaatgctagagtattcgatcagcgagtcagcagaccagaccagcttgcagaggctattaaggaagagattatgatctggaaagaagccagctatttcgcgagtagtagctcataaaaacttctcttccattttttttcgttctgtagctgttcctagcttatgggtgcttgtggctaggccatagcatcatttcgacagcttcctgtcgctgtaaaaaatgttgggttcggtcgtttggtgtgtcgaatgggtttaccaagatgcaatatctaacgtacgtacgcaaggatatcatgctacgccacacaatctcttcacgtgctccttgcctcttgttatgcgtgatgttggtgggagttgaatttaatgggctgttattgtagtgggcctattgaggtggatgtgccattaatgtccctaggtgaaataagttcacttttgctcctttgacatagagtttcagaaacgttcttaaaccgcaataacatatatagcgtgtcctttaacttgcaaaattggtttaactggaaaaaaaatacccgtgagttgcaacgggtgaagtctattttaatcttattattgttatttaatttagttaaaatgaaattcacggtgggagtccacttggatatatatatttttagaaaatcatgagctgtaattaggagtccgatcgtctcaagttagcgtgcgagtttttttaaacagatttcttatatgattccttctgtattaccaaaagtgaacgatcttaaaaactgactcaaatacggatatgtaattccaaaagtaaacaaacttaaaaaccaactcatacacggataatgtaccaaaataccggtaaaatcatcttcaatttctataatagtagagatagggtcccaaggtagcataggtttcgtccgacgtgtcgttttggctcaagcgtcaaacgaaaccaggagctatactggcttagaaccccctttaacctgattttgtaagttaaaggatatggtatgatgtttctgaaattcgacgtcgagaagaggaacctaaaatgaacttattcttttcctaggtagctggtgtgaacagcccgttgtaggtggtgggctattgttgggccgttaatgttgatggtgccctagtggcctggtttgctaggcaccaaaccgacacacgacgtgtgacgtgttacacgcaccccttcctcgaaaccgctcggaaattgtaaaaaaaaaaaaaaggaaaaaggaaatcaggtggccggaatccatccatcgcgagagcagagggagggggatcgcggcggcggcggcagctgcggcgaagggggaagcgccggaacgggagccgtggagcgatccgtcgggcatcggcgcccgatgtgggcgtggggcctcgtcgagcgcgccgccgcgggcctcctcggccccctcggcggagcccatggcggcggccgatggaacaccgccgtcgccgtcggtgtcacggccgccgccggcctcgtgctcgtcgtgatcgttgtctcctcccgcaggttcgtcgcctcccaacccttactccccatcctctaggaggcctggtgtggtgttcccttcctggcttcctttcgctgagttgctagcgggtgctttgattgcagaggtgggctcaaatcgccgtggtggcggcggcggaggaaggccgcgcttaagccccatgaatgggtcagcttgttcacgccggaggggaagcttaaggacggcggagtgaagcttctgaagaaagttcgaagcggagtaagagagttttgctttttcgtttatactccctccatttcacaatgtaagattttctagcattgcctacatatatatagatgttaatgaatctaaacacatacatatgtctagattcattaacatctaaatgaatatggcaatgctagaaagtcttacattgtgaaacggatgaagtattctactattatgtttccatgattcggtgtaggttaaggagttatatgattttgttctatgtgcttctgtgacaggggattgagccaagtatcagagcacaggtctggccattccttctgggagtgtaagtactctggaaaacttaatttcgagacggctatagtcaaggacttacgtgttcagatgaataattatatcggcaacatgctatgatcatcttgtacttaagcaaatgacaattgattttgcctcctggatttgaggaaagacttctaggctagcatctcaacttctgaacataggctaagtgtgcaggagcataacagaacttctgatcataccagttgtacacacatgctgagtagttactaagggtgcgttctaaagagcttatctgattgtctactccctcgtttattgtgagcatgtttcccgaaccgctaaatggtgtgttttttgcaaatattttatatatagaagtttcttataaaaaaacaaataaattcatttttcaagtttgtaatacttaatactcaattaattatgcgctaatggctcgcctccttttgtgtgccaagtacaacttataaagtgtttttttttctttcaatcagcagaatgtgagaagaatgtattgctacagtgaggaatattgtgtggttgcatattgtagcatatatatatgtgtgttagttgtgtcttgaagatagcttccatgtgatctgaatttttcattcttatgcagttacagtcttggtagttcagaatctgaaagagacgcggttaaggcacagaacaggtacattcttctgcatgcacattttgtatgtctctctgttcttcctgctttatcgcatcctcatatacctgcccaaagctgaccaatcaaaccaaatccacttgagaacctttcctgatagagttaacatgttatatctgctactctttattttgaaatttgactagtgcctcttgtgttcttttttctgggttatctgaagttgactttttaatggtggatgaattttgtaggaaaggttatctgttattgaggaaccattgcctgcgaaaatctgtctacatcaatgaagagaacaaacaatcaaatgaagccgctggagccaaacatgtggagtgtgttagttctgaaaaaggcgaagacactgtcaatccagctggatctgaagaagtacctgataaatctagtgtagaagagcatcttgttggcgatgacactgttggtcccgttgtatctgaagaagtggctgaaaaatcttttgtcgaagatcatcttgttagtgaggaggaaaatccatctgccaatccaggagaagaagtgcaggatgacacatctaaaacaagccctgagaagctgacagatggaaatcattcttcatctagttcatctagtgaggaagaaagtgaatcaagtggcctgactcatgtagaaacatctcatatggttgtcgcctcagttcagcaatctttaactgaggatgaacaagaaagtatcccgagatattccaacacaggaggaaacatggaaaatgatagcgagttatctaaggctgctcgtcctgtgaaatctgtacgcacaattgaggattttgagacttggcaacgaattatccgcttggatgcagttcgtgctaatgatgaatgggtttcttactccccatctcaagctgtagtttccagggagaaggcaattgaatctgctaaagctgtttgtctgaaagattacgaacatttggaaccacataggatccgtcatgcagcacgccttgttccaattcttgaggcttatgccatctatgacccagaaattggatattgccagggcatgagcgaccttcttgcacctctacttgccgtactggaagatgacaatgaagccttctggtgctttgctggttttatgaggaaagcccgtcataatttcaggcttgatgaagtgggcattcgcaggcaactgaacatggtagccaggataatcaaatacaaggacttccatctttacagacatttggagatgctccaagctgaggactgcttctttgtttacagaatggtggtggtcatgttccgaagggagctgacctttgagcagaccctctgtctatgggaggttatgtgggccgatcaggcagcaaaccgtgctggaattgcaaaatcatcgttggggaaactgcggttaggagcccctccaactgatgacttgctactatatgcaattgcggccagcgtgctgcagaagaggaaactgataatagagagctatagcagcatggatgagatcataagggagtgtaacagcatggctgggcagctggacatttggaagctcctggacgatgcgcacgatctagtaacgacccttcacggtaggattgagtagtgatatactgatacactctactcattttgtacacggcttgttgtattactttacacattttcatccttacgtcatatttcatctctttttcactaacactccctccatggatatgtgttagtttgggactacagacctacagtaccacaggctcagttgcatggtgtcccagtctagctgcctctcaggattaggccattatcttttcttgatcatagtggtgtaactggaccatctatgcgtgtggatttctttcttgctgtggtcgctgtcagtatcctgcaaatccatgtgatagcatcataccaatgtgcaaggggcaaattctacttcctccgttttaggttataaggctttctaacgttgccttaaacagagcgttttaggttataaggctttctaacattgccttaaacagaggtagtagtggacatgcggttggaaccggtaaaccagtacctaaaatagaaacaaatcaatggctacccccagtgtttcttgtctgtgtacataagcatagatgtttgcttcgtgaggacttcaacaaacagaacacaaatatcagaagttacatcaaagaagaataatttcacttctctttgtgtcgaattctccgaagtgttctacgctacgaaagtcatttgttatgttatttcatatcccagccgttccaaatgaacaatatttgggcacaaatatgtaacacggatgttcgggatacataatactccataatataacaatacaacataccgttcccctcaacaaatatcattatttagttcttttgatccaaatcatttcacctaatatagcttcatggaccatattgattatcaacattgtaataacagatctactcagatttggtgtactgccggatagcaaatgcaagccccaagatcaagatggggacaagaaactgcaagatcttaatgagcatgtcatcgcccttgtctgggttgccgggcgcttgctggggagtgacatgagtacgctttactgggatggttgaagcatcaatctccccaatgagatacttctccatcatctcccttgctgattcactgtggccaatgtcttcaaaatcattggttgcgtctttgcctacgtgcattggagaggaggggtcagctttgatattgagatggcaatggtttaataatgttgacagtcagtttcatcattaattatgaaatgaaagaaaatatatctcaccagttactgctagcaacacttcatcgccaccagggtgctcatccataaaagaagtaacatcatatacctgaaatgttaacaaggatgagatgttatggtcaagtgcataaatctccatattagcacaatttcttatcggcaagcaacatacggcagatgacattaaatatgggccaaacataagttttttatgttttcaccatgttttacttcatactccctccgctccaaaataaacaagtctagaatgagatgggacattacctagtaccatgaatctagacactaggtaatgtttcatcctaggtttatttattttgggacaaggagagtacaatcctaatcttatggaagagatgaatatgcatgtctataccaaccataattacttaacccaaggaactagacaatttaatggtacatctctttttcactgcagagaaaacctactgttatgcataggctgtagtagcacatggttcgttgtacacaggccatactaatccatacactttccaaatatcataattgtgaaggggagagacaaccaaaactattgaccacacggagtacaaatgcataatgttttagagggtcgtatgaatcaaatgcactaataactcctttaattccaccatgcacgactactctctctctctaattcaagtgggttgaatgtaagccatatcattatttgaggtgcatgcagtacctaagcacactgaacactaaatgaaagtcactcgacctgcaatggacatacccgctgatagaattatgcctgctttccatctctttttttttttacgtaaaaaggtagagagattctaccttgtaaccattagattaatggtgggtactttccatcttaaaaacacatatttgttcgagactccacagataccttgcagacataccaatcatgagtccacaaaagaatctgatcgaggaactttgcaaatacaagttacacaaccaccacatactgtaatatgttgatagccatatgtaatgcaagcccaaatgaattaattctacccttcaagtaaacaatctatcgtgtattgtcctctggcttcaagtatctaaccatctggcagatagcgcatttatttatcctaaatgatagaggggaaacgagtcgattagtcaccaacaagaacattctgcacagtgcccacaagctttgtcatggtcagcattttattttgctgtgttttcttatgtttgcttgctcttacactgaagcagattctttattccagggatgtagtaacccaacatccaaaacgaggtttgctggtgtggaacctatgcccagagcaggataatgatgtgagcttggtgtttgcttaggggttgggaggactactaccttttattttttcctaaaaaaaggttatatcccagctaggggttagggggtcatgtcaagtctgaagtcatgtcatctcagatgctgataatttggactcattcctatgaatagtatgggttgcgagtgatttattataccttcttggtgagaattggtgaccacgaaacaaacactaatcgcagagaaagaggataaagaaagaaaaaaaaaaccttcccggcgatgatgagccagcaatccttggtgacgttgtggccggccacctcctcgaacccgaacaccttcttctcgccggccatgtccgccgcccacgcccacgccctgcaacgctgcaaagagaaattcccccccccaaaacaccagagaaacaaacaatcagccccccttcttcgcgcacccgagaagaaaggagagaactccgccacgcaaagaggcgcgcggctggctcacctgcgaggtggtgggaggaagcggaagccgacgaggagcgcgtggccgcggggggagcggagcggagtgtgggggagtcacgcgatctggacacgctccgctctctcggcggcgccggaaaccccgcggtatttgagacgctgcgcaccccgacccgagtccaccgtttacttgcttgcccatgtggttttaccgaaatacccttcgttccctgcctactacgcaacgcacggctgctttgggtaattgggtccggcccattatcatgcctcgtggtctcttcctcgctctgcaccagtgtaccgtactactcgacaagtggttttacccaaatacccttcccttcctcagcatggctgcttcttatgtgggccttccgttgggcccggcccatcggctcgcctcgtggtgacgtaaccgttgacacgtaggcggcggcttcccctacctcggagtcagtcgtctcctccgctttttgcttcgccatttgatttttttgccaagtccaacgtcgcgcgaggcgaggcgaggcgaggcgagaggaggagtggagaccaccgccgccgcggcgcgcgcgcgctcggagatctcgccgcggtagcgcagcgcgggtgccgtgccctgatccgtccgtgcgatgaaagagcccgcgcaggtgaggacggcgcggggcggcgcggcggatggggtggaggtgggggtggaggaggaggaggagccgccgcgatcggcgacggtgaagcaggaggaggcgaacgcggtgctcggggcggaggggtcccgcccgttcgccatgcgggagctcaaggaggaccacgaggtcgcggccgggagcggcgtgaaggcggcgtctggggagaggaacgggatcggatcggcggatgcccagggttcgtcgtacaggttcgtggagatgcagtccattcagatctcacgacatgtaccgtatcagttcgatttagtcgtgtttgcgttgagtgttaattgctctgttgcctgcagagttttattcgatgtttaactattgctttagttagaattccaccaccatagttgagttaatctcatcaatgtgaattgtgatgctgatacttatgatagttgttgtattggaatgattagctgcaacatgcaagcctgcaaccataattctttgttttgatgagaattgtttgtcaagtatcagtggtcatagttgagcaaagcaaaattaccgccctagcaaatctagcagacctctcacctagtcgaccttcttttaggttagttttactgctagataaggatatataaaagccacttttcgtgccactgtacattgctttgcaatatcatgggtaattcttaaacattgtggaatgtttaattccattcttaaacatcatgggtaaaatattgtgttatgtacaacatatagtgcatgtctatcccattctccgtacacattgatgagactgtctcgaatttatttcagccaagagagtatgcagcagttttcatcccatcatgatgttgcaatggacttaataaatagtgtcactggagttgacgaggaaggccgttctcgccagaggattctttcttttgctgccaaaaggttgtgttatctttcctgaatatcctttctcttgctattatcttacactttaaatgtccttcatctgtaattacttgttctgtcaagtcttataaaatctttcatgcagatacataagcgcaatagaaagaaatcatgatgaccctgatgcatattataattgggcccttgttctccaggtacatctgcattcttcttaagttatgtgatgtgccagttattgtgttgtactgttgttaatacttaactgtgaccaatgtatgattgataatattctctcaaaatattgattcaggagagtgcagacaatgtagatccaaattctagttcgtccaaagatgcattgcttgaggaggcttgcaaaaagtatgctgaagctacccgtctttgcccaactctttatgatgtaagtttttgttcctcacatttgtttgatttgaagaatttgaattgataagagaattttctgagttggtcttgtccaagaaaagatgagaagagacatggccattttttaccaccaatactctatcaaaagcatttagaattgtagatcatcccgcagaatgtaatctatggttctggtggataaaaagtgctctcatttgctgtatattagatgtccatatttgactattttgtacttatttcaagcacccatttccccttttaggcatattataactgggctattgctattgctgatcgggctaaaatgcgaggtcgtactaaagaagctgaagagctctggaagcaggtttacttacaagcctcacacatgtacatgctttgttaaaatgtttatgctatatatcttgttgctccctgttatcagtataatgtttattcatctagtgaaattccattgattgcaatttgcattatttaaatgatcaacattgtgcaattttcctttcagttatcaagttaaaattctatatgataatattttttagttatactaataagttggttgcttccttcatatatctcgatggcagtgtaagccacaactttctcaatagccaattgggtagtaagcggcataaaactcataatggcacttcgtgatgacattaattcttgcggtttactgtaagctatgctgacacaatgtgatcatcatatttgaggcttatttttatctgtctttttctatactaaacttagccagtttgcctttgatatttggggcaaaatcaacctagcatattcttaaaaaaagttctgtgtatctcttaataccgctgtttggtttcgaacatattctaacgaaacaaactgtattggtggaaataggaattgattcctactgcaaattttgatggtgattttccaaatctaccttgtccagatagtcttggaatgggttgttctaatgatccatcactttattgaagcatatatgctgccctgagacttgtttttttttcggttatgtgcttgtaaatggaaaccggaatcacacttctagttttgcatagactaacttttgtcatcactcatctataacaaatgatacctatttttttctactaggttttactgagtcataaggtgatctttttctttacaaggaatacactgtcatactgtttaaagtttataatgaagtttgatgccacgtgttatgtatggttccattccattgcaggcaatactgaattatgagaaggctgtccagctaaattggaatagtccgcaggtcagaacctagatcctttttccttatcttcaggactttacaacataagaaaaaaaaagagaagatatgaaatgtttgcctttttgtgaagaagaaacattcttatttgatttaagtggaagaaattcacgtcaatgcaattaatgaaatgggaaggttcaaaaaaatatggagttgtgccataccataaaaatgctatcatatgggttgtagaatgtagagaaccgtttgtagaggccttacctttacatttagaatacatttttttaatctaaatcctaatatgccctttaaggaaaaaaggcctcactgaatgttcattcttccatcaaatggtccaaaagaagaaattttaaaattacatccactgagaaaccaaaacttgatatacctcaatcgtaatactgtacaattcatgtcacttccttttaaccattctcttcattcttcattttgggcaaagctatgagttgaacattgacagatcatatcaacttggattttctttccacacactccccctattttcagttctcacttgagaacccatgccattgttgcttatattagttatatctttgattacaggctcttaataattggggtcttggactacaggtaatcccacatttgacttcttgttattgtagccttctcaatctgggatattccttagctctctgctcttgagctatatttgctatgctgtattttttttcagctaggagtatgaatttgtattgcaggaactgagtgcaattgttccggctcgtgagaagcaaaccatcataaaaacagctataagtaaggtagatgcaatttctattactgtgcgagaatcatttttgatgattgtatcttctataaactattgggctgttgacgccccccttctgatgtcttggcagtttcgagctgcaattcaactgcaatttgatttccatcgggcaatatacaatcttgggacagtcttggtatgattcctgacttccattactcacctagcaataatctattgttttaatgtagctgcagtgacttgtgaaaaccttagctgattaagttttatgataataacaagaatctgtcttcttgtcttattaaatgtctcagtatggtttagctgaggatacaatgaggtctgggaagccaggtgtgtccgctagcgagttttacagtcagtctgctatctatgttgcagctgcccatgcactgaagccaaattactcggtatttctttttgtcttttaattttctaatttatgtatgggacttcttcataaaaactttatagctgacaatgtccctttttgtataattcaggtctaccgcagtgctttgcgattagtccgttcaatggtaagacactaattttatttcttgacaaactcttaatttattgtttatttttatcagttgttagccagcagtagttaagatatggctagaatatgtttatttcttaatttattatcttagaattcacttatctttttttttgttaagtcgtttttatgtggaagataaaagatgaatagacataggactttgaacctgtcaaatttttactctgctgttctttagttttgagtatacattgttatttcagtacatggcttcttatcttatttcttgatatggcagaagtaaccttgttcttgctgtcattctatgtcatgcagctgcctttgccatatctcaaagtgggatatttgattgctcctccagaaaatagtgccattgcaccacacaaagaatgggagaggtcacagtttgttttgaaccatgaagaactccagcaggtagttctgccactgttctttgtgcacttgctttagatgataatattgtccattttgaagttactgctgtctgtaattgttctttgtcattatcgtgcctgctcaaactgctatgtgttgtaaattgtaggtcaatgcctctgaccagcctccatcacaatcacctgggcatgtggacagcggcagaaagcttttcaggatagttgttgcagacattgtttctgtgtcagcatgcgctgatctaaccctgccacccggtgctggccttcgcatcgatactattcatggccctagattcttggtatgcatttcaatttgcaattgttcatttgttctatcgaaatggattacagatgttttcctttatctacaaatggactattttctctgctttccttgtaaaatggataactacaactctatgcctataatgtcctcagctatcattatcaagttagtgacaaacaactgagtatatagtttcgagtgcataacaaatgttttgttgtgcttgtggcaggttgctgataactgggagaccattgacagttggctagacgctatacgcctagtctacaccatatttgcaagagggaggagtgatgtccttgctgggattattactggctgatggctcgctgctagtgaaaaactgccaacaagtataggccaagagactgtaggagtatgtcccggaatcagatagaagtatcatagaactcatggttttagtaggcgtaagagcagatgttatttgtaacccatttatggactggtaggtcataggccaattttcctttgtactgtggcgttgtgtcgtcatggtacatatgatgtgatataagaaataaaaaccgtaatatcctctctagcctgtgaataaagatgcaacggcttgtggcaggcgagtaggttgtgtgaactgctgtcctatctccctctcaaagaaggaataaaatgtttcccctatctgtttttcagccttcaaatctctgtttctcggaaaggaaaaccacatattatttacaatgttacacgtacacagttcggcttagcgaacatttgttttcagacataatttggacatgcatgtcagtacttgatatcaaaggctcaaagcgtgtatgcaatttgctccttgaagtttcataatctaagcgtgtatacaatctcgagccgcaggatccagccgcaggaatccagtgctgttcagattgaggtcatttcaaaccatactaatttttaggtaaagttgtcaaagatgtgcatatatttagtttcttatcaatctttggtaaatacataataaatcctgccaaaatttaataaggtttattttggttacaatctgaagagcccctcagtcacttgatgctggacaagagatgaatctctgaattgacatctccaagtattccaccacttactgtaaagctgaagggaaaaaaactgaaaaagagaaatattcccccgcctgagatttctcagagacatttcgaaatttctcctcctcccagatcgccaactcaagaaagaacaccgcctcctcctcctcctcctccactcctactccaccgcatccgcctcaacctccatcaatggaactctcctccaagcgcgagcgccccaaggactccagctagagtgagctccctgatcgggccatggcgacgatagcagcagcccgtggaatctccaccaacgacatcgcccacatggcgttcgtgtgcaagcgctaggcgggcgctctgtgagttcactgctccaccttcggagaagtcttcagctctgatgcgtccgtctccattgatgaagcgcttctccaagggtcctatggattcgggctggggtgagctccctgcttgcgcagtcgtgaggatcacagcagcaagtggacttgcggacaaggacgtcaaccacatggtgttcctgtgccatcactgggcgaacgttctcctcgaggagctcacgatggcatcgggtgagtccccctctttccctcccttagagagttctgcagcggccacagggtggagaggggggatgcattcagctgctatgtcatcatcgcgatggagcaccattctatacgatttgttgttcgcaattgctcttcgcctgaaggatttggccgtgctgaggcttgtgtgcaagccatggtgggatgcattcccaggtccaccgtttctggtatgctccacacacttgctggaagaaccactggttggggaatcacaagttttgggtcattttctcccatgcaagttgcaaaaaattttcccccaaattcagtctgttggggtggatctcttgatgtacttgggatagtcgattcggacggccaccatgattgcaggattttttgtctgctctgtgagggagaggagagattaccaccattgccagattcacctaatggactcttcgtgttctagatctgtaacattcttatgagagcagttcatgttgtggcatcgtcattactttatcatttccatgagagaaaatttgtgctagtgaatgagggtttacaacgatttgtcgagtaggtccaaattaagattccaaggaactataccattggtccaaattcggtcgtggagacaaacattaatggtattgttatccaacagccaaaggtagcagaatttgcccaaggaagtcattattcgagaccaaaaagacaacacctctttatatgtaatgaggagatgtacttatgtatcatcttgcatggagctgaaagggatgatatcatagttaagctattcagagcaattgagctaacactaccaccatcaattttgttcttgcgaatagtattggtacttactcactttaccttggtgccaatcaaccttggttcgccacttgaataatgtttctacatgcagaaggatcaacactgcctatttcgagaattgggacgacaatatgtggattgcgtgttttaagcattaatttcagtagcatcacatctttaactagacaggtgaaataatggcacaggagaacattaggcccctgcagtgtgggtgtgtaaaaatctccatagagatacaagtaccgcatgtcatttatgctattagagtagggcaatacgatggtcgaccagaaggattgatgatggcacatcatgggtgcaatgtgcacaatgtaatttgttgtattaatatcgactaaggaaaaaatctcgcttgtaaaggattatggttttctatcaataaaattgggtttgaaatttttaaccaagaggttacaatacatgcttgcataattggctgtagttttttttctataataataaatgcttatataatgaaacataagctatgaattggttacaacaaaatcaggatcacaagactataaattcaccctatggtgataccttttaaatgactataaagatgttccacaatgattacggctatattaatagtatggtggaaaatataacttattttttatggatgaacttaataactgggtgtgtggcagttaacttaagttagttaagaaatacataatgtttagaagtagcttttatcaacccatcttactattcttattcgtattgtctatctcctcctgcagtagaaggcccttttgaaaactgagtttagtcactattgaaaactgagtttagtcactatgccaataggttgtcaaccgtttaagacatgctaaagttagagtgtgttgattttagtttagttagagtgttttattttagtttagctcttgtgagatgttttgtaaatattgttattttagctttggtctatttgatggctgtctttgagattgtcgtatacaaatgttgaatttataatagaacgtcatggatagttggtgtccccaacaagactccttctatctatctactgtattgatgttttcttcagaattttaattacttaactgatgtttgctggtaagtttgtcatatgcattattaatattttccttctattatggtgatgcttcttatttagttttaaaaaaaaagttttcggttccgcttaaaattcagtcaaatatggttgggatgttagatgttttgttagaaccataatgaagaatttaacatcaaaaaggtttgtttcatattcatatcaagtttttattatgttattttgtttacaacttattcaagtaattttttatttgtagttgcttaagattagttgtgaaactttataacaaaaaatatgccaagagctaagcccttataagtattttcatcacttattttttattttgtttattttatgatactatggtacatagtgagtatattaagtatcttatattcatttatgtgtataaagtgattatgggagggaaggtactgattgaaggataaaaccattttgttttttatgttacttgagttttatcctgctattttttgtttgtccctttacgtaattcactatataaacaagtagattatttccatttatttaatcttttcaacattatgaattatgcagctattttgaatttgtacatatgtgtagttaaaaaactatcaaaaataataagtgttaaacatactgcaaaatatgaatacgtatccaccgtaaaaaaagtaaaaaaaagctttaaattataagatactatacatgtgtacagatttttgccttagacattgataattacgcacagatttttgccctttaccctgagattgctaacataaatagattatttttatttttactgtttatttttcttgttaagccttgtctagcattagattaagttaatatcacggtgttacaacattttttctgttaaaaatatagttctgaagttccacaaacttcaacatagtaaataaatgtataattgtttcagtttttgaaggttaagtagtttaatagatacatccttttatttatttgagtaaattttgaaacttggtgttgtgtaagaactcaggatcctattgtgcatgtggggaggggtgggaagatgaaagttatcgtgtgcttattagaatagttttctaccgttggaaattaatttgcattaatcctagttagacagaaatatgtattgataatatgaataaataattgtaccattatgagtatgtatgcatacaagttctaattattacatcttggaaatatttttttggtaccaaaatattagaattaccaatgaagtaaaactcatcctagtaatgtatgattgtatgttttctgaatttgaatttagattaacaaaattagttctttaacgtagctaagtaatccacattgcacttgaatctctagataaatcagcagagtataagcctcacaagcctcatgtgagtgcatggagtgttgaaataagcataaagtatttggtgttcaaattattcagcattatcaccaaaaaaaacaacgtgagtaaacaactgcaacaatccacaatgattatttttttatatttttcttataactaccaaatatcccctctattaggcccattttaaaaacatcagcattaactgctcatttttgtttgagcttgttactgtctacctacaaaatcttacactatgatattgttagtctgattgataaatcgtcctctcttctctaacatttcaaggctaagtagatttgttaacggttgccgtaccgccgaagggcgggcttcactagttaagcggaaaatgaaatggtgaaattgtatttatttcttaaaaattggatcctctattacatccccttggggtctatttataggcttacagccctggattctcagttctagggttttgatattacatgaatgcccctatgtcagggatatttacgggggtaatgataatattttaattgcactatgcaactcatgggtccaattatccctttttcatggtgtcagtgggcctccatggttgaatcgaagaggctattcagcaatcagccactcaccgcgcgcggcgcgcgtaggggggcggcggcaggacgcgtgtaggggagggagcacgtgtctcaatttggtttttttctttggtttttgcagctttctggtttctttccttcggttttctttgggtttcttttttatacgtacggatacgttcccggttcagtttttctatattttttcctttggttttttgcggttttctggtttctttccttcggttcttttggtttataaagtttgtatacgtgaatgcaaagtttgtatacgtacgtatgcaaactttatatttatatatgtgtatacatacatacatacataaattttgcatacttgtatatattttttatacatataaaaatataagttttatagtagtggtatcagtgtagcagtaagtactagttatagaggtagtaaatagtactagtactatagtagtagcacgtactggcacgccgcgcgggaggctgggcgcgcgcccagcagcgcattagcagcgaatgttgattagcgaactgtcgtgtgcctctcctcccgtgcggcgcagccgtggcacgcgcgg

SEQ ID NO: 39619 - DNA, 14138 bp, Oryza sativa
  unsure (1)..(14138): unsure at all n locations
catagtagtatagtagtagtataaaatagtatagtagtaataaagagggaggatagtatacttgtagtagtacatatgagagactaaggggttggcctggtggtggcgcgtggtggtcagttgctaatcagtcgtccactggttgtataggtcattgcatttgcttcggctcctggcttcggcttgcttcgctaaccggcgaccctctttcggcaatcaccggcgtccagccttcgcctctttgtgcttcgccgccaggtgatcttctttgatggcattttggcaggcttggtcaaaggcccttaaggcatgcctctaacattaaccaatgtctgacttgtcttctttcaacctaactgaaacatctaggttaggaagacagccagaaaatttgttttgtattcgtcatatatgaatctagtatatttttctcattttagagaaatgagcttagccttattaacgagtgcgataaccagccaaacatctagtacttaaaagaaagcgagcaatcaaagagagcatgtgattttttctttccattctcattcattggggatcatttggtaatcccatctctggcgtccatcatcgatgttcatagcaaggcttccgtatgtcctgctgcagttttagttcgatgttatcaccactggagctacttgaagaactactggcatcaccggtaagctagatcatctgttgtttatcattattattgccagctttattcttatagccataggatttggttaagcatgttttagccattgttccttcaatagtggtagctaaagatgactacatcggcctctctatgattttttttctttcgagtttgcgtatttggtctcattatatttgttaagaatcttacatcattttatcctgccctgtaggttagtaccataatccaattgactaacaaaagcagaatgaacaatttattaatgtcgaactaccatcgagaattactgttaaaatgcacactgtcagctgcaagtctacaacatcatctatttcatgatggattgcattgggtaagctattttttttcttaaagttgagtaacatatctatataatgaattataaaaaatattgagggcacacattttgttttattttgcgcagttaatatgatcattctgagatttctcaagtgatgtctctattttacaaacttcactctatacatggccaatcttagttttactattttcctcttcttagtactccctccattactagggggttgttcgcttgaactaaattgcagccagttgtgactgtagctgcctgcagtacagtacaagccaatataaattttactgcatttgttgtaggtgttgtggttgtacagccgcaactatgtccaccgaacacaccctaggttggattttttaggacagagggagtatgcatgagtaggatcaatagaaccgaaatttcgtttcagaattttgaacccaacatgagtacaaattcccttgacattaagatattgcgcaataacgcgtggagtatcatctacttctacaataagttgcatctcgatcctgctttcgctggtttcagtttgatgctctactgtttctatcatgaagtgaaggtacaatcactacttgttgaggttgcaaacttgtgatatccttttctggttaatctatttggatttggacaaagggaatgcatgcccatctcgacttccagttccaccggagcagctttgcctacctttatgactttactatctaatgaactgcagaaatgataaatatcacaggaacaactccgatccctcagcttaccagttgctgcacgacctccattttttttttacgttaatggacacccaaggccaagggcacatgccactaatttctacaaccacaagatgccaacttattctttctcgatttaatgctgagtatgtttcttttttcgaataagaatgttgaatatgtttcgatcatccagaatttggcctgattagtatcacacgacacaaaatcaagtgtacccacatatgagtttatctgagaggagagaagttggtgaagctcagttttccttttttctgtaaatactgttgaagcaatagaattatttaaaaaatagtcttcatcactgctaactactccttgaggaagggaggaagggcctcttgagacacaaccaagaatagggccagcagctgctaattccttccccctcatgatattgcggaggacatggaattctctgcaggacatcagactgtacaaaatatcgttccttgcatagtagacacagtttcctctgatcaaagggaagtcttgtgcatgaacggcgaacccttctccccgccccaagaagaccgagtagccgccgaggtccgtcaccttctccccaaactccagctgccaccgctccgccggcgccgtccactcggcggccggcggcttgtaaacctcggcgaaggacgggagccattgcacctgaacgccggcggcgccggtggcgtcgtcccggcggcgatggagttgaggtcgtagacgacgaggagctgctgccagtcgacgaagatcagcttcccgtcgtggaaggcgacgctctctatcctggaggtggagtagttcggcctcggtggcgtcatgaggctccacgacgcgtcccctggacgccagaagtacgtcttctgcgagtcggcgcgtggcacgttctgctggctcgcgagcgccatccactgctgcggcggcggcgaggagagcgggtcaccggagaggaagacctggaggacggagcgcagcggcgggagctcgacctccgcgccggaggtgggatcccagagcaccagccgcgcgcgtcggcagctcgtcgtcgtccgtcagcgcgagccagccacggggcatgccgcagcagcgcgggacgccggcgggcggcgaggcgccacgcaggtccacgtgcccgacgccgtcgaggtgccacacggagtaggcgcccaccggcgacatccgccgccacgggcggatggcggcgacgagccacggccggcgggtggcggacgggagagcggtggaggcgcgccagtgcgcgcacacctggtgcacgtggacatggtcggcctccgtcaccagccggccggcgatctcctcgagcagctccggcaggagccactgccatccgctctccgccatctctgatcaacttcggattacgtacgtgaatgcaggtacaatcttgtagtgatcgaatcgcaatccttttgattaagaactatgcacggagaaaaatctatgagtttcttggcgaatccgctgtttccttccatacataaagacacgtcttgcaattgcaggcccgcgggctctatgtttgggtaactatgatacgtgtttgggctttagaatcgatttctagaaggaataagtccattttacgtttctcatctttttatcgttcaatcgtatccctaaattccattgctgagaaatcttagcccccaacttataaaaccagattaaataaagtccatggtatatggatgtatgttttggctgacaaaacatcctagtcggcaaaaaaaaatagaaaaacatatgagacccacatgtaagtaaacttccacctctcccccacctatccctctcttttgcaagagtttgccgaccaggagaggggtggtgtctggtgggagaggagcaagacgacagcgacggtgacttagatcctcaccggcgagatccacgtgggaggtcgaaggaggagacgcgcgtggtggagaggggatggagcgatgcaacccttcagttgccaaggaatggtggacatagtgcagcatcgacagcggtgcttgggcaaaacgcaacacgatggctcccaatctctctagcacggtggctgatggcatggaggccaagctccatggcagcaatgctgcctcgtcaagctcatgtgtcctcctgcgtcaccatagccttcccgagctcctgttgttgcattgtcgaggttctccgtccctaagccgctttcagcgtcgacgcgcaaaggggctccccagttgacggcgtcaaggagggctcgatttggctattgtcgctctaattcgccctccgccatcgctgcctcctggcccacctcgctcctccttggcgagcttcgccgccggttctccatctcataacatatacccatcccccccccctctcgtcggccaactaccacggctcccggcgtcgctgaccattgacgaggcaacaaagctcgagctcgcgggagaaagtggtgcctcatgctccccctaccttctcccgagccttccttggcctccacttaggggtgtaagtggctaatccgcaaaacccacttatatgctaaattaaaccgcgaacctgcttatttgacctataagtgggttcgcggctgacccacttacacccctacctccacttgctccttccccgctggccaccgctaggaggaagagaagggacaggtggaaagaccagagatgtggtcatgtggagaagagaggagagagggagattagaggaagaatatagaagcctgacatgtgggcccacgtggatcccttgttgtcttagtcgggttgattgtaatcaattcgtcacgtcaaccaaaccgaccactcataccgccatgggacctaatttaatctggtgttgctagttttggatggttaagatatccaatatattgcagtgcagggaacgatttgaacttgtcgaaaacatgagggatgtagaatggactttattcattcgtacaatgcagtaacacacgcacggcctggtccaacggcataagagaatcgttgtcaaataaaatcatgagatgccattttcattatcttaatttaccatttattacttgtaaatcatgagatcgttcagatccgatgccgcgagagccccgaagtcatagatatgtccatcagatacctccgtcgtgtagccatcgacttcaaaaggcagaaaaaactttgaatgagctttcaccaatatgcagtcagattatgggcacctgataatgacgtaaagcaatgacacgctctattatttacgcatgcagaccagtcgctgtaggcggtacattacaattgtaaatataaaaacaaactaataacaccccccccccctccgttttttaagtagataccatggatacattacactattttataaaataaaactaatgattaaatattattttaaaacaaacggcatcatctattaaaatatggagataattaatacaacaaagttatagggctaactctatgcatgattccatttctggatcttctggtccgtagctatctgaaagttgaaatattacatgtgtttttatataggcgtattaatcaagataatacaattaattagtaccacctagctaagctatatggagaccgacattatttgcaagttggaagaggaagaacccaaaatttcaaaagctttcgattggatctgctttttcaacgaaagacggcacaagatcttccaacaatattctattggcaccaatttgcgtgtcaagaatgccaatgaaacagctcgcggcggagacgacgacgttgatatcagctctgtgattgattctgtctacaaaatttctcaccgatatcatgcctggatcgatggatcagtacaaatgcgtatcaatcaagtctcgcacgatgcgtgcgaaagacaacacatttcgactctcgttagattttctccctagtgatgaatgcttctctgaacgttgaatgagcaatcgaaatgcatgcgcatgtctgcttgctttttttccactgccgttattatacgtcgtagaactacgtacctggctagtcccatttgttcttttatccttatgagctttgtaattaaaagttgctgttgcgatgaaatcaatgtaattagtactccctcggtagtgctcactccctccgtttccatctgtttcatgttataaaacgacttgactttgattaaaattaaactactttaaagtttgatcaagtttataaaaaaatagtaatattttcaacccaagataaatttattatgaaaatatatttaattattgatttgatgacactaattgaaattagtattataaatattactatatttgcctataaacttagtcaaacttgaaatagtttgactttagttaaaatatcttataacctgaaacggagggagtattaaatatatgacgttgttggttttattcatcattttttaaaagaataccattaataattttaaaatatttagtttgaaaacataaaatcatattccttcatttttttaatatatgatgtcattgacttatgttataatatttgaccattcgtcttatttaaaaaattataaataatgcttaaagtttctttagtggtaaatcaagaaaaaaggaaaataatatttacttatattttttaaataaaatgaatggttaaacatgatataaaaagttgatgacatcatatattaaaagacggaggcagtaccagtatattgttggaaatatagtcattaatcggcatattttaatccaagaaaatgaaacaatgatcatggcataagcagtgtaggatgatcttaacataaccagtagcatactatgcgcatcatgaatgtcaggaacaggaacataccagtaacgcgataacatgctagaggcatcatgtagaacaggaacaaaaacatagcgcacatagtatagcgctaacaatgggaacaggaatagcgctaacagcagtagcaggaggagaagattataccccgagaatggccctccgctggatggtgaggcagaattgcctccgttgttgtagtcgttcacggcatctcctcctggcgcaccagctccggatccagatccagctcctgtcggcggcggcgtaccacctccgccagcagtggcggcagcaactccagacatggcgatgagcagtcgtgcgggaggcactccccaaaaacctgatcacccgcctacccggtgcagatctcaggcgaaggtgtggtttcggaggcactactccttccaatctctcgtgcgcgcaagagatcagaagcggggaagcgagagcaactcaggcgcgaagaaggagaaactaacaccggggaaagaagcgaagaagtcggatcggactcgcggcctccttatctatcaggagaaagaacgtggacgcgctgttgcggagggaattgtggctgcaagaggatagcgacgtgacgcacgcacgccgcgcctcgccctcgccctcgccctcgcccatggcccggcccggcgcgcgcgcgcgcgcgtgtggcattccgacccccacctcaactggtcaacaaggagcctctaataactccctatttaggttgagatatttctcgcttaaatcctgaggtggtattattatcctcaacatttattatgggcctttgagatttaatattataaattgggcctagcccaattattctaacaatccccaccaaatttcaaggctcataagaaatgttcccaatgttgtgcctgtttgatataccagggttttggtggagactgttaagttgaacttccacctaggaaatgagctacatcaaaccacaactgaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaatatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacgcatatccacttatggcttttatctcattagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagttgatcccttgctattcttcggtttttccttaatagcacgttaggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggctagtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatataaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggctacaagccttgccttgtacttttcgattgtaccatcaggcctaagctttttcttgaaaacccatttgcatcctacgggcttacacccatatggatgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcatcgtgttctatcggtgcaaagtgctcatggggcatgacagtttctttactagaagtgctaggtgtatatttcataggaaattcattctcaaagaatgtagcatctctggactcaagaattgtaccagcatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtatctaacatggcattcaccatctcagttagagtacggttctttctttcggccaccccatttgattggggtgaatagggaggcgacatctcatgaataattccaaactcttcgcaaaaggatgcaaactcattggaaaaatactccccacctctatcagatctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttgaaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgttgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccataccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggacgtactttgccctcgccttctcctcaacacccaaagagccaatgagatcaggaacactgaactcttgtctcttgtgctttagagaagtggcaaggtccgaccaagaaggtggtagtttggcaataatgccacccgccacaaacttgtccggcaactcacagttgttgttctcaagttccttagccagcatctgaatctcataagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcgtcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaagaaaatgaaacaatgatcatggcataagcagtgtagggtgatcttaacataaccagtagcatactatgcgcatcatgaatgtcaggaacaggaacataccagtaacgcgataacatgctcgataacatgctagaggcatcatgtagaacaggaacaagaacatagcgaacatagcgcacatagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagatccagctcctgtcggcggcggcgtaccacctccgccagcagtggcggcagcaactccagacatggcgatgagcagtcgtgcgggaggcactccccaaaaacctgatcacccgcctacccggtgcagatctcaggcgaaggtgtggtttcggaggcactactccttccgcactccccaaaacctgatcacccgcctacccggtgcagatctcaggcgaaggtgtggtttcggaggcactactccttccaatctctcgtgcgcgcaagatcggactcgcggcctccttatctatcaggagaaagaacgtggacgcgctgttgcggagggaatcgtgggaacgtaggttagtggctgcaaaaggatagcgacgtgacgcacgccgccagccacgcctcgcccacggcccggcgcgcgcgcgcgcgtgtggcattccgacccccacctcaactagtcaacagggagcctctaataactccctatttaggttgagatatttctcgcttaaatcctgaggtggtattattatcctcaacatttattatgggcctttgagatttaatattataaattgggcctagcccaattattctaacatatgagctaatcttttataaatatttctcatagtattataattttattagatattaaccacgagagagcgatgtggtatctcaaatcggtcaaggggctgcttttgatgccacggatcgattagacagagaagaaaaagtatgatctccaattcactttggagatactgccaattgctaacacgtcagttcatgcgtttgcatttgccaccgtatatagacttcaaagtgacgggatcaaagaagtctttgtttgtagggaaacactttgtttcgtatgtgcgacactgttttttccccctgtcttttgcatgagctcgtgcgtggaattaacgtacgaacgaaattcatggactcctggatttcatacgaaaggaagaaaaatcctgatcaaaagacatagtaccaataatgatcaatatattcaggaaaacgactagacatatccactttttcggaagcagtcatagaagactggggcatgctgaaatttctgctacgtatacgtactaagttttctcataggaaaaatatgccgtcatatatagtactagcatatatgcattgcatgttctattttctctgttagttatatatggtcaatatccgctggtcacgttaataatgcgaaaactgctgacatctgcgttcattgaccagctaatctcctttgtgcgtagaaacggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39620 - DNA, 778 bp, Oryza sativa
ccccccccccctccggtttttaagtagataccatggatacattacactattttataaaataaaactaatggattaaatattattttaaaacaaacggcatcatctattaaaatatggagataattaatacaacaaagttatagggctaactctatgcatgattccatttctggatcttctggtccgtagctatctgaaagttgaaatattacatgtgtttttatataggcgtattaatcaagataatacaattaattagtaccacctagctaagctatatggagaccgacattatttgcaagttggaagaggaagaacccaaaatttcaaaagctttcgattggatctgctttttcaacgaaagacggcacaagatcttccaacaatattctattggcaccaatttgcgtgtcaagaatgccaatgaaacagctcgcggcggagacgacgacgttgatatcagctctgtgattgattctgtctacaaaatttctcaccgatatcatgcctggatcgatggatcagtacaaatgcgtatcaatcaagtctcgcacgatgcgtgcgaaagacaacacatttcgactctcgttagattttctccctagtgatgaatgcttctctgaacgttgaatgagcaatcgaaatgcatgcgcatgtctgcttgctttttttccactgccgttattatacgtcgtagaactacgtacctggctagtcccatttgttcttttatccttatgagctttgtaattaaaagttgctgttgcgatgaaatcaa

SEQ ID NO: 39621 - DNA, 4032 bp, Oryza sativa
  unsure (1)..(4032): unsure at all n locations
cgtatgcttttttttacaaacgatggaaatattttttttctcttaggactacgaaaaccttttttttctagcgcattttcttttgcgctttttcctgacattttttcctcactcgttctttttaaaccgtttttattttctcgcacattttttgtttttaatatacgatggaaacttctctttttaaatagttagattagattagattagagatagagaagagatatacacacactactaaaacaacgaatagaaattagactttttttgccgcgcttttttctgccctttttttctcgtgcgtttttctacgaacgctttttcgccactttcttatagagtcggacctttctttttggattttttttgttttcgctttataggaatcggattttttttccattgtgggaatcggatctacgtttctttttcttttttttgccagaaaacggatttttttttgttttttcccgttttaggtgggaatcgtatttttttaatctacgtttcttttttgttttttcgccaggtatcggatttttttttgtattttcccgttttaggtgggaatcggatcttttttttttgccagggaatcggattttttaggttgttttttcgctgtttttttttaattttgacgaacgacggaaacgtgttaaattttttaagtaaatagagaagagatatggtttagttaagatgaaatttactatgtgagttcatttggatatacatatatttttagaaaatcatgagctatagttaggagtctgattgtctcaagttagcatacgagtttttttaaacagatttcttatatgattccttctatattaccaaaagtgaacgatcttaaaaaccgcctcaaatacggatatgtatttcgaaaagcaatcgaatttaaaaactgactcatacacagataacgtaccaaaataccggcaaaaacatcttattatttttataataatagagatagagatgagtaaattcatggtaaaatttttatagtaaggcagtgtttagttccctgcaaacttccaaaaattccgtcacattaaatgtttggacacatgcatggaacattaaatatggacgaaaaaacaattgcacagtttacatgtaaattgcgagataaatattttgagcctaattacgctatgatttaataatgtgatgttacagtaaacatttgctaatgatggattaattaggcttaataaatttatatcacagtttataggtgaaatctgtaatttgttttattattagcatatgtttaatacttcaaatgtgcgtccgtatacttttaaaaaaaattgacacacatctaaacacggccctagatactagtatggctaggcccaaaaatctttccgtcactgcctggaatccacgcacaggatagcatacaggcgcctccaacttagcataacgaagtcaaaacgaggggtgggttgtcaaggttgggtgaaaacttaggctgtgtttagatctaaactttggatccaaagttttaactttttccatcacatcaacctgtcatacacacaaattttcagtcacatagtaccaatttcaacccaaacttccaactttaaaagaaactaaacacagccttaatagagagatggttgtgtgggggaaatagctgcaactagttgtactgatcaggccaagcccaatactatagacgtgcttatatttactataaacaaaatttaaacactattgagtactgtagttggtgaatcttgcagcaaacaatatatgaaccgtacggggggtgtgagagtgactgtgactgtgtgtgaacaggacgaggaatcgggctgaatggcctccccattactgaccggttggtgccaccggtggcgacgtactgcccacttttactacccccatttccaccggcgcagaggaccgtcgtcatctcgcctccacaccacattgatctccgtgcaggcggccgcagcgtccctccgtccgtccccgtgtacatgtggccggtgacgacgagtcatcccaatttatgggcgcgcaggtggtggcatttgcatagtctccgtctataataaggtgtgtttagttcacgttaaaattagaagttttattgaacttgaaacaatgtgacggaaaagttgaaagtttatgtgtgtaggaaagttttgatgtgatgaaaaagttggaagtttgaagaaaaattttagaactaaactcggccatagttgtcagtttgattttttttcttataatgtttgaccattcattttatttaaaaaattagtgcaaatataaaaaatataattcgtacttaaagtaattttgataataaagcaaatcataaataaaataaataataatttaaatattttataaataagacaaatgatcaaacattacaaataaaaactcaaagcgacaagtaatatgagagggaggtagtatatctgagggggtttagacctaggagtgtaaaattttagcgtatcatatcggatattatataggtgtcggatgggttgttcggacactaataaaaaaaactaattacagaatgtccgtaaaccgtgagatgaatttattaagcctaattaattcattattaacaaatgtttactgtatcaccatattgtcaaacatagagcaattagttttaaaagattcgtctagcaaattagtcgcaatctatgcaattagttatttttaaatatatatttaatacttcatgcaggtgtttaaacgtttgatgtgatatggtgtaaagttttacgatgggatctaaatagagcctgagtaaaaatttccatagcatttgcagtttcgcatagtcgaatctgggcagtaaaaaattactaaaaaattccacacacacgcaccacggctgctcgcggtcgcggggggaggcacggatctcgcggtgaaaagtcgtctccgggaaggacgactagtcgctggcagatgctgctgctgctgctgctgctggtgcgtcgtgcgcgcgcgcgtctcgggctcggaaaccccgcgtcgtttccgcgttaacaccgcgcgccgattgcccgaatcatttcgcaatcgattggccctgacctgacaacgatccgacgccgtaataatctcctcattctgttcacagaaacttgaacaatgctactcctatcctcctactactgcatcgtgagtgtactactgcaccgcacaggggggtaaaattaaagacgcagattaattgtaattagcctgaagaataaggaataatgcatgagtcatttcctttcttttcctgagtagaaacgtgcatgttgctcggagtngtcaatgtcaactcatctccgagagaaatggaaaaccagaaaccaagcggccggcgagactgtatctctccgaccgaacttgcaatcatgcattgcacgttatagatgcatactcctactacttcttagatagggataagtgacagagtcacagagagagaaaattttgaacccatacaaacttcactatagctatcatttgctatagaaatttcatcatcagatcattcaaaaatattaaaatttaacggagttttcaccggctggcctacgtgtctgtccgggctaaccggttagtggctctactcctaattggatgtgaacatttctactgtaacaaatctggataatcttttattcaaattcattgtattttttaggatgaagggagtagatgtaagatctctatgcttagcagctatgactacgagtaataaaaacaagggaaattttgctacaggacacttgttatgtgtgatttagccctaggacactgcctaaacttacttttggggaaaacactccataaacgtggttatttgccagtgggcaccgctccgattaaaataatactttccggttggggaggagagagaaatagcgtgaaatgtcaaaaatgctcttgggcccacatgtcagctctatctcctatctctcctcatctctctcttttctctctcagagagcgctcgcacggggtggcgtcggtcacggc

SEQ ID NO: 39622 - DNA, 2313 bp, Oryza sativa
taatcggcgcggtgtccactgtcaaattactacatttatggagtgtttttctttaaaagtgagtttgtgcagtgtcctaaagttaaaaccacacataacgaatgtcctgtagcaaaatttccctaaaaacaaactttcacgtagtgtagtgcccggttcggaaggaacacgtacacgcacagtgccgtgctttcagtgctttgcctacgtgaagctgcgagagagtgatggtcgatcgtggggccccacgggccacaagggaaaattgtccgtgcttgggtggtgctctcttcaaggatggggaagagaatcgaggtgagaaaattagggcacagccagcgctgaattgaattgaattcgagcttttatggctgctgcttcttgaatcggtgctgcaggtcatcaatgctgcttgctgactcctcttttttctcgcacacgaacatgtcgtacagctacgaccgtgtattcatattgaaattgaaagtttggttaaaattagaacgatatgacgaaaaagttataagtttatactatgtatgtgtagaaaagttttgatgtgatagaaaagttggaagtttgaataattattttgcaactaaacacagccgtactcgatactctctcacaactactcctacgagtatagacaatactttttttaataaaaaaggagtatacaggagtagtagtagaactctgaagggattgagtacaagtagagtagtggtacgatcagtatgggtatgcagcagcagctagcacacaccaggcaagaacgactgaacaactatacgtatttgctacatattccgcaggcgtgcgtacgtacagtcaaagaaacagttgccaaacgtcttcaggtttgttctattagtctggccggtctgcttaattaattgcttataagcttatcctccctccgtaattataaaggaagtcgtttagaacaatgtttaagttaaaccttaggaatataaattatgaataactcttaagttattgagtttgaaaatgcaaaaattatatgtatagatttatcttgaaaaatactttcataaaagtatacatatatcacttttcaatcaatatttttatagaaacaataaatcaaagttgtgttttggagactgtgtcgctgttctaaacgacttactttacgaatatggcgggagtagataattaagttaattagcacgctgtaattcatgcatccaattaacgtggtttatttttctcgttctatgtccgtagatgctgcatgcaccactatggcgaagcaacaatttgtcaatgttttagcaccaatgcaacatctcgctcctatcagggctcaatattctgggtcgtaataatttctgaaatttgcttacttcagccgacataatattgtgcaaattttaaagtaagcaaattttatttgattttaataaaaaaatgctcaatttttgttattcgggattcattttctgttggtcccccctataagtaatgtgcaaagcaatatataggtccccgggctcctatatataacaaccaaaatatctggataagaatgtgcccagatatataactagaatttactaatatattttaaaagatggtgatagtaataaacagcattgcaatgtgtgtgtgtgtgtgaccatgtaaatactgcagcactaggtagaaacataaccaatatattagcaaagatcattgttgttgcaaaatctgaatcattttaaaacatggtctcaggcggaggcgaggcatctcggtagctggcttgctttttaattttagctcagttggaccgaaggtcctgagccttgtttttcttacttgtaaagtttattctttctttattcaatgaaattggcagtttgccgatcgattcgttcaaaaagaaaatttgaatcatgtgtagcttcaagtagaaatataattacatgtgttgcagttaattttgatcataattatttttcaaacatactccttccgtcccaaaatataacaacttttagctatgaatctgaacacacagttgttcagattcatagctaaaaatgcttatattttggaacggaggtagtaggtttttggtacataaaaataatataggtaattaagtttatcctaacaaaagctttgatcacaacattatatttattcaaaagaattaaatagtcaaagtcctgtcccattgattttaaatggtacaaaattacttccttttgtgactagagggagtagtagtacaactcaatacaacaatctgatcaacaatggcgcattatcgatccgcggagtaagtacaacttaaaaaaa

SEQ ID NO: 39623 - DNA, 8288 bp, Oryza sativa
ttaaattgcgaggttcttaagtatgaattctttggttctatatgatccaaagtgtcatttggaagatcgatatacatatcaagtgcaacgttacatgaagaaatagggtctcctatattttccaatatactgaatagtataactgaagaggaagaaagaatcaaagcacgtatatagatgcattattcttactgatcgatcaccacacattgaaattcaagtagaaaaggtttatcaggagttcgatctgttggatcatggtattctaaaaccctacctttagaagggagcctgcttttcatcagagaccatggaagttggaacgaaataagtacattcatgcataaagaaaaagcagctgcgcaggaataataatctcgtagagtagaacataaacacagttaaatattgcctttgctcatcccaaagtatcatgcatgcatgtgtgtatgttctgtgttcagccaacaattaatcttgctagatacaaaatatacagtaaaacaaaacatgcataaccgcatccaggttactcttatccccacttcatctcttatacatacattcttgaaagcgtatgcagaaggttaaaccaagctactcgatcagatctgagttattgtacgtaatctagcatcagttcgtcctagagcttcttcggactttataccaagacaaatcatgattgaacctgcggataagggcaaattaaaaaaaccatactggagatggaagttagttaaaaaaaaaatacagaaagttttcactgaaaacattcatatatatatacacctctattccaaacatcactactgcataattatgagcacactacatgttcaaccttgaatcacataagagcatgcaggctgcacagcatcaccgagaagacaaccctagctggctagctatagctcttatgcatgtcgttgctagctagctagagctttttctcttttggtaatataaccagatccagatatacatcaaattttatgctaacttgttgaagtaacataagtatatctttcattgaagagaaaaggaagcagggaaaagaacacctgtgaaaatgaagaaactaaacagaatggaagaaataaagagagaagataatgaaatagaagagggggagagagaatgtcaaggaagattcccccaatcaaaaggtaatgatgaaactttccagcgcctgccagagagacagagaaaagaggagtcaaagcaagccatcattacaccaatcttctatctctcctcggttctaagcaaacacaaacaaacaaacaaaaaagcagtgaaatcatgaaacagcatcctcggttctcaacaaaccaacaaaaataaaccgaaacaaacatcacatgaaaaatgaaatcctcaataatagagggaagaaagtgaagaaataatagcgagaactatagatctaatgttttgaagctatctctgaggggaatgaagcctggtccgagatcccacggatgagaggaatgaaaaaccttgcacaaatcatcctcaaaaccgcaaggtgcatgagaccttgaaccagacaacattccactcagaagcaaatagcttcatactatctattttcctttcccctcctctctctctctatctatctagttctcatcctctgatattcttcccttgcaagaagctatgggcaaagagcacgggtatgtatagacacaaggagcaagggccagtgacatggtccatggagtggtcatgatatgtgaaatgattacagctgcacacatcaccataaataatttttttttgaagtcacccaaattattcaaaagaaaatactctgacgaccatgcatccccagtgcatctattgaaacgagccatgcacctgcatagtcactgacaagtggaccatgatgcagctgtagcacccgtggagcccacctgtcagtggctggggcatggacagctatacatttacatggggggtgtttagattaggggtgtaaaattttgacgtgtcatattgggtattatatggggtgttgcatggggtacttgggcactaacaaaaaaaaactaattacaaaatctgttagtaaaccgcgagacgaatttattaagcctaattaatccgttattagtaaatgtttattgtagcaccatattgtcaaatcatggaacaattaggcttaaaagattcgtctcacaaattaatcgcagtctgtgcaattagttattttttagcctacattaaatactttatgcggattttaaacatttgaaatgacatggtgtaaaatttttgtgtgggaaatatacagggccatcgcaacaggcaagaccacatggaaaaaagagacggcattaaaaaaccataaagagcggaatgaatggtgacaaagaacacggcggcagaggggttggacctacagctgtggtcgccgccgtggagagacccgggatgcaatcctagccgtccatcgcggcctcgatcgacggatgagagagcacgagacgccatgaaaccctagaaatgacgagagggtcggggggcagtcactgggggagtggttgagttaaatgcgcggcccaagatttggaatttggtgtgcctgctctcgtgtgttgtgtgttgccttgcttgccctagggccatgaattattcatttttttcatgtattttgcttggagtacacagctagctagcaacgagcatatgaagatctctcactgacaaggctccatctctctgcattatgtgtacgtgtacgtgttttatcactgagtcactgacaggagacatgcagatgtaatgatgcaaatatataatacatgtagaatctgactgcattgtacatatatacacataatacatagcggcatgcactacaggtaggagttaaggtcttcatttcttcaaggagtttgtaaactctgaacagtgtggaaaaacgggagagaaagagagcctagatcagacatacacaaatttctcagtaccatggcgtacgtggcactttagcttagctgctgacaaagcccctgcactagctaggttgcatgtttcagtcatcagcaatagaaaacacgattcaaccgttgtttatgtttctcagatatgttaaactaatggccatatgtcttgtgacataatgacatcttctatcagcaattgtcttattcaatgcatagagccatagtccatagctagatgtctcttgatcaagcatatggccggcattaattacaaaatatggagtagtagtactgcttactgctgatataatgtcgtacgtgatggaaaatatatgcattgatttgaattattgcttgaacagggcctccttgtttcatatgcatagcctgccacaaaacacgtactcatgtgataaggcagacgtacactgttggtttttgttaatatatctagagaaatccatgtattgggtttgttgttttgttagtatattgtgaagtactccctccgtcccaaaataagtgcagttttacactattcatgtttaacgtttgaccgttcgtcttatttgaaaatattttatgattagtatttttattactattagatgataaaacatgaatagtattttatgtatgactaaatatttttaaatttttcaaataagacggacggtcaaacgttgaacacggatatctatgactgcacttattttaggacggaggtagtagatgtgacaggcactgacactacaactcaactttacatatagaaaactatacatagtgtagtatgtccaactactattcagagaccttgcccatgcacgatatgggcacggggtctgcgagctagggctcatctggggtcaagcgaatcaacacggtcggcctttgtatggcccctaattcaaaagggttaggccggccattttgtcatctcatcgtgtacacaagtataagatagtacgtactactgtttaacaaaataattaccgtacatacaaaattttgaattagcactcataagtttagcatttaatttgtaaggagtaccacacattattcggataagtttgatataatgtgcaatgagatgatcgattgtgatgcatgacttcgttaagcgtaagttataccgacttagtattttggaagctctcatatgggttgaaacgtgaatattggggtgagtgcgcttgcgtgtatgagcataatggtttaattatatcgcgttttgcaaaaaaaaaaaaatgaaaatcctaaatgtagcaaatgttgactgtgtatcgacaataacccattccctctggcctggtgtggccttcgtctgaaccaggcgacgacgacatgatcgatcagccagccaaaaagcccaaaacccttgccattttcaagcttctcccatctccactacgtgtaaacgccgcatacgcacacagaccagaagctaccgccgagcgccgatcgcgcaggcatgcatgagctatttcccgagaaagccaaagctgtgagcgcccgtagctccagggcttctgcagcagcaagtagcttgtgactaggtttcagccacttgtagcgaaggattagaccacacatgacatgcatgagaatgcagagagctaggcgcaccgcactggagcgccgatttgatcgattcgtctctctgctccttaatttgcgtgtgttttggtccgttgctccggcgtcgtcttcgccttcgcctgcatgcgtggcagcatggctgcatgggtaagtgcatgcacgcagagagctagcggccggcactacagtaacgcgtgggtagccatggcgtgtaacgttttctcatgcgttagattattcgtatagttagtttagtcgtactagccgtagtagtagtagtagatgtgccgtgcgtgaagcggtcaagtgatcggccagagacgtgacatctcgtcgcactctcgatcacctgcatgcgcgcgcgcgcgcccgtgaggcgccgaaccgcgcaaacgcacgcgctgcctctcgcggtgagatttgccgatcgcggtgagccgcgcccgagctcccccccgccccgcgcgcgtaacgctcggctcggctattgtctgcgcggctgtgcgaacgtgacgatgtcgtgggcggaacacgcgctgcctctcgccgtgagattttgccggttaatttttctgcgagatttgccgatttggagcccccgccgcgtgcgtgcgtgcggctatatcctcttgggcctccttcccgtgcgtacgacgcgtgggttgggtcggggaaactggccggcggggcctgcgcgaggggaagctttgcgttttttttttccggtgttgggcttggtaggccaggagcggtggtccgcggcgtagctaggacgcagagcctgtttctgtcgtgggctgcagtggttttactccttggaaggagttgtgagctctgggctgcggcaagtgatggaagatggaagaaatttgatgtgctttccttggttttcttcaactccctccgtcctaaaatgtcctttttctctcaatgaattccctttcgacgggaataaggccttctttcttcttgacacaacttcggatccaagaattttttagaactaagtatccctaacttcacaaatccatcaatttagatctgtgaccacatttataaaatttggataaattatttcgttctagatgaaatttatgattttaaactatatataaactataaatctatcgtgaacggtggattgagatctgaaactgtattgaacagagtccaagagtgtaggtagtgggaaatgggtagaaatggattccatgctttttcgtgtctcagttttatatggtgtgtttttttataaacaaaagtaataaagcatgcatcagatgccaaggtttttgataagggagaaaagatggagtgctatttgcgaacatggttatatttttattgaagtttcttcaagctgattttactcgttttgcaacacacatcatcttgtgagggagtgatgtataaagtatgtaatttgtaaacgagtgaggaagtgacaaaaaagttgcacgtattttgtatacataggctgtgtttggatgcctcctttcccaaccactctccctcgttttctgcgcgcacgtttttcaaactgctaaacggtgtgttttttgcgaaaagtttctatacgaaagttgcttaaaaaaatcaaattaattctttttttaaaaaagatagcaaatacttaattaatcacgtgctaatggaccgctccgttttccgtgaccacagggctgtccctaggggcgtgcagcctgcgcgcccgcacagggcccccaattttcaagggccccttaggcccaaaacttcaacactagatatacaacttaataagtaaattggtagcctaactagtcccgaaaatctgttatttttcttgtcgtttcggcttcgataaagcctttgccggttcgcatagttgcgccagttcgcaattttgaatcgcctcccactatggaccttatcaatcaccaaccgcaacgaacgagaggagtaaacgacgcctcacctctctcttgtgcggtcgtgccgcctaatgctgtttgccacgcccctaacctaattatttctgataatttctaatccggtaatacctaattttggattatcattttaggccattctaattttttatgaaatatattacggagtataaattattttcatattatatcatcaattaagtttttatccttcaactttgcacaggcccctgaatttaacgggacggccctgcgtgatcactgttacggatgggaacttgttctaacggacacagccatataatacatggcttaaaaaaaaaagcttcacctcaaacggaagatctctacaaataagtgtacaaattctaacctaccttaccagtactctctctgccttcaagtatttgtcaagatagtggatagtattcctcaaatttcgaccactcgtcttcctttaaaaaaataaataaatactaaaacttaatgttccgtaataacataacaaagtatatagcactctaaatatatgcattcatgaaacttttgtcagtggcaaaaccacgggagtgccagagtgggcctgtcactcctcattcgacctggaaaccctggtgcatagtcaatcgatcatttgtgtaggcattcaccaaactctgtatgtacctacttatctacagtcttgagtaaataactagctacaataatacatttgtgatattgaagctagactgatttctattatcaaaagaaaatctgaacaagctttaaggcaaggttaatggcacgataaacttttctctttctctctcgaccatgacatcgtcttatcaatgggtccaatgatcgatgatatatttctctaactacggtatgcatgattgtgctctcagtggacaacctaggaattttttaaacctaaacgaaacatgaaaagcatgcgagaaagcatgggctccatgcatctctgagacgccgacctcacagtggtgagatcttataattaatggcgactagccacagtccattttccccgccatggtgaccggtgtccatcgtgacgttcgtcctcgttctctaacatgtggtcctattaattatgttcttccactcctaggtgttagtttcaatgttagaggattatagagtccaagcactcctcatgacttctagacaattacagcttctgagaatctgtaccaaaagctgagctgtttgaggaagtttttgattctgagagaagctgcagcagctagaaactccctaatcagagcctcaatatgctgtgctattttttattacatatagtccaatttcgaatctttggtctcgctaaaatactataaaatcctattaaaagtacacacgcgctcatgtgtaatagcgggctcaggatttgaaccctaataaacaaaatcatgcatgtactatttcacatgtatacttttggtgctgatcatatagcatgtgacttcgcttgagtatataatttttgacatttagttatgtgaccccttaatttttttgctcaaagtacgccactgcatgggttcaaacttgtgtgtgtcttgtgatcaaactaatacttgtttggtcctattatcaacctatatatcgttgccttcaaattgtggagaattgaagaatagattaaccgatcgatcgatcgatcgaacactgcaaattgcgagcagcatgttgctttctgaccccagcaacgaaagacaccattcggcttagccctctagcctctgtatacctgattacctgtacgccactacgcactacagtaatc

SEQ ID NO: 39624 - DNA, 5127 bp, Oryza sativa
aactatgataaaacccttaaatcaactcccaatttaatattgaaaatttaaattttagtttataagcataagccaaaagatgaggttgcacacccgttaactccacctaggaagacgcgcacgcctatcgatctgtcatgttcaacacatacatgatttccacttttgttccaaccaggggcggattcagcatggggatggtggggtctcgagccaccactactaacgtgaagactatgagagccccacgaagaccccactaaaatttttttaccatacatagatgggagggggactgtaactccatctagtttgcttagaccccactgatatttctttctggatccgccactggttccaaccgcaattatacatcatgcgtgcatctttcagtttcaggctttcagggatcagaacactagctagtagctaacaatgtttaaatttcctttttgctgatcggttaatttggtgcggctattctacacgcaaagtctcagtaaggttgcctttacggttagtgggtagtgcaagttgccataggcttcaatatacaattgcaataatgtatcaactatcaaccgaatatatgatcgtcctgactgatgatcacttaacagtctgtcattgcaacgacacctttttggaacacagagtgttcgacgatccccacagatattgaccagtccagctagctaagctagaagccgatcggatggcggcctttaatttggtcagtatcttgtgccgattcgatcaatcttcagagaaagattatacagtttcagcggtagcaacagcggtacaatattatagagagagagagagagaggaaccaaggggcaaatttttttgcttaaacatcattcatttcaatagttatgtaaaaatcccaaataaaagttacaatactcatataacaacatgtattaccagagtaccagtctaccacatcacaagatgtaaagtcgaaacaaaatttacacatcgagaaaaaaataattaaagacaaatccagcgtatgaacggtacagagcatttggctttgcgaaaagtcgagaaccatcgggtcaaaatatggaacctagctagctatatataagcatatttttctaattgcaagtgcgacgttatcacacttgcaaggaaaaggcggttaattccgatctatcgatgcatgtcgatcgaggtagttagtggccatcgttttcgtcaatttcgtgctgttgtttcttttgaaggataaggcagggtggtggatgcatgatcagatcagttttcggttcagttaaaagcggcgacatgaggtgaaaggtcgctgcacggcttgccgctatctctcgctgtctgtgtctccccctcgctcgcgatcggcgccgcgcgcgcgctagcgagctagctagctgcgtcgtctgtgcgccacgacctgatcagcacgagcacgaaccgtgcggctcattggccacacggagcagctagctaagggaacatatatgtcacactgctcgccatggacgccgcccgcgaaatgaggtgtggagagggtggttaggctagctaggccgtatctctatctcgccgcatcattattttggattcggcgaccaggagcagcaccagcggcatactccgtccgtcccaaaaaaaaaaaaagacaaaccctgatttctgtgtccaatgtttaaccatccgtcttatttaaaaaaatatgaaaaaaattaaaaagataagtcacacataaagtattaatcatgttttatcatctaacaacaacaaaaaatactaattataaaaaaatttcatataagacggacagttaaacattggcacgaaaacccggggtttgactttttttttgggacggagggagtacttacttcgtaccatgaaaaaccaatctaatatctgatatgatatatcatagtactatatttagattcgtagtactaaaatactccctccattttaaattaatctacatatagttttttttaggttattccgaaatgatctatatatttgtgtttattcattaggtctattcgttatttgtgcattggagtaaatggacattgatgcatgcatccatgcacacaaatatttataactcacatgcaatatcttgatttgctattggctaggagatagtggggatggtgcatatatctagtttgttgctagagaaaatatagtatgagagagttattagcttttcttggtcttggtgtacctatgaaatatgtagatcaatttggaatggagtgagtatgtcacatctaacgtcagattgtttttatggaatagagggattactagctacacatgctctgaatcagtcagcggaaagagtataaaaaacaaacctaatatcgaatattgtaatactacaaatccagatatacatttatatccagatatacatttattgaaatttatagtagtagaatgtgtaataggaagtatttgatatcaggtttttttttacagagtgaatactagctacacatgctctgaatcagtcagcgggaagagcatgcaggagcagtgtgcgcacaactgtgcagcggcacgatgatggccaaggagaaagtggagcttaacgttgttggttccaattaattactaattcctctctggtttaatttgaaaagagcagggagccaattgattttgcgctagctgagtccgtctgcatgtgtaactgtgtactccctccgtccaaaaaaaaaaaggcaaaccctaaattttcataccaatgtttaactgttcgtcttatatgaattttttttataattagtatttcattacgcgtgacttatctttttaattttttttcatatttttttaaataagacggatgatcaaatgttggacacggaaaccagagtttgtcttctttttttagacggaaggagtatggttgtagctagcttttactgcggtggtcgtagagagggtttgatttccaaaaggtgttcacgaggtcgggtttccggccgatcgatcgacagcaaaactagctagggttgcccggtatgtacattgatgtgatacggccgtgtaggtcactatagtgacctaaccatacatgtccatatcacaggctagatctgatctctcatgctttgcttacgattaaggaatatatttcagtacttccttcgtttttaaatatacgatatattaacttttagatagacgatgtttgaccatttaccttattcaacaatttagtaatataaaaaaatataaacaatgcttaaaatatatgcaatgataatataagtacaacaagataataatacttgcataagttttttaaaataaaatgaattgttgcatgttcaaaagtcaatagcatcatatatttaaaaaggaagataataactcatttctactaggacgttgtgtggtaagtagaatatcccgtgatgacctaggggttcactaaggagttgaagagttatgatcactttagtctcatatattgatgactacacactttttttttgggggagggggggggggggctgctctcggggcgcatccaccacctttccctcgggcgccctcctcctcggcctggttgtgcttggggtctgatcgagacctacaatatcttcaaggtgttgaagttgcagctcacgaccttcggcatctccttctagctatatccatcgtgaactcctgcgccatcaacatctttgagaaggtcgtccaaactaacaagaaaacctacattcagccatagttattaggaccggattggcggtccgaccgaaaaaaatgggaaccaggggctcagccgatccgatccagtttaaaaattggagtgcaatcaacccggaaaaaatcggttgaatcgccggtttttggaaagaaccagtgaaaaatcaggcaaatagaccgctaaagaaccgagcgctcgtgggaacatgtgtgaaaaggccgaacactggctgaaacgtggggatagagaagaaaataggcggcttgagggatttgaactctcaacctcccctttagactcaatcatccccaccactgagctatgcatgcttatcaattgatttgaaccgtgttggaccggtggttcaaccgatcagaccaatcaaaccgtgtctggtccgatcctaataactatgcattcagcaatggtaacgatcacggctgccctggacgtgcggttaaaaaaacactgagcacagtgaccgcctatgaataaggctcaaacgtcttgggggggcgggctcaggcccgagcatgccctctgccccgagctctcctcagaaggctctgtcctatttatgggtattggtgggcctatagggctaacattaaccgacacaccgcttaaaccgcagggtagagcaactcggtgtacagctcgtccgcatgctgagaaacatgatgcttcatgaagccccttacatggccacatcaaccaaagaaatagaggggaggtaacatggcatgccctcatcatccgtagtttaggtccacctcggtactttagaaaggctgacatgtggccctgtgacagttgggaaaacactttcttacctcctgctccactagttagccgacagctgagacagtcacgtccggctagcttgtttgtagggacatcgacaacactaagcatacctaattcaatagagtgggtctcactcctgcatacatgcattggcattgtggactccccttcatgtataaaaagaggatggggcaattgcatcggtgcccccactttcaaacccatttgctgttttatcatcactttttagggtttacagttttaccctcactctttgaatctgaaccagccagttacccccacttctaatagaaggtgtcacggtgttagttgtacaacaaaaggacatgtataccctctgcatccaacaacatcgtgcaggggaggacctggagcaagggacggggaggagggcggcgtcggcgccgacgtcgacgtcgagcaggatggggtcgtctccggccacgggagcagcagcagcagcgatggtgggggcaggtggaggcggacgctgacgacgatgcctcagcgtggaagccagcggccacgggagcagcagcagcagccgccgccgtcgcccgcacgccgtt

SEQ ID NO: 39625 - DNA, 13187 bp, Oryza sativa
  unsure (1)..(13187): unsure at all n locations
ggcaaaagtgttttctttaaaaagtaggggtaaaacagcagttgaggttcaaagtgagggtatagatgcaattatcccaaagaggatccatgccaccgagaagaaggatccctgagtttccagcaatctagcatacactaagattttccactccacgcactgtgaacatgatcatcaccatcatctaccaaagaacacaagagtaaagtattacgcttccgagcggcccaaaccggtctaaaaatgcttgcctctcccacttttatccttcgagcgtcgcctcatttttgcgcaccgctccctggccgaatcttcaaagggggagtacacgcttacccgctagaggagttccacgctccgacaaccacattaccatcgatccctaaaaaagagcacaaatcaaccactctgagatagatagaaggtgcatgagcgatgttctggtactctctactggtagtattattctaccagtattattaggggtaaattaataatttaataataccctaattagttatgttttcttttctaactaaatatatctatgattatctattacgatgacattactcatattgcatagaaaaaaatgtttagtcgctgataaatgatgattatacccctccgcacctttttttttataataatgcccctccgcgttttttactaccactagttactattgtagtataaatagatttgaacccttcgatcaaatgaaatcaatagttcatattgttttctacttagtagtagagaacatcgtaatggagctcaaggtgcgtagggtacctcatgtccataacaccaacaaataaaaatggtgcaaataccattgagtatttgagtatatttcttcgatgctttctggtacttatatggattgtgttagattacatgtttgttcagcttcaaataccactataaatctataatcactgttgtcgaacttttatacttttttataatgtaaagtatgatgggccattggagcgaggggtacacttccttaataattaagatgttaaactccagctccaaatagtagggaaacatcactgaatctgccttcaagtctattatactccatttatcatcaaaagatccatatcatatccttgtatttcttaatgaaaggagaactaattaggtcgcatgcgccagccattcacacaagagcttaacgaaaagaaaaaaaaggtggagaacaactcacagaatcctcttattctatttatgtttgtgctgtaatctccgctctttgctcgctgacttgcattatcttgcaaaaagcaactctagatatgcgcgtccaaatcaacaactatacaatcagtggctagctagctgctagctagctagtgatcgatgcaagttgatactaggattaagtatactattacccggtttgatcgatcaatcagctcatgatcaacactaaaccgtatcgatcggcgtcacatctcacatgtacttccccagttgccggttgccccctgcatcgatcctctttcgtgttgcctgccgcctgccgcctgccgctttcagctctgtgatgttggaaaactattctaaactctcaaagatgacatcctctcgttatttatatatcatctaaatagttataaaaaatattaaaaaaataataagatagattaatatatgataaattactccacaaatatgcaagataaaatttaacttgtacaggttgcaatgaaaaaaaataaatttaactaaatatatgttaactaaccatagtttaatttatgtattttctataatttatagattttaacttgtatgtttatggagttatatatcacatattaatctatttatttaattttttataactatttaaattacatgtaaataataatgtaaataataaggggaagttggctcgaaagttttagagtccactctcgtgatgttgccactcgtacgtgagctagcttagctatatattgcgcacatgtgcagcaaccaaacctagctgctacgagcaaggcaaagcagagccgtcagttgcggtcagtttccctgtcacctccaggcgtccaggaacatacacacacatcaaggtagtggtggccatggccgcgtgcaggtgcagcagccgcctctccctgcagctgcctcctccgtgcttgctcatcgtcctcgtcgccggtaagtgtatcgtatcttgcatgcatgcgtacgtgtgtgtgatgtgtgtcactgtggctgacacggcggctgggatgtgttgttgttgttggttttggtgcagcggcggcgatggtggcggcggcggcgacaggggcgagggcggcgtgggtggactacccgtcgggggtgccgtgcggggagacgatcccggtggagcagtgcgacccgggcgacgcggcggcgaacagcgcgtgcatggacgtgtgccactacggcggatgccggcgcggcggcgagtgcgtctccctcggcttcggccgcggccggggatgccactgcaagtgctagcagctgaactgagctgagctgatctctgatctgaactgaactgatatgctaatcaggttgagcaaagtagtagaagcagtaattaggagagaataaattaatgagcgctaagctgctgtttgtagatgctcgcttagctactgtcccgttgctggctgccttgctagttttcccgcccttttttgttcctctgttttttcctgatcttcgtgttttgcatgagttggtagcacattaggtttgcttttgtccgcgctgcctctctgtacaaaagcctaaggcgtgagctttgaaaaatgaaatcgccaggtgccttttgttttcttgcacctgtcttttgcctcctttttacaacaagctcgtgctaccaagtaccagttggatctaaacaaacaggagaaaataatcactggattgtacttgcggatccggagtgttcttttggttgccagaagcatgtgtacttccgttacaatgtttgtggtcaagagtttcataatccatgttctagagacaggaattctctaggacgcatcaactattcgaaggtgtgtatgattctccaggacgaaataaagtaagcaccattctgttcttcgggaccaacattgtcacacaccatccactctctgagactcggtatcaaatattcgcttgctaaagcaagatacttcctccgtttcagtaatatgaatagatttattaacattaatatgaatattgaaaatattagaataacttatattgtgaaacggagagtagtactactacaagatgtgcgcattcctgtgagaatataacaggcaagtaaagaaagcccacccaaccaccaaattgcttatcctccaaacgacaacaatacacatcagtaactctatcttcacaagatgatcatcatcatctagctcatgtggcagacaacacgtacaaatacaactcatacatcaccacaattcacgaagaacaagttacaagggaggggatagaaaggtacatgagcagttctgcactacagattgtccatcttttttttcctgttgaaaaatcctatactgtactgagaacacaaacaccgcaggacacaagtcttattcacactttgtaaacactacaaggctcaagctgatcaaggacatcacattcggggtgctgtccctttaatgggggcgatgaacatcaagtggccggcatcagggacctcaaaacaaccacacaaacagggacctccaaacaaccgcgcacactgggggtggcagccactgtgttgtttcgaatgcaagtacaccgattcgagattactctatagtagttgtattagatatcagcaaggtaaaaaggagaaaccacgagatgtactacacaacaagctgcagtccagactccggataggcttttacatttggatagacatcacctcaccaggcacttttgctcgtcaagcacacgatgcacacctctgaagttgggtgtcagcaaggctgttctgacttctgactttagctatgatcaagcacacgatgtacacctctgaagcaaggtgccagcaaagctgttctgacctcttgactgtagctatgaatctgtgggcgtggacaaaaataatccacacctttgccgattgtacatgaacaggatatcgggcaaacttgagaactgtgcagactttggagtcatgtatttacagctactgtacaggatttttggctggcctgccgattaatcgacattgctgaggcagcaaactgcatcgaacttgccccttgacatgcaatagttcaccatcaataccacatccatcatgtgtgttgggcccagccttgagcctcacagacttaacctggaaaagttaatatgtccgtgaactaagtaaattaaagaaaagagttttaacatgaaaacttctggataacaataaaaatatcatgacaggttcaataaaaaccagaaaattctaacgtaatatatgccaatcccgactttataggtttacccttttttttctctcatctatgattccaatttccagaacagattgtgaatggcatgtgaaaggtaaattttttcattacacacctacaattgaaccaagttgtgcagtgaatccaggagatttgcaataaaaaagaaaataaaaaatacaataatcacatgacatgcacaaaaagattttaaaacaacagtttctaagaatgaacgaaaaccttaatatttgaccaagagaaccaatcgtattaccttcagatattccacattgggaagagaaatatgctttccaaactgcaaaagcaccaaaaatttcagtaacctcagcctcccacttccaccaaccaacagtaggtccaggcaattgtcatcgtattcagccttaggagcaataacctgagagcttaaactctgcacagtcttgcatgaatggttgcataccagtacaccaagataccgccccttcctaactgtccatctttcatctaagcttgggactagttccttagtcagaccaagttcaatatcatccaatggaccaggtaagtcaatgggagtctctggttcccagttaggttgattatcccatttaggctcatcatcccacttgggtcctgaatcccacacaggcccaggatctgaaattgtggaggaggcgtcttctttgtcatgtgttgtggtaccacgagaggaatttgcatcatttgtagcacccgagcctggccatgccttttctgtccttgatttcgatttggatctacgccagttgggagtcgatgaaacatgagcctgaggatggatcacttcttctggttctttgaaagtacttgttctccctaatgataggcgctttgattttgggtcaagtgcacgaacaagttcagagggttcattattagcatgtggactcgaaacctctagatctccacctgacattattcctgtagacatgattgaatcaatgctagataaacttgaggcacgaggtagacattctactcgcgacctccgaactacatcatcatagaggtctgatgcatcaactttatcttgcccttccacaattttatgctcaccaccaccaccatctgatattggaagatactccaattcaaagttatactttggcaagcacaagaatttcagaaaaccggctacaaagtaacggagaggaccaaaacgcttctggtatctctctgagagttcaagaactgcaatagaaacaaatagtcagattttctgcttccatttcaaaaaagaattaatattgatccaacaggaaaagaaaatggtctgaaatgtcaattatgtggttaccatcactaacaaaaccaaaatatgagactgttgtgccaaaatggatagtcccactttgaatccattcaacggcaaaaacatcaatgggtgtaaaacctccctgcaagcaatgaacagtttaacaaacattgatgtgaaacaaaaaagaaaaaaatgctgacacaaaattgtgagggcaataattaactcggtctacgttagacagctaaactagtacacagcagaactcttgactaatttgtatgcttcacagactttcagtgccctgctacattttcttgaaaagcagcatgtaaactttcatacacgattctaccttcagtgttcaaactaattcttgccagaacaatggtttcaaatgatggattctctaagaaaaaaaaatcagcatgacttctgtgtactttcagaactgctcgactgcacctggtgacagaagccccctttgacataagttgagctagcttactactgtggcatactaggatggctagttaatggagtacaataagcagatctagaaatgtcagtacaggcctggccaacaattccacatccccagggtccaactagagcaaagcagtgtgaacacatggttggcaacaaagagtaaagagtcatgatagctagtaactcaagagctggtatcatatccagcatcatcaataacatttaatttctttgatgcctagtactgaatcaataaatcatgtgacacgtatatagaaaaccataaatactgaaacaatataatgatgtttaccctgacaattgacattgctgcagaaatcggatctttaacacccaatactgtccaaacaagtgagttatcggaccctgctggtattataccaattggaacagatacagccacattttgatcatctctacaaaggagaccattgagaacctacaaaatgaatttattaatgcatcagaacctgtagttgacaaatgagcattttatagtgacatgcaaggagaggatggcttcagaaagtggaagacaaacatggtctagtgttcatagaagtacataggttttgagaagtaagcattaacagccctcatgtgataaccattctaggttagcagcgtcactgaaaatgatttgaaggttttgtgggttcgacaaccagttgtttaatgaactccaaaattgtgaataacaaagtaaaatattacaatatacaaatctgctgatccctgggagaagcttcttgaacttagtagtttccccctgaaacagttcaggctgaggaagtagaaggttggtttcagaacaaagttgcgaaacttcaagcaattttcagcagtttatataggtatatcctatttgttcttgatataacagatcaaaacttcagaaaagctaaggcaatttaagaaactgtaattggtaatgttgtcataaaagattaccttctctagttggtataccaaacacattaaaaataagatgaggaaacataaaaaaatcatgcatgaaattaacatagactaacctcattaacaatcccatcgccacccacacatacaattcctagaagacaggcacaaacatgaatcagatgatcaaaatagttatgtagaacacttcaggtaagatgtaaagatatatataccatctggacaggtactgaaatctattgttgatacaagagattttgcatgaccagcatgtgtagttttgaccacttccatcttgaaacctgcaagctgtcaccggcacttattattgttataaaaacaagcacaaccacatgatacactgaaaacaagttgttttgctctggaatgataagatgagtatttccatacaattgaatgctcacttatgtcaaagactatagtgatgccgaattttcatccctaataaattcagcattacagagatgataggacatggcagaaataatcttcaaggcatggcactagaagcagcaagattgatatgtaacgcagtagagacaacagtgtatcaagatattactccatcacacgtgtctatgtaataccaatatcttgattcaaatagactggatgaaaggatacaacagctacagacacacacagcgagagagagagagagagagagagagagagagagagatttaaaatcccttaaagttcaggaacatttcaaacatatgaatcataccaaccagcggaccttgacagataatgtgaactactagagccagagaaccttcaaaatggctcctggcaacaaatggatagcaaagcatgctccagttcaacaggagagatgattcttagggcacaatatgaactcaaacatgaatttatacatagagaagctcatcttggtaagatactgacaacatgaatattgatatggtcctctactacaaacgaattcatttttatggagatggatcaaggaacataataaagaaacagttcgtgccttttcatctacctatgcaaagttagcatcttacttgattactacaaataaaaaggtcaacacgattaggtatatgacttgcatttttatcggtaaccaatgtcaatggtaaataaggaaacatgaaagacactcattgcaacattttttttaaagttatgtaatgactatatgaccatagctaatgctgcaaacatgcttaagagttgatgaggcagacatcacagctctgattataaaataatgcacatgattctattcatctagacataccttgaatataggttccacttttccgtggaaaactttgctagatctaccatgtccagatcgaggattcaagatgacaagtatctttgggggagaccggcatttaacacatggatcaaacatattatcaaatggaatgagttcagatgaatgcttcttgctagatgccatggggtgaggtaatagatttacatagcattgttgatctgcaaaaccattaacccaccgaaaagcctcgtgtggagaagtggataggaaacgtaagtccttttgaatttttctaggcttcataaagcaggaaagtccactggatcttttttcaagagggcatgcatgcacagtgaagtgacggagcccggaatgatatgatacctgcaatgttaaagttgaaaagatcttagaattgctctcacatgatgtggacttgcagtgaaactcagaaacataccaacgcaatttacagaataaagtcaatgagctaaaaactcacagatacaatgtcctcgagcttaaggatattagaaccccataccaaggcttcagtagtgagtctagcatcaaagcaattgctactggaccctgatccagactgttcacctgatgcacttttggctttgttatccaatgtaagcttcccagaacaaatttcataccctaacaaatcagacttctcatcttcaattctgttgtcgtgtgtgcctgccttctctggatccttgatggcatcatcaatatccttttgctttaagaattttgaattgcttgtctccaggaatacaggagaagggttatggtctgctgcagttggagaacgcctgctacttgtgcgacgcagcactttatggattagccctcttggtgaagtaagattctgctcatgatgatcagacttctgaatttccatcttttaagggagcccagtacatgcataacattgggagatgctagatgctatagaaacatgccaataatggcatcactcttataagctcatggaacaccaacttatggctgtgtgcctgcaaaacatatgtaacagaacatcaagcaggtaataatggaacagatctgcgcctaattgattgctgtggcaacatcagtaaccaatgaaagccgcaatggatgagtagcagctactgagtgttcagttaaatcatcctatacatttataagaaattgcctacctaatatgatagtttagctagggatgcaagtggaccagatcaggctgacccattgaccccttctagttcatttgagtgcaaataatactaaatggaccaccaataggtgggagtgatccctagaccattaccatagtacttgaggaataaattataacagatcctacaggtgaatttttctaggtccaccatagccaggagctaccctgcatcaataattcatctctatttgaactatgccagacatacaaatatcgatgtatgaagctgaaacactcaacaccaaccttttaatcaaggacagagatcaagccaagtcaaaccacacagaccaaaagggaaaaaagtatttagaaagctacatagaacaattaatttatagtgccactttgtaaccaacaaaaactattttaaaatgaaaggttccgttgttggcctgtcaaaggtgatgacagaaacttaatgcatatacatatgcatgccattaggtgataataacatgagtaaaacgcatggtcattcaacatgtttaggtgtgtcatataggtcactacttccaaaatgcacatttaggtcactaatgtgagttaaatgagtcatgttctcatctaactatccatgtaagcataccttacacatgacatgccacctaagactgaaaaaattacttctgaaaatgtgcagacctagcaatgtaattgagtggaacaaaaacatagtgaaaataaaagctgctagggtttgatggcaactgagaacttgaactcgtcaaaataggcacatgaaataatttagtttcactaattccgtgtattgccaattagtagtgctctgacaaaggaaaaaatacacaaagagttttctacacatttctagatgcaattttttaatcctatgtggcatgccatgtgtacaaggtatgctcatgtggatagttagatgggtaaatgactcacttaactcacattagtgacttaaatgtgcattttctaagtagagtaaccaatatgacacctaaacaagttgggtgaccctccatgcattttactcattaaacatttttttgacaacctttatagaatttatttataaatatacgcatcataggtccatacaaataaagagtagtaggcattacttatcattttaagagatcccacagtgaacaatagaatttacgatttcatgaagtgggcattcatagcaaactcaactatatgttttatactcaatgaacaaaggaatcaaagggacatctcatgttgttacttttcatacagcatatgaatctgtcttatagtaaacttactcaatggtgcaaaccttactcttatagagttacagtaagatgtctgaaggtgaactacagatgtcggtgtaacttccatcaatcattagggaaattaacttccattctatacaaaattgtacagatatacatgagttattccgattatgaaacaactacacctatagcatctacatgatccttggtttgtgaaaaaacacaagtgatggacactaaatgttcctaaatcttgtgggttaggaacaaatattgctcaaggaaagctatctgctgcattgcccaatgaaaaaacaacaataaaaactatagtacatgaagcacatgaggcgtatcaactggattcatcacccgtccaggacgggaatgaagaaaccagttcagaaatgactcttaaggatctgcaaccaatggatagtggccaaggaaaagactaataagcaaccgaagagaacatcatgttaggtacaaccttggcacagaaaaactgcgtctacctaaccacagaaatcagaaggcaaaagcatcccacagccacagcccacaggactcgcaccacagccctgggcgaaacgccgccgcccaaaccgaattcgcgcgccttccagagcaggcacgccgaggaggaggaggagggcactcaccgatcggatcgagccggacggaggccgaggccacccgaagcctccccaccgccgcgggcgctccgccccaccgcaaaatccccgcgccaccgagctcgattcggcggcgaaaccctagcttggtcgaagcaaacggagagagagagagagagacggagcgcgtagccggtggaggaaggaaggaagaggaggggggaaatttattaattaacggagagagacagcaaggcaacgacgacgaggaggacgaaggtatagtggggggagctgctttggtttgcttttaatccccgattagactgtggggattagctgctaatcgtgccatttcctgcgtgctaattatggcacgtagcgtgtcttccacgaagagacgcaggaaaggaaaagggggcggacgcctgctttctctttggattttatcggcacgacccccgcggccgcacgatgggaatttccgacagcttttttatttgggtagattcgtgttattataatttttgtggttttgttattataatttttgtggtttggggaaaaaaaacattcttactgtttagtactctgtactgtttttgagtggttatttcgattcatgtcattataatttcacctttattaaaaatacgctaatttttagatcatattaccctcatattcttccttcatcctctactctctttcatattcatcttctccaccgctagatctgacggagctgatgtcgttgaatggtagctctaagcagtatgtggtgggaatagggcagcgttgttttccctcgttggttgaccctgctcattgacctatttgcatgttcacacctcgaagcccacaaccctcacctgcacgaggagcttcccaactcacagtccaaaccccaagaaggcactcgggggatccactagttctagagcggccgccaccgcggtggagctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39626 - DNA, 3862 bp, Oryza sativa
acaactccactccagacccaactcctgaagctaaatttatgagttggagctgtatcaaacagacccaaagtattgacaatctggctaagcgcctatcaacgaaaagaaacacagatgctttgaaaggttttttttttaaaaaaaaaagttttcaggggtcaatcccaagtgtcctaatattgctacagattgatagagctaaccacaaggtctaatggaaactttgcttccgaatcagaataggacatatacactttccgatgtactataaacttactacaaaagaaaaaaagcggtgaaaaaaaaaggtactaccctccgtttcatattataagactttctaacattgtacatatttatatatgtgtgacacacacacacacacacacacacacacacacacatatatatatatatatatatatatatatatatatatatatatatatatatatatatatatatatatatatatataaaagtatgtatgtatgtatgtatatatgtatagattcattaatatccatatgaatgtgggtaatgctagaaagtcttataatatgaaacggagggagtatgtggtgagcgcgtttgcccatcagacttttcattataaattgtgtgtccattccacaccgcttcagatagattttggagggattcggttcaggtgcagtagctagtgtgatattgtgactgcaagttacacagtcacaccagcaccactagatttgaaacatatggcccagatgcattagaatactgtagcaaagtactgtagcgttgctgcaagaactagtgctgattcactgtagcaaacgatttggatcattggatcaagaaatagagggatcagattatgcgcagtagcaataacaactgcactggatctcaatccatttttgagatatctaggagttttgtgcattttcattgttgatcaaaatccaaagtcttttattctactaccctcgagaaggaggagatgtaaattagatctattggatcaatagacccgatgaactccgagaaaatccattgttaaatggcctataaaacgaaaatatgacatcgtgtaccgagggatattaagtttagagtaacaccaataaactatttttttctcgatccgcaactaatgttgatggtattgttgtaattccatctatgccttcccagactacattagaaaatactcgttttagaccttctcagaagaatctttttacctgtgacccttaaatggcgtattaactttttattagtttggtgttaaagcctcttttaaatggtgcatatgagccttaggatacatatccaaacattttaggtacatgcaaaaaagtagttaggtgttgtatgctttagagcaagtctaatagtatagctcactactagctccaaatcatgtacagccaatatagtagccaattcatataatagttgcttactatatactattaatgcatagtctcacctgtaatatatacgttatgtttttgagtccatgctgtagctagctacagatctgtagcccgctactcttctctctcttctttatctctttaaaatatatttatagctagtttatagcttgctattgtacctgctcttacatgagttttggcatctatcctatgtgaatggctagaattacagcctacagcccccaatgctccaagaatttgagtcacaattattttcccttttctcctctccatgtggtttgtgcaaaggcaactattttgtccttcttgtggtgatgtttggacacgtggcatacttgaatagaggaataaagtttatcaagatatggatgctatggtcctcaaataaaagataggaattcctcacaaaaaacaggagaacaaaaatagacatggttggctgacattaaacctccaaattgaaaaataccgccaaaaaagaagccatggatgaagcagattatactatcaaactgctcatacgccttttgcacatttgtttcagatgacacttgtatcaccattaaagcagtattgaccaaacaaaaacaggccttatttagattcaatttttttttccaaaaatgtcacatcgaatgtttgaacacatgcacagagcattaaatgtggacgaaaaaaaaccaattgcacagtttgcatgtaaattacgagacaaatcttttgagcctaattacgtcattatttgacaatgtaatgctacagtaaatatttactaatgacggattaattagacttaataaattcgtcttgtagtttacaggcggaatctataatttattttattattagattatatttaatactttaaatataaatatgtatccgaatatacttaaaaaaattagccaagaaactaaacatggccacagttaagcagagtataggagtacagttaagcagagtataggagtaatcacaacataggaacaatgattgatgggatggatcacagaatatgttctacaaggtcccaaaagaatgaaaatgaaattcctttgatcacaagttctaaacacatggcaggacattagtaagcatcctaatagcttaatgtatagatcgccacacaaagatattcttttttaaaaaagcatatgatgcacatacactacaagtcaaaactatttcgtagaacagtggtctaccactaaacactcaaagcccaccatcctcctccacgtgcaggtttcaaaccgctaacatgggtgagtgaatctgtattcaaattcaaataaatatatttaaaataccccacaccgaacgaagatttactcccatttacacctaattaggtggtggttggatccaggaacttaactttagtctctatagttagacactaatttagagtattaaatataggctacttacaaaactaattacataaatgaaagctaatttacgagacaatttttttaagcctaattaatccataattagggaatatttactgtagcatcacataggctaatcatagattaattaggcttaaatgattcgtctcgcgaattagtccaagattatggatgggttttattaatagtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaatgcgcaagccccaccacgccgcgcagcctccgccgccgccgccgctcccgctcccgctcccgctcccgccgcggaactgcccgctcgcgaccgcggtcctggcgctcctctccgtgctcctcgccacggcgctgtgggtcctcctcgtgctgtccccggcgtcccacgcgaggggcccagccgcggggctgtcggatgcggcggacgcggaggcgtttgcggtggcgggcggaggaggcggaggcggcggggagggcgcggaggccccgctgtcgctcggccacatcgtgttcgggatcgcgggctccgcgcacctctggccgcgccgccgggagtacgtccggatgtggtgggacccggccgccatgcgcggg

SEQ ID NO: 39627 - DNA, 9411 bp, Oryza sativa
agccacagtatggcgttcgggggcgacggcgtcgcgctcagcctccccctcgccacggcgctcgcgcggacgctcgacgtctgcatcgagaggtaccccaagctgtacggaagtgacgatcgcctccatgcttgcatcaccgagctcggagtgcccctctcccgcgagtacggattccatcaggtatgagcttatttttcaacattttgtggccattcaacagaaatgtgggttgggtattaacagcgcttagattattgagtggtcttatgaaatgttattcgcctcagcaattggagcacttattctgttctgctttgtacgatctgctgatagactagttaccagtgacacagtgacttgaattcagggactatccactctctcctgatcccatgcatgaatttagtgcgaaatagcatgctgtctatgctcacggaaattcgggggattgctaatgaactagcccaatttagaatttgcgttagatcttgggaggcatgcatattgatccactctttggaaccttaccatttctgtgatgcttgattcattatggcagaaaggaagtgtagcctgtctgctgttgtgccaacctagctggctgttatatgttcaatcagaatacatgaacaatagtagtagggtcttgccagagtggttatgttagattgatagtgaaaggaagtttggtagtacttgaatgttacctttctttgggctcttttatggccagcagaagtttttgcaagaacttgcctgcttgctttatagtactattgtaatttctgtcaaataggtaccagcatgctgcatgtgtttgaaaatatgataataagtgattagcaagttcttttttctgtttgcacattaacaagtcatatttacttttttttattaatcgtgtgtatggagaactaaactctactctcttaatcttacttttgtccctttgcattgtaatcagtgggatatcagaggcaatgcccatggtatattggctgctcatccaattgctcctttcatcagtatccaccatctggagcttgtcgatcctatataccctggtttgaactctcttgagagtttggagctctttacaaaggctatgaaaacagaacccatgagcttcttgcagcgctcgatttgttatgataaaaggcagaagtatacatttgcagtctctttgggttatgttgttcaagtgtacccctatgttcttcttcctcgtgaattggagcgatccgagcggacttacattgcatataataggatgagtcagcgaactgaatttgattttgacactaaggatattcagaaatcattgtgcaagaaacctatattatttttcttgaaggatgtttggaaggatggaaacataactaggggttcttatatacgtgcaagtgttcgggatgacctaaaaaacaaagtgttttgcttcaggtcaccccctttacctgacatagacgagattcaagtttctgcatccccattaagcaaaagatggcatctggtttgttctaatattcctaacaatatatcatatcttgtttctacatttacattggctaattgtcgtaccactgatataggcaccaagaaggttatgcagtgcgcttaaaggatctattaatggcactttgtttatgtttgttcggcaatgtggacgggggacatttggctcagcttctgattctctataattgatggaaagcagaggtgtatattttctgttcagatgatacctggaagatgtagttaccatcctacattctttgaatcgagtgttgtgggggctctttttctgcctcgagcacttggcagttaccaactgcttgttatacttggtagttgttgaaggtagtttctgtatcttctgaatagtgacattagaaaatagttttaatcgttgaccgtaacaattgggattcatttttgatgatttttaaggtgcttctaaaattatgatggtttctcaggctagtaccattccctatttgacgattgatgacctgtaatatatctaatgtaggccttttcaggttttcattcactttgtactatatttcatcaattggaaaaaaacccaatcatgcatgggctatactaagtttaaacataggtctcagacataaatatggaccttacttattacataaaaaatggcatcatgcttgtccatacctactttgagttgcaaattaattccatgtgctatgtatgcttatcatggtgttgtcttttgatatggatgcaagaggacccttctaggagatcataaccccccctcccccccccctattttcattagtagaaatgagcattacaaagtttctgaccgtcagtattatgattaattgatcaaaatttgatactttcttcttgtcatgtaccattttgttattaaaggatatagtttctaactttgtttaggcatcagagcaatcaaatcattgctaatatacaaaaaggaattcagaaggatatgcagatatacaaacagttgaaaaatgacagggaaaaaaatatgcctgctgattggagagagattttttttgttgttaaaaataagttagcacacaggcgtacgattcaaaattaattgtggtctaatggctgagtcgatgagcgaaaatacctagttgcttcgcacgatgaatccagttttctacgtcttgcatacatcttatgagaaaataatcattgactgacatggttgtcaactattatgttccagttacgaggatctttttgcagaaagctctgaaaatttaagttgcatttgccattttagttatttgaaggaaaaaaaactgttgtgtctagtcataaactgccttgagcttcatttttcctaatttttataaagaatgttggagtgggatgcttagcttccgacaatcttttacagtgtcagtgtgctgtgtgcggtactctgtttcgacaaccttaatgcttatttaagagtaactggcttactggcatatgcagattgatatttttcatttcccttgcattttgttttcagtatccggtgctttatctgtagccttttttcaacactctgttctctacttttatgtcgccacatgatgtgctttaatcaatgctttatgctgtggtcacaaatgttctaacttttgagcaaagtttcagtgctgtattcattcacttcaatagcaagattaatctatcatggtacattgcaaaagttgccagattgacttggtgttctgaaattcttttgtagcagtttgttaatagaagaatctgctgaggaacaaagctgaaaaagaaatactggtggctttttttgtggaatcttcaagctactcgtggatgtacgatacttgtggacggagactgggtgaacggagtgtcaccctttgattagctgcattagtctgactgaaacaactttccggcttcattctttgagacccgtgtactaaccttgatggattctcagtcgaaatgtgaaatcactaaatcaggtaagaacagcactccattagcattgtattggagggctgtaaacctttcccgataccttgtttagaactgtaaatcagtgtgaactgtgaagcgccataaccatgaaagagattccattcaatctttattcctttccagttcattctgaaagccgttatctgctatgacgcctaaatttacttttgtgtccattttagtcctactccttttgatatctgctttatactatcaaagtcttaccacagctaaacatgttacctttattggggcatgtctaaagttgaggatttaaatggggcaaatccgcaaatgcacatgtaccttttccagatcaattaccttaagctatatgccatatcctttctgtagtatatccttgctgttctcgtgtaagtcgaatttctaacgtgtttttccttttcaattgacttccctgatttagtcacggttcaatccagtcttgctgctcattattctacgaatctcccgtatgtacttatggtacactgtttgctgctaaattaacatatgaactgctatgctgtatctgtttgctgctaaaataacatctggacttatatgctgtgtggaagtgattcatcttccttatcaaaaaggaaaataaaatgtgtatgtctgtgatgtgctctccacggtcggcaagcagatatttaacctcctagttctgttcgttgttattttcagtacatgatgtttcctgagtatcaacaatatttttcctcttattttttcccctgaggtgggactatcaaccatattttacccgttgctaatggctcaagtggttggtggttacttgtcaagggcacaaaacatggtacttgactactcctaattctcaagtaacaggtttgttcagatactgcatcgctgcttttctgtttactctgcaaattgcgatcctcttattacaacttgtgtagcaactcttgtgctgtgcaaaggcaacactacgtactgcgctagtacatggtccaatcagggcccaagcccttgaggcccatcttagcccatgtggtttgagctttgccatgtgctccctgagacagtaattagagttaagttagcaccctagtgggcctttttcttaattgtccatgagctttggcatccattatcgaaatgatatgaacataagaggatttgaataggtgggaaggaggttaaacatcttcccactacttgatcattggccctattctttccttggtgcatttgtaaagtccaaatataaattttgatgtactaacaactatgctttccaactgtcaactgttaggcgctgactttttgtagtttaagactggagatcagattcggcgtatggtcgcatggtctcgtgggacatttcatatcctcgcaaagctagcttaaatgttccatcatggggtcatctgtcaacgcattttgcatgttgattttgatatttcatatcttcgcaaagcttatcggacgtagctaaaatttaaattttaaaacttaaatttaaaattgattttgatgctttttatcgtagtttattttcaacattagcttttaagtcgctaaaatatatatatgtagaagttatatataaaattagtttatatttgctaatcagcgttacgccttataataagtggtatgtgaaaggcaaaactatcacactgggactgaggtgctctcctctaatatcaactctgttaagtttcgaattccgtgaaccaaaattcttttgtcagcttccaccaaaaaatgtcctcttatttcttctcttgaatataagagcctggtctctataggtgaagtacagcagttttaccaactactatagtctggttgacacagtatttttttttcctgatcatgcatttacgtgatataggcccatattaactgttactcattactgttgcgagcaaaacctaatttcagatcaaggaccacacgagtgtctctgactttcagattcagtgtgaaaaattccttgtatttattccgtggacttgcaggctgttactttgtcttttggtgttcatccagcccatgttttgtcaactctctacctaacttgcttcctcaatcttttcctaccctctttctactgtgttttgccccagtaggtaaccaattccaatgtaaaaaagagaaaaggagaaatgtcttcagtggcgtgcagccagggtagtatagttgtgtggttaaaatttggtttgacatctctggctctgaccagcaacagcatcatctttgctcctaatgaattctaatgaaattgctcaattattaccaggatttaagaaaaacctacctgcatgcatgatctaacctctagaaaggagtccttttgccttctactaatccatttctaatttttctttctgcgaaatgcgatccatcattccatctcatcgatcccaacattttgcaaccgatatacaaaacagtacagtgggaattgtgggaaaggtgagaccaactgtgcagtaaggcgagcagttcggttgcacgctatctgaaacatgttttgtgtgaaggctaggcggttggaactaacatcatatcgctggcaggcagcgtgcgtgcgtgtgtgtgaggatgaacaaagagacgatgcgtgccgcaaaggaaaagcgcatgcaaattgccttcgttttcgcgtcatcccgcccggtgcatggctggcacgcgccgccgtaagcaaagctacgccgagcatgggagtcgccgagctgcggtggcacgtacgtggacctattccaaacaacttcaccgttttgctcttcagcttatcagccgtaattaaaatttaaaattatcagacttaatttaagggttgattttcaatttttttcgtcgttgtttatttttagtttagagcttttaaatcactaaaaacatatataaaacgctttacttatactatatataataaaccttacggtttaaaatctgctgtaggcgaaactatgggaatgaaaaatgtttctcaataactaaaccagccacttgtcactttgatcattcgttcacagatcacaggataagttgactaagttcagaaaaccgactgcaaaatttctcccatggcacgagctctctatctctctgcccccaatttggcgtagaaaagaggtcaaaattacgtagaaagctctttctctgtttctcataagtgagctttgagcttaacgtcgaaacgtccaagtgttcaactctccaagacctcgatgatgctctctgttaagaggccaaaattacacgtcagatgagctgcctagtgtggccgtgtccgtctgcaactctgtttgcttctcccattgggtaaaaacccaattattgatcttgtgtgctcaactgctcatcagaaggtggcatctgactatttgtaccttctgcaaattcatccacttctgctgcccttttcacatctcctaactaattgccgtgtacttacacgctgatgccatttatttcctcagcttcatccacctctcactgacccattacgtacatcaatcatcagatcacacagagatactcctatactcctccagaatgtcagtgtgctacagtacgtgtaatttcagaaacacggattcagcagagtggtttagccaataattgtgcagagtttgcttgcgtgtaatacaaaccaatccaaaatgtgcatcaaaagcttggagttaaaactacctacccatcttcacctaatccccatccttattttacgagtccttctgtactactaccacttaattaccacgagtcattttattcgttatcagtagcaatcaccaacatctcatccgctgttcatctttgactcctgaaagctgaaaaaacatactccgtacagtactctactagttttttctaaaaaaaaaaaaccatatactcgcactggaagcagtaaattgactggaattcctcactccagattacgtgaagaaccgagatatttcacgcagtggatttctcccggtactgatcctatctctgaaccgtactactgcaaagcctgcagagccgtgtctgaattctgacactgacgaggttgcagatatctgaattttttttttgggtgctgaaagctgcggccactacggacactgatggttacgtgaggccgccggcgccgaagctgaatatatgcagatgtggccgtgcccttactaatggcactttaataaccagccgcactgttagaaagaagcaagcaggacagtgctggctctaactcttaactaactgaattaacttcacatgtgactttgcactaccgtatcttatcttccatgaaagtttttgcaagtgtagtttccagtgctggacgatttaagcctttcagaagatcagatgctgcatgtcaaatatggtaacatggtgtccatctccgtacatttttctcatgcagaaaaaaagaatgaaaagaagaatgaaagaaaggaacattgcgtgcatagggatcaaacattgctgcatgctgagatgagatggatcctgtagatgtagctagcaatggacaggtaaaatttggccatcacagtgtttgatgcttgatctgatctgatctgatccgatctgcttctccagaatgcaccagccgtttgcatggacgcgtctctgtaaccaggtgccagccaagtcactactgtcaagagtcagcatctgtaattctcctcttctctgatctgtccctccctgtggcctgcgtgcgtctctccatccccttcatcacctctctgtctcgcctccacgaccccgttcttttcggctacttcacagttattgttacgggttactcatttcacgtctctaaaaactcatcttctaaaaaaatagagaacatttttaattgtttatatcatatcgcttgttataagttatccgcttactatatttaatttatatttataattgtatagttaatctgctataataatttggtcaataatctgttgtagttttggtcgtgaaaacgggagaaatcgcaacttataattgtatatagataattcactattgggacgcaggctattcatctaatttctctaaaaattcctttttttctaaaagaaaagaataatccttttactgcacaacatcacttatcctaagttatcagttattaaaatatttaattatttactatcataattcagtggataatctgtttcaagcaggtcgtgacaacgagagaaagcaaacagccaatagctcggccgcgggcgtccctttctcgtgcatggctgcaacctgacggggaacggaaacgccgagcacttccgcgcgcggcgtggaaggaagccgcgcgcgcgcgcgtgcgacttggcgaggggagagccacatgtgtgcgtgaggagacagttaggcaaagctgggcacttaacagtgctgacactgccgtgtgctttgacactttgacagtgaaatccccttgagtttagttcttttgctcgtctcccggtggcatcattgctgtgctgggggctcaaaaaggagagagagatggagagggtgactgtgactctaggttacaccttcaccttggttaaccttgtaaacttgttttgtttagatttaaccatggttgcaaaaaataggggtatttgcttttccacttgcaagcttgcgtgaggaatccttttatttaggtttaaccatggttgcggaaattgggtgtgttccttttccaccggcaagtcgtgtatgcgtgcagaatcttttgtatttaggtttaactattgttgcggaaattggaggtgtttcctttcacactggcagacgtgcatgcgagatcttatgaccgtgataatttgataccataacgtttaatttgggcggaggtgcttcttgtgcttcttacttaattacgagctcattttcggattcgtcctcgatttatcaaga

SEQ ID NO: 39628 - DNA, 7225 bp, Oryza sativa
cccccttagtctaggatacttcttgtaaacgatggaattacttcctagtagtatttgcgatctcaattttggccttttgtcctcgattcatccagaaggatcaactggaccacacgcttagttttcaaatagtggagtacaatttgcatgtacagagattcaaaacaagaaaaggggagcatgtacaggaagtgcgagtctaaaaaatgtactgaattcgaacaggacagagtgacaaggagagggaatggcttgaaatggcaatgaaaaggccaggtcaaattggcaatcacaccggccagaaaacctagtcaaaacgtcattgaaaaagagaaaaaaaactgaggcgttcaacctgttcatgcacgagccgttcgttcggttcattcaccttttcacagcggtcgctagctgacggcatgtcggctcgcttgtgttactactacttgattaattgacagctgcatgccataaaacccaattacaattagcagtggtatattttttttcagataaggacaattagaagtagtagtaaaagaccaattctttctttgttaattacgcgtatcaatggatggccttttccatgtgcagcagctgcagtggtatgatcactgtcaatttatgggccggggttgagcagtatatttgacttcaaaagatgggaggccattttaatcaatcacctgttctaacaacctttaactagacgtgtttggtttaatttcaccgttatttctagaatgaggtttgtgtccggttgttgatacggcgcacgagtttgaacagtgacatgagagttgaagtactgctggtggtaaatgctaccaaaattagtccgacgtgaccaattcaattattacttctctagtttctacacttttgtgccattggtcaaagaagtaatactcgtggatgcacacactataaagatatatatcattctcaatgttccggtatattctttagatagcacttttaagaaaaaaaactttttaatcacaaataaaaatatctataaatttcaagcattaatttaatgagaatgatactggtacattctgtagttttatgatactctactttaaatctgtaattttgtaatatattttgtgttaaacctatagttttctgatatatcatctttaatctataattttgtgctaatttggtcaatatatctataactttgtgaaattacttttttatataagaaaatggtgaaaagtggcacattatggggttgggttttaatatgcatgtgatgtgaatggttcgacttctctggtttggttgaacttttgggtgagtttcatttttttttgtgagaaaagctttggatgaacttattgttgcatacaacttaattagtaaataatatcagtaaacatttcactagtcaaatttatgatatatcggactacaaaatgcagaacaaaacatcaactttgttttttagcatgggtgcgacggatgaaagtgaaacaacgttagaaaactgggagtataactgttgctaacaagtggacagcgtacggacgaaagggtcagcagtggtcaaattaaccgattactgtagctagccgtcaaaccaccccaaatttgaccgccgaaaaatctaaccattccctctgaccaccatgcatgtacgtaaatacgtgcacacaccatccccgaaacacatccaaaagccgaccttttcatcgaaatgaatagcgatcggtcgagtgagacgcgcgcgctacagtgcaagtacttcgtagcttttttcttaccgtcggttactgtggtatacgtataccgggcacatactggtactactgagttggagtataattttacatattgttttcatactatattcactgttaccgtgcttatcttaatttggctagggtaaggatttgcattcttgatgaaaaccgatctggatttcacataatccagacttctctaacgaggtaaaaaaacaaaaatcgctttttcatgttaaattcaaaaaattcaagctggactataaattttcgacaaaaaattatcgatttcatctctttttcatttttatcaatgtctttggtgaattccaaagatacacctcgtgagcggtttttatccagtatcaggatcgtgaaccctattccctctcccccgattgtccccggtaataaggcaaactaagagcaggtacaatagcaggctataagctagctataaacatatttaaaggagataaaagagtagagagaagagcagtgggctatagatttgtagccagctgtagcacggactcctagacacaatgtgtatatgacaggtggaaccaggtattaatagtatagtatgtaactattgtatgaattggctactaaattgactatagataatttataatccctccgtttcataatgtaaatcattctagcattttctatattcatattgatgttaaatgaatctagacatatatatctatttatattcattaacattaatatgaatgtagaaaatgctaaaatgatttacattgtaaaacggaggaagtagccggtagttggctacactattaaacttgctctaaccgagcgcaaagcctggaagaaaaaaaaaacaccgagccatcgctcggtccgcatccgcgcgcaagtgtgggagcagccgcggccgcccgcccgcccgcccgcgcgcgcgcgtgtgccgcatgggcaaattttccctctcacccgcacgtatgcacgcatgcgcgcggcgtttgcgtgtggttgcgtcgcgggagacggcgccccgcgcccgatcgatcgatcgaacgagcccacgcgccgcgtgcgcgtgagccctcgcacgcaacacatgaagctagtcgatcgatcgagccgccgtttcgttagccgacacgcttcgctcgatcggcagctggcggctcgcggaaaaggcgagacgaaatcacgctgcaacttgccgccggatatgcacgcattgcatgcgtatccggtcaaaactcaacggggatccacagctagtttatttcaagtctggactacttggttcatcacatcgaccaatctcggtcagcctcacagttgatttatcgctggtcgtatactctgctctctttttttttcaaccctaaaatgcacgcactcgtgtgaaatgaaatgaaatgatacacgagatcgatgtatcgatcggtatcttgttgccagaagctaacgagatgatatgtacgccagcagggtttacattaccatcggtaaccgcgcggttatcggtcttaacgtgggggtacggtaataaaaaaactgcgataacctccttaaattcaaataaaattttaaaataatttaaatttttaataaattttacatggtttcgtacggtttgtcacggttatcggggtaactgtgcttaccgccagggcgcggtaaccctgacccccggtgttttgggaaaccctgctagaaacaggttgggaatctcaacatccgataaacgagatcgatatatcggtcggtatcatccggtgctgcacgttgcaaactcaaactacgggagtcaaaaagtttcgttgcgaaagtgagcagatgcagcaccacatctgtgtatactccagttgcttcctcagcataaacatctctcattctttgacgggaaagcaactagttagcaagcatacatataaacatctctcactctcacgggcattgggatgcacacgcagtagaccaagcagcgacccgactctgatttttgtactagtagcgcctgtagacagcaacgtataatagtacgacgtatgttgccatttgtaatacactaagctgcagcccaccgcgcatattattcccccggacaagttgctacttaacaaaatgacagggaaggaataacatactttgcatatgtacacaaaagggtgttcctgttcatggaacaagagctcgtactgccgctgcagcggcaacccctgtcgtgtggtggcgctcggctaataaaccaatccccaatcccccgagcgaatagaatttgtgattaattcttcggtgtccctctctcctctggtttgatgtgaaatcctctgtcacgttgccaattggaaagaggtagctgtacgtagccgaagtccccgaggcggtttggtggtggtgtggtgtggttggtcgatgcgcgcggccgcgttcgagtgcgtgcaccgtgcgccgccgcggggtgggtgattgggtggctatggttactcagtgttcagttccattcaaactcccaaaaatttcatcacatcaaatatttaaatatatacatagagtattaaatatggatagaaaaaaaaaccaattagaaagtttgcatgtaaattacgagacgaatcttttgagcctaattgcaacatgatttgataatgtgatgctacagtaaatatttactaatgacgaattaattaaacttaataaattcgtctcgcagtttacaggtgaaatttataatttgttttattattagtctatgtttaatactttaaacgtgtgtatgtatatttaaaaagttttaggacacgaactaatcactgccggcttttgcaggcgcgagatgcgcgcgccgccggatgaaaggtgtggtgtgggtgtgtgggtggtcggagggaaagctgcaaaagccggcaggagcactgcggtgcgggcggagatggacgtggtacgtcatgctgctggccacagtggtgcatgcctagacctgcggcttcctgggccactcgtactagctcctggggagagtagcttaagccagatagtgggtaatcagtggaagtgctagaccttggccattccaaataaggagattcggttaactaagtgctttttactctagtattataaaaactaaatatattgttaccggtattttgttacctcatccgtatttgagttcgttttaaagttcgttcgcttttaaaaatacagatccgtatttaagtcggattttaaattcatttgtttttagaaataaaaaagaatcatataagaaatctctttaaaatactccctccatccacaaaagttagaaatatttcacatttgagtttttccaaataagttattcctatttgtagtctttatgcattcaagacttaaataaagagataaattaaatgtttgattagaacccaaggagtcatataaatactcattggttgcatgctttcattcactcgttgaatttgtaacatccaagatgatttaatttctccttggtcttgatgacaaaagtaataggtataacttttgtggatggagggagtaactcgcaagctaacttgagatgaaagtcggattcctaattgcagctcatgattttctaaaaaaaaatatctaagcgaattcttacagtgaatttcatcatagctaaaccgtataataataataagattaaaatagcattcacctgttgcaacacacggatattttttttatctttttaaaaatataaaatatttgtatttgatcggttcttaaatttgaagcagagtatcacgtcgatttggatagcttcacatagaattttcagctcctcaaacagttcatattgttacctaggttctgacaatctatagttgtagtcagaagctgaaaaacaaaattctccgtattctcgaagttggctaccaaccagcagattattagaatcttaaggtccccaaacagaaccgatcatctagattcatgcacttataaaatataaggactaaaatcttggtttaatgtatcacgagatgtataaagtacaaacaatgtagctcgggtgctgacatggttgtccacaataacgagaattttgtatttacacctattcaatacaatatgtcccaaaatccggctttcatcactcccaagttgactcctaacacacatgtgggagaggtggcgaagagatgacgattagagtggcatctattgtcggagataggaggtccccgaaaaccgaggtaagatggcaccatagtgaaagggtgatcccacgaggggggaaggctaatgcgcgtacgcgccagcaaatttagctggcgcacacggcagttggccccctccccggtttcagcgtgcttttctttctcacattcctttttacgattttagtgcccagatccgggcacgtttttcctttttttggtttctttctattgttttttaattcttcagacacctctttacaaatgtagagttgaaagtatttaattttgacttgaaagttttcaaattttgtgttgaaagtttttatatttgagttgaatgttttcaaattttgagttgaaagtttttaaatttgacttgaaagttttcaaatctaggttgaaagttttcaaatttgggttgaaagttttaaatttgacttgaaagttttcaaatctgggttgaaagtttttaaatttgacttgaaagttttcaaatttgggctgaaagtttatcaaatttgagatgaaaagttgaaagttttcaaaatttgacttttaaaaattcaaatttcaagttgaaagttttcaaatttgggttgaaagttttcaaatttgtgttgaaagttttcagaatttgacttcacgcataaatttcttttcaatctgttacttaaaaaaaaatcttatcttcattatctaaaactaatggatttttttacatgctaaaactaacggattagttactagacgcgctatggaaaaaatcccgaaaaaaatctaaccgcgccgacgcgcggtgccgcgcatacgcgtgggtcttgtgggccggaagtacacgtcggcgacgcatatgcgccaattaggaattatgtcccacgagccatgcacgtgtgatcgtcgccgtgaaggcaaacaatggaacatcatattgcacgaggattacggcgaaaataacaccacactgaacttacaatattaaccctctctatgtgacgtggtttttctcggttctagggactatccaccaatgacagtcgcagctatcctcgttaccatttcttcgcctcctctcccactggcatggtgggagttgatttgggaggggaatattgtactggaggggctgaatgtaaaatttccactggatggccaaattagtttctaagtttgtgttatctgtactttgagctgagtgatacattaaatcaaaattaaagacatagatgtgcattttaaaatccataaatgtagatagtactctactccaaatttaaagactagcca

SEQ ID NO: 39629 - DNA, 3228 bp, Oryza sativa
gtcttgcccatacattacttaagccggggcataataattggggtggttaacttaatttaatcaccaagattttttgcctaatcattaaaaaaaagggccacatggccatttattacctggaaagggagggattaacccacaacatgccaatgcatggccatttttatactcctctgcccctgaaccattggctcgcggataccaccaacgcggctgacatgacacgtgggcccatgcgcatgtgggccccacatgtcagtggcgtaagcgtgtgggccacctagtggggttgggtctgggagtgggggggtgttgggggggggggggggtccgcgttaatcgccgggcacgttctgcacctctttcgctctccggaagggcccacattacagctgttataatgtggtcttgtctgcctcctcctctcactcctactactactcctttaattattatttttttgtttttctccaattctcctaactaattttgttcccacatgtaaacttttttttttggttttttggggatttaattttgcctttgtaatgatttttttggctgttgctgatgctgctgcaaagtagtaaaaccaatcttggtgtaattgtttttctgctgccccttggatcctccaatggtccttggtttagtactggtcatcagtgcaaacaattgcttctaactcagatgaattttatatttttcatctcaaaagaaaaggtattgatgagagtagaaatggtgaggtaaaataaaaagggtaattttgaggataatttatgactaaatttccagtgtgaaaaatactcctccagcttagtacagtagatcatgaatcacagaatccaatatattcccccatggggattgaggtagaggagtttttgtagaggtatttgtgctcctctcccttttattacaagcctccacctttctctctcatcccacagtttcctacccctcctttcttcttcaccagtttgtctctctctctctctctctctctctctctctctctctctgtcctttcggttttaactagcattaggcaggtggttaggaggggaggtaaagctcaaagctccctcccctgacagcgcagcatcttgtttgttttatctcccacatcatctccctcatcatcatcatcatcttctcttcttgcaagcacccacaacaacacaaactctctttcttcatctttctctctcctcctcctctctttgttgtactctactcaacatttctcaactttcacttcttcttcttcttcttcctttctctcttcacagctatcatattctcctcctgcttgctgctgctgctgctggctgtttctctctcatccatccaccctattatttattcaaggctaagtgatggtatcttaattcttttttcctctctgcctcctcttcttcctcctcctctctctctcccttgctgttgcaggagtataatttttatttttgccaggcttcttcctgtactggtgtttccttgtttcctccctttcttgtgcttcttcttcttcctcatcttcttttttttttgggttttctctctcctgccatccttttcacctctactagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggtaaaaaattcaacgccatgagcccccctcaagaattgctccgccgtcgatctcgccgccatggctgaattctcgtcggcgaaatgctgcatgaaatctcggcggcctccagaagcagtagcctggtgtgatttttggttaggctcagttaattaattaccggctaaaataaacacctccttttcactttttttcccttaaccatcgttcacgagcacagtgactttttttccattttaaaataatacgggtatcactctccttcctcacctttccaaagaatttttttttcatggccatctcttatcaagatggtggtacaatacaacacacgcccatacgcttcagatccgaaaggcatcaattccaattttgcaagcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgtgagggttacagcttaatttccttcaaattttggctcgccattgacgagctcgagcttaagcttcttcttcttcgtgttgtttttaatggcggcgtggtggtgggttgggtgcaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtctgtggc

SEQ ID NO: 39630 - DNA, 5107 bp, Oryza sativa
gtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaaggtaagctaagctacgtgcatccatccgtgtgcatttccccgtgtggccgtagcgaattggcgcgtacacatgtggtacgctgctgttcgtttttggtgatccaatgctgattgcgtaacgctgcgcatttaaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttataccagcattctttctaaataagtgtgatgctctttgtctactttatttatttttagagaaaagaaggattagaggcagatgcaacgatttaaattacatgtgcagctctggttatactctaggatccaatgcttaatttattgtaaactttttagttttagatcccataaggatcgatctcgatctttcaaatattaatataaattgctatgccacgattagtataagcatggggagatagccctcacatgccaaagattagtatagcacaaggaaggcttgatatatagggtataaaatttaaagcaagtaattatcaaattataaccgaggtaaactcattaaaataactaggtagcatccaagctagatgtcacggtatgttgtcatatgcatgcatgcatgtaaataaaaaaaatgcctgcaaaaatttaggtagatcaaaagataaaattcggtatgatcttgatcaacttaaattgccagcacaaaatcaactagtagaaggatcttgtgtagatcgccctatcatgacaacttcgagtgctagctaagagagcatgtgctacaaagtgacacttgattaattatcacttgcacaaattcttgctacttaaaccacacttttatacacactatgctactgtatactactcccagtagcactagtcctgtaattaaaattgtgctcctagtacgtgagataccctaccactgtagttttaggcttggatgcctcggagttagagccagcagggggggggggggggttgcctagctatagtgagtatggctgatcctttggcaagcatacaaaattagttttggggtcaggctggcttggctgtggctggggatccgtataaaaacggttgaagtgtggggtgatgtgtctgccataaaaggttaaaaagaatggagctgtgggattgatgcctcctgtttaaattatgggagaacgtggaggttgcagggcgcgcgctcgttcaccttgctgcccttcgtagctctagctctactccctcggtcccaaaacaaaaaataacttaaaagaaaatataactttttctcctaatacaacgaatttgaatagagggttgtccaaattcattgtaccaaaaagaatcacatctagactgagggttgtccaaattcgttgtatcagaaagggtcacatctcatactatgttaagttttttttggacggagggagtatgtagtagtagcagcatcatcagttctaaggttgtaccagaaagggtcacatctcatatgttaagtttttttttggacggagggagtatgtagtagtagcagcatcatcagttctaaggtgggaataataattttaggatttttgatatgaaatggaatagtttcatattctaaatacaggagttcgatctcaggattttaaagaatttttgttagagaggtaaaaattttcgtattctaagagggattcggagagggatggagctaattctaagatggtggctcgcgtacgtgccatgtacctaggagtacattatatttgtggatttgaatgcaacatttccactattttcttttgtgaagggaaacactaggagggccgtataatacactgtcaagatagtgcactatgcatacacgttgcaataatttagtgataaatctatccattatcttaaaagaagagtgataaatttattatataagtttatcgtgtttgataatgtttgctatcttatgacaatagatttacatgagctacatctacactctaattccctagtacacactattcatgcatcttttctcacactcttcatagcttcttgggcaattggcatgagaagggagagcttggctctacactctactttcttctggctgcaggctgaatgttgcacatgggatggtgagaaagttaaaaaagagggagagataggaaattaggaacagacatgtccaggaggagcccacacaatgccaccttgcttcctacttgtgctcccttagcttttgttcctttatttttttaccactggctttttatcttgtcatggtggtagtaactattaagtcatatgtccaatgcgtaggagggccaattcatcatctgccaacctgttgagatctgcgtgtgtaaattcagtgtacaatcatgtggcaatagcatccgcatatgtataactatctagaccagtaacaagtgtaacaaacagttagaaaatgctagacaaaccaaattctaaaggcattttgcacacaaacctcaaaatctgaaacaatattccaagtccaagaaaaatttccttttcttacctggatactagggtggtgtttggttggagggactaaagtggagctaaactttagtcccagggactaaatttaatccctagttcccaaacaccccctaggtaatctgcaacagggccatccactgagagtttgtgcatggaaaaggcaggccctcatgcagagaggtggctgcagaagattcttttggtgagagagaagagtgaaccaatgctacttcaacgtactaccagtagtacgttttattcaggtaaaagatggcaaagtgcacagggtaataaggtgaaaaagagagaaaaaaaagaagaaaatagtactggcttaggcacattgagaattcactggccccggcagcatgtgcggtgactccacggttcacgaggcggtgttacttgagggctggaaactgggcggtatactgaagggcgaaaaaaaaaaactggagaaactttcgctaagtcaacacccagcgttacacaggcttttcactaggtttggttttatgtgaaggtgtagtttcaacatagtccaggggaagagcgaggggtgttgtcaagcccgaacaataaagaatgtttactagcaatcggtaacttttagtacatgggttgccgataacagaacaataaaaataccgacggcagagctcgaacagctgtccaactatctcaggagccagctccgccactgacatagcctcttgccagcgaagaacatttgggtatataagatatattataggagtacgagtacctctggtttattgaaattattgcactgcaaagacaccccccccaaaaaaaagagaagacaatattagatgagcaattctacggtccttgaggaggtaccatgaggtaccaaaaatttagtgtagaatttggtacctcatggtacctcataatac

SEQ ID NO: 39631 - DNA, 1722 bp, Oryza sativa
  unsure (1)..(1722): unsure at all n locations
ttgcatgtttctagttacacactcagtaatccgtttttaacgaaaaggccggatttcacacccaatcgattgaactatttttattaatgccacacaatgtctgaaaatgacacccattgattgtgttgttagtagcactgtggactaaaataagatataaacagtcatgtcccgtgagtacgtaccatccgcttaattgccgtgaatagtggttaaatgtatacaaaactctatcatgtttgcacaggatatgattaatcaaccaaccacattttcttgttaggttatataggggcatgtcattgactaattaagatgtgttaaagtaatcaccaaaacagcatttgatatagtaggtgtggcggtatattaatcctttttgtcttcattaaaatttgatggattttatacaaaaccaaatttgacaactagataggtagaacatacatgtacatgcttgcatgtcggtgcaaacaaaaaaaaacaaacaaacaaaggcgtgcagatgaggaggtatcatccatcctagggtgacaaaccggtaaagagaaaaagggcatccttcctagtgcaagaaaaggtgatgttaaaatgattgggtcgcagctcaaatgataagaacaaagagaagcgtttggaagcggcacaagtatgcaaaactaaattattaatagcttaatatgccgcctgatagcgacatcatgatgtgctagtttcttttgatctgttgcgtatattattgtttttttatctctctatctcttttcattttattatattagtgtaaccgcacagaagagaggaaaaaaaaaacctgtaaagttgcggcgattccagggaccttttccagtgcagcacggctgaaacaaataaaaagataggaaaataattaaaaaaaagggttccctccaacgtcgggatgagctctgtgtgtcgtgttctgtggtgtcagtgtcgcacaaagctgcaatgctaacttagttatatatgcatgcatggctgctgtgtgcaccaagaatttaccaaaagaagcctcaccaacgtgtatttcaaattaccctttaaaggccctgccgcagggatacctgggactttttaatatcccaaatgtttaaaaaaaactctaattaactactttattatgtaaaaaaaatatcaaagttaaagctgattgcaatagttcaactggaacatatacctagctattgtgataaaaaaattctagagtagattatattacaacatgttgtatataaatttgcgaattaattaggaaaacaaagcacctgatggattacctgaacaattctttttagccaggggtgtgaccatttctttaagaaaattaaataatgtgagctctgtcaaccaatgaaagggtttaataaggcaaaccttgtctggcatgactaatcaaaccagttaaacagggagatgcgtccaaatggccccttgctatatatgtgaaccatggtccagccggcggctcccactgtgcacgccggtgagccgcggcgatcgatgatggtccaaacggaaacccatacattatcatggtcccgtacgtgttgctggagagacgatctgaaattagacatctttttcccttgtcctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39632 - DNA, 31466 bp, Oryza sativa
  unsure (1)..(31466): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgcatcccaataaagcagcttcgacttcaccttgaagaaaacgaagaaagttggatgcttgccacatccaagagcagcacccaggagacgaaggcctcgccgaatagctaggcttatagagctttgacatgggggtccattgtaaaatcaaaggtgtttttgattattattctgtgatgaacaattggcatcggaggttattggttttgttatttggaatttattcacgaagtggttttggagatgattggattttacaggtgaatggctcctggctctcctcaagctaaatacctgccaaactctttttttttaccaaactcttaattacagtacaaagtagcacacaagagttaaggatgtgtttggttgggcggacgcgcgcggcggtggatgcgagcggtggcggcggcggacgcactgcggcgtgcggcggcagatgcgggcggtggggtgaggaggagcggcggcggatgcgcgcggcggcggcggcaaacgcaggcggcggggtgaggaggagcggcggcgacgacgaagtggggaggagaaggagcgacgcccgtgggagaaaaaagaagcgcgaaccgttttttgtgtaatggcagaggtgggtaatttttcccccaaaagcagggggtagaggtgattttgatttgtactaccttaaaagctggctttgggcaaaagcagctgtagcttttgggcgctttggttggcttttggctttttcaaaaccaaaagcaggttgaaaagcccaaccaaacacaccctaagggtgcattacgaattgattctcggattggctactccctcacctatcataagcacattatccgaactgctaaaggatatattttttcaaaatagcattttatataaaattacttaaaaattaaataaatctattttgtttgtactagttaagtttcgggtgtcattgaaaatatgatccgaaaactccaggatttttgactctgcgctctcttttatctcaatgattctggagttcattctcttagagggtcatctgtggtctttagctagggttgccacttttgggaatttcttgggagcgtagcgtggctctgcccctttctattgttatgagttgcgtttagccgcctgttaacgccaaaatttggtaagcccgaagtcatcatcggtttagagtcagtatcgactttagagtactgaaatcagccgatgggagtcgtcaagtcgccagcagtcgtgttcttgatggagtcggatcaattaaaggaagcttatttaagaagagtccgagttcaaggaggatgcggcatggcaagttatctattaattaggaatagtttattagttttcttttatctttaagaaagtgtgtttagtgtccgataaggactttatgttttccttttatctttaggaaagttttttttattgtcctgcaaggactagtatctacccatgggtataaatatgtacacccggggttattgtaataaatctctcgatcaatactactctcagcgcatcgccaccctctttaccgaggtttttacttatcttccagcggaatatggcacctgacgcggggctgcatcggttcagttcgatctccggtgaaggggtaagtcctacgttccactggccctggtgaatctatcggctacattagtgttgttcaaggctgcattgcttcgatctcttagatcgctctggtttggttgatatatttgtctacctaatatctcaattctatttctagttgcattgtgtttagagacgcatcgacttagttgtgactgtctcggttaggtccgatcttctgtcttagccgatatatctctacaatcacaatgttgttgtaaatagatttgttatatccatcacattagacaaatctattggctcatcgagtattagattattatatacaatttcgtgctgcatcggttaggttcgacctactagattgttgttgataatataaatcttgttaagccgataggttcatactagtgttttatcggagtgctagccgataagttatccggacgttgcatcggtttataaggatcgcatgtacatataatatataagttggatttagccgatgacaacaaaggtttcattgatctatctaatcttgtggatttaataacatcggacctccagccgatgtatgctttaaccttcggatcgatgctcatctatagtatatcacattgttagccgattggtttctaccggattatattattgttatattgcatcatcatcagccgactgtctttatattattggacatattgctgatagctcaaaaccctatctctatcggctgacatcggcatcggctggaattactccatcggcttgtcagccgatcggttgtttgatctgttgtttacatatcttgtcagttgcaggatcaaactgactggcacgcccgcatctcatcaaggtcttggacctgcactggagctaagcagatctcccaggccagtgtctgattttcgcatcaacaccgccatagtagttttttcctaagcttcagtttctgttttgttttttctcccttcccttggcataagctggtatggctgattgtgttgtgtaacaaaaactccttttcttttaatatattgacgtgcaatctttttgtgcgttcgcgaaaaaaatatgatccgacatgcatatttaaacgagaaatttgcatatataccacggttaaaaaccggcttcactataataccatcgctcaaatgggattcacccaaacgccattctcaagatgtgggcgttctctacaatgccattttcaccatttgttgcatttccaaaccattttccaccaaaataatattttggctgaccgttttgaccctggaactggttgaaccgaaccacacacacgagggacgccgctgccgctgcccagatgtgccgctcgcctctcaacacgatgatgcggcctcctcccccgccatccgcgccgccgccttccccgcctcgcgccgtcttcccctcagctcgctgctgccttccctcacctcaccgcttccttccctcaactcgccggaagcggctagtgacggtggccaagctggcgttcccggccgagttgaaggcgcacacattgcatctcgtcgacaacggcggcgagctcatgctcgtgcaccactgcttcgggacgacgcgccgaggtgcgggcggcggcggcttcaacctattcaacgatcgtcttacgagtttctactacacgcaccgagtagatctggacgcgaagaggaggagagcgctacgcgtcggacgtacagcacgagacgaaaaatcggacacatccacgagcagtccgatccgcgcgcacgccatccgccatccaacatcatcaagcatgcatgcatgcaaaactattttaacctaccttttctcttaaattatttattcaaattatgatccgattgtaccattaaattcgatgcaattaaatctttaaaacaagaccacatatgaatatattccggtgaaaaaatattagcttattattgaattatttttaaatgttgcacgctgttcaccaagtatatcagaattgtttcactaagtagatcgaatcatcgaaaatgtttcaatcgtttaaatcggacgttgtttcaccttatataaaaacattgtttcagcaaataccgaaagaatgtttcaagtcattgcaacatttgatctatataaagtgaaatattttttgtggaacaaaaaataaaacgaattctcttaatagatttccataatatgtgggtgatttattgcaaaagaattttttaattcacggcaacattagatctatacataaacattgtgagtacattaggtgaaacatttttagtggaacattgtgagcacactagtggatacttgttgaaacacttaaccaacatatatatgtaacatttacgaataaaccagtgaaacacaataaactacttactaaaacatacaaatagtaccatgagatacattaaggaaagatatatacatcgcgacactaaataaatatgtgcagcataataaaatttcagctaaaacatctaattttcatatgtgaaacattaagtttaattggttgaaacatatgtgtgtttttttattataatatagtcatgtgagatcttgttgtaaagatttaattgtaacgaatacaatggtataatcggatcgtaaattggatgagtaatttagaagaaaatcatttttcaagtttgctaaaagggtgttatgtacatgcaagtaaccttgtatcatctctctcacgcatattaatacctagaaagaaagcacatgtaagagagagaggacctgacaaaagctgcatgcagcaaagtcaaagaaagatgtgtccgatttttttttctcaaaatcagatgacgaagcattttccccgaagaggacggtgtcttgccgtgggctgggcgtccgccgccgcgccgcgttcctcggcaggaaccgcacgctgtccgtgtccgccgaggtgttccccgccattcgcgctgacaccatctatctgcaggggatgcctgagcaagaagaggctcacctgaggtcgtatgcctgagcgctccattgattgggccaacccggctggcattgttgactatctgtgcaggtacgtctcatgcttcagctgtggatgaattcattcgtttgttcgcagcgattctctgtcatcgccatgaagaagcagctgcaagacgagatacagcaacatgaagaagcacacgcaggtgctgggctggaagcctggaagtggaagggaaggccgaggggagctcgggctgttaattccaagtatcatgggctggaatgggccatgtaatagctaaacaataggtccagtaatgtgagagaaagagtggttatcacatccccgatccggcaccaccgtacaacaacagcaggatgcaccacaggataagggtgtgaaccgtcacttgcgaaacagcaataccaatccctgtttcagggtatcagcccaaacgtcctgcttagccttttgtagctaaaacttccataatgcgtcagttgaacaccaaagtgaaagcaagaaaattattgcatgtccaattatatactcctaggttggagacttgagcatataaccactctgaacctgaagtgtgacttgaaacttgtaccaatactaatgccatctgtgcagtgtacatgttattttaagttctacaagtgccatatgccacaagctagtcttctgatgtgttcctactgctgtcagtaaatggccagcatactactagtcttggtcaaattttagtcacgtggttgaggttcacatttgttttagtacaaccaaaacaaaaatgatacttcaggtttattcaagaaattctgccattggctgatgctgataactagtgcctagtggctcggcagtattatattttcctgatgttaactaagagttcagcataaagagcatatggtataccttttgcaagcaacacacaatcgaaataatatccaaccaaacgtattctagtttttcttgtactgattgtgatacatgcaagtataatcatgatatgactgaacagatcagtttgctgttcgtgcagatttggcgaatccaaggcaggaatttcttacacctacacaatgccctttccttaataaattctaattgtagagattttgttcagatcatgataagatttgcaagtgccactctgtccgttgatcttttctatatagtttatgatcaagaccatttcagatgtggtatttggcatctagattgacagaatttatgggattgactgtgtttctgactggtctaacagtggagtggataaatgtttatgcttggatctattgcatgacagtgatatctaggcagcaatgcttccaagttccaactgtctcagaaaagaagacaagtcaaagtctgaaacccagtctaaagaagcaaaggagccacaagaaaagatgctccagcaataatgccccatcccagcagtcaatactcaatagagtggaaaacttgaggaattcttgacaagaactaatacaggtatcgaggaacaactccaaaaatgatatttttcagctgtagtatatagattgtctgaaataactagacaaaaggtgaaaactgttaagtcttttgtccattctgaaaagcacagacttttctcttagcacgttttctagaagtatgaaaaggatgaagggctgcatccacatagtactccttttctcttccttgaggtgcatgaacttctatattgggcatggctcagacttaagatgctgtagaaacttttatacgtgtgttttagcaatacaattgccaatgctgaaaaataaaatagaaaatgtaggatcgaatcacaagaactaagccaaccagagggggggtgaatgattggtatacccaaaaaccgaaaacttttagcggaaataaaagttacccttgaaatcgacggatcgcggtctgaccgaagttgtcctgccggtctgaccgcctggttgccgtcggtctgaccgcggttatatctccggtccgaccgccgagatcagctgatgctcgctgtcgccgccgccggtctgaccgccgtgctcccgctggtctgaccgccgaaacccagtaaacacaaatcgaagaactcttaaagtagatgatgactttattgattctctctgtgtttacaaagtgcaccaacagcactccttacaaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtacaagaaagaaactttacataatcaatcgtaccaaatttggactccttccaaattcgactccgcatcccatacgcacacaataactccatcgtatgccatatggaatctccatcaaccacgtgcatcaactctagcctaagtatctcgcatgatctctgaccaccacggacgtcgtcttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtatagtatccatctagaagtcataatcatgaaataaactcggatatccaaataaacaacccgaaaccgaaaccgacacagtgtcggccggtcagaccgcgggctgcgccagtctgaccgcgcattacatgccggtctgaccggctaccagagctcggtctgaccagtcacatgaaataatgaatcctgcgatcacctgtgaattcaatcatctccaaaaccacttcgtgaataaatttcaaatgacaaaaccaataatctccaatgcccaattgttcatcacagaataataatcaaaaacacctttgattttacagaaaacatcaaaatcaactttaaaattaacttttaaaatttaaattttggatacggctgatagaaaagatggaactgacgatgcaattgccgttcttgcctctatccctatataagtgcatttttaacactctagttttttgtcaaaataagtcacttctaatgtactacatatcctatcaatcacttcttatttaaatttctcttcatttacccccaaccaaccaacactaacatcccttatttaattaaggggcatataagtcatttattttatctattccctccgtctcagaatatagcaatttagaaccggatgcaggggcggaggtagagtatggaagggggggcacccaggaacccggttaagaaaattttttagttataactcaccgattttcaccatgtgtgcaccccctcaatataaacttagatacacgcatcaacttaaacttgatctaaagtagagtaaattaaataagaggcactatcctctatttcgttctagctccgcgccctttggatgtgaccaaacaacgttgaagattcagacttgcatgctgacatttgcctcatgacatcacattacccggttcaatccatcacgtggtgatcctcactgtcaccaatgatatgcaagcatctagtaatcattttcttctcaatcgagtagaaatggtaccaatcaacctcctaaatcctgccctgtgcatgcatacccccaaccaccagtaagtactaattgtgaataaaaatacttctgaataaaaccattttcaatatggcaagactaactcaaagaaaacagcataaacattacattattgcctgaagattacatacatgattgtgaaatccagccatatccaacagcaatatcattcatttctgtcctcctaaccaaactagcattactaagtctttggagtggtcaagttcatgaatgtgaggtacgggctgcattattaattgagaggcccttaattgagacgatatagtaacagtagagatttttctgatagaccagacaaatgaacaatcaaaagctactagggaagagaaaaggtaggaaaaggggaatcaaagcagaacaaaagcttgaaaagatagtcgagtcatggtgcacgaggagcaacaattattttccatccttcgttaatcctcacgcagaataatcgtgtaagaaaagaccaaggcgtagaacaccagaatggctcttcacctcgttgttgaaactctaaaacattttttgatagtgttcaaaccatttgagaggaacaggtcgatcaaacctatatgacagcactaaaaaaacacttattttctcgccggaccacaaaattttacttttattactaccttttcagccatgtttcagtatcatgtagggaaatcaaagattatgagatgaaacaaaaacagtttcgtctgacaggtagataggcacagcgttgttgaccatggactgctgatttgtcacaactcacaacccagcggagagccttgctctatgcaatgaactggacacagagcgatcaacaattaacaaaagaatctaaggcaaaaaaaaagacgaagcatcaaaacttgaggaatcccaaagccaaaatggacacaaacaagagcagaatccagagcgcagaaaattatcgtgttcacaaccctgttgcatttattttttggaataagaacaaccctgttgtattatccatgtactaaatgttttatctaacatcgtagtctcggttaactgacaggcattgacctgcagtttaagggttcagagtgaatgcatgagctttggccggtcaaagcctgtcagtgtcagatcattgcataccaggttgtcatggctggacgctactttgccatccggtgtgaatacgcatcatccatccatcatcacatcagtagaaatggccgccccttcctcctctccatcctctatataaaggcatgtatgtgactgcagattgcagaagcacagaagaagatactactactacatagtagtacatagcactagtatcttcagagagcaggaagaacatagtagatagagacatagagtgcgccatgtatatctgcagtctgcagagatgagggaggatgtgcgttcttgtggggggtttgggccctgtgatcaggagagatgacaccgacatcgccggaattcgttcttggtcttgtgccatgatgaattgatggtccgtttgatgcaggtgtcatctcccctgaacataggactgactgaccctgaatggatgtgtacctcgatgattcttcggtttcttctgttctgttctgttcttgatttgcttttacaaggtaatgcctgatgctagtatgcaaatgtcagcttgtctcctcgattggtttctctttccatgattatctgcaggtgataagagttgattatccaagctctgacatagacgtgtgagaaggacataggttgcggagtcaaccacaaggtttgccatccactcttgccagggcagacagtaatttaggcgtcacttagctgtaaaaacgggaataccattaactactgcccagaaaaactcggtgtcttcattgacaacacatggtgcattctttgtttgctgcgtggtcaaattttttgtgttacctcatacggtttatcccatcttaggtaacttcatatccctcaagaacatggcgctctatctatttcgtgtaggttgtctgttaaattctgatttggttttgcacttctggttgcagggaagaacagaatcggagaatccgcaggcgagaccgcaccaacccgagcgctgcttcggtttgggccgaaacgattgagcggccaccgttcagctgcggcctgcgggccttcgggccacacggcgaggccgaggcccagcacacgcgttctgaagacttctcacgggctgtggcctgtggaggaagcaaactgaatgccgcaccgcactttgtactgttagcgctgattaatggtgtgtcatggataagtgaatattttgtaaaaagagatttttctgcgaattcaaaaatcgtactgtaccacgttatgtttgttaagtgcagagtgcacctaaaatctttaaaacatatggtagaacaacatgaatgaaactactgaattcagtggaaaaccataaacgtcaaatccgccgtgcccgatggcctgattaacgggttcttatttgtttcagaatagtgaatcagtttgaatgtaagaaaaacattttttttaaccccgcaaaaaaaacatttttttttaaaaaaaagagtggtgaacagaagttagctgccaacatttagaattcccattgataattcattaattcatctcccacaagtatattattcttcatctctcacgacagatcaacccatcaacatttcatcagttagttccacatgaacaccacagggctcctgacctgatgcttccgattctcccacgagatgtgcccgaaatcccagctctggttgacgtgtcctcccgccacgctcgtgaactccaccgtgtagctcttctcctcgttcttctccttgaactccagcgtcgccggcctcacggtcaccttcacgccggccggcgccgacacggccacgctgtacgtctccggcttctcgtacaccttggtcaccgtccgcgttagcgtgcggacgcgtgtgctgccgttgaacgcgacgacgaacgacgggtagttgaggttggccgggccgccgccggggagcgccggcgcgcacccggccgtgtccgggacgaacacccgcagctgctcgacggtgtagttgaggctgcagaggaagtcgacgtagtcctccacgccggcgtcgtagacgagccccgggtccacggcgagctgcgggcggacgtgccccgcgccggccgccagcggcgtcgcgctcgtgaaggtggcgttggcggcctcctggacgccctcgtcggtgatgtcgcggccggtgttgtcgagcgtcgccgcggtcgtcatcatcgcggagcgtatcatggccggcgtccagtcgccgtgcctcttcttgatcagcgccgcgacgccggcggcgtgcgggcacgccatggatgtccccgagaggatgttgaattcggatctcctcgtgtccatgttcaacatcgacaccgggatgtcgcgcggccaggccgcgaggatgttcagccccggcgcgagaacgtcgggcttgaggagctcggggacgacgcggttggggcccctcgacgagaagcccaccgccgtcggcgcacggttctcgccggtgaccgtctcgcaggcgaagctgaacgacgccaccgggctcgccgccgactcgaagtagtccatgagcttctcggccttggagtagctgagagtgagagccgggagggtgaaggcgtcggctaccactccgtcgccgtgccattcctcaccttgcatggagactagcccggcgccaccggcgttctgcagcagcatgccctcgtagacgccggcgaggcacacgacgatcttgcccatgacgacgtcgggcgagagactccactcgtcacaggagtccagcaacaccagcggcgccatggtggtgcccgtggccatcttggtgtacagggactggccgacgagcacctcaccgttgccgagcgtgaggttagccgggaacagccggtccacggcgccggcgccgacggtggtcatccacggcgccacgttggtcacggtgtacggccgagggccgctgttgccgccggcgagggcgacgaacacgccctcccgctgggcgccgaacgtggcgatcgcgaggctgtcctcgtagaacgggatcgggaaaccgccgagggagatggagatgatgtccacgccgtccttcaccgcggcgtcgatcccggcgatgatggcggcgtcgctgcagccccagttgccgccgcacttgtacatggcgatcctcgccttgggcgccacccccctcgccgtcccccgcgcgaacatgaagaggccggcgccgtggacctcggagccggcggccgtcgacgccacgtgcgtgccgtgccctacgtcgtccctcggggaggaggcgccgccgtactcggcggcggagaagtccttggcgccgaccagcttgttgttgcacagcctggcgccgagacccacgcacccgcccttccagctgcggcggacggcggcgagcccgctgtcgttgaagctcgggttctccggccagatgccggagtcgatgacgccgatgatgacgccgtcgccgaactccgtgtcgcgccacaggccgtactccgggtcgaggccgatgaaccccggcgacctcgtggtctgcgggtagtacatcctggcctggtgcaccgcggtcacgccgggggcgccgcgggacaagctccgggcctcgtcggcggcgaggcgcacggcgaagccgtgcatgacggtgtcgtaggtgtacaggatgcggccggccaccgcggcggcggcggcggtggcgttggtggcggcgcgaggggagtgcgtggccaccatggagatgtaccagtgctcgagggtggcgaagcgggacggcttgaggaggtggttggcatggacgatgtaggtgttcgacagctgatcaggcttgtgctcggtgcggttcttgggcttggggatgaaggctgagtgggcgagctgcgcgaggaggaggaacaatgccaagcactgcaagggtttggaggtcgtggacgccattgttgatgggtgtgtgagcgagcttgtggtgaaggaatgcatgcgtagtaatggcttttatagaggcgggatgaaaatcatttagggcttcttgccaagtgccaaactgtcactaatcactgtcacacatccctcagaaaaagggaaaagaggacacttgaaaattgaaaaatagtgtgtttgtttcactgaaactgcatgtcagtatgtcaccaatacttctccatgcatatgcatgtgaaacaactgagatatactattatcaaggggttaaatgatttttaattagagcatttaatcatctaagtgagagctgagacaaattaaaaggcacctagcgttgaagtatctacttcatgagagaaactaatcagatctatattgtttgaaggtttttcagacaaaattaagggacctaatgttcaactgtcattcttctgaaacaacctaaaataaacttttgaagttaaacacccagaaaatttgaagttaagcattcataaattgagattgtggaagttaaacttctaagtatttattgcatgtttgttgtcttgtcaactgcaggcaaaatttgaattttataacttgatttttaaattaatttaggttttttcatcatagactattttcgaacatggcttttaagccactaatgacatagatataaaagctatccataaattattttatttgctctgtgctgttaatatacttgctggatgaattggaggaggaagcaacggtgaacgctctgggctgtgaaacaaattcagttggaactaactaccacactttggcagggaacagggcaacagaaaaccaggccatgcttggcagatcataaacatttagatagctctaaaaaactccaacaatttcgattatatcatggtgactaggccacatgaagcaaaacttctgtcattttccgtttcctcctgggatagatagaaataagcttgtgaatagcaacttctgctccattattcaggacgaaacgggctctccattgttcagaatgaaacggctttctccatccttttgtcttttcttaaattttgacatgcttcagttgtattgcgttcaaccagttgcataaagtatgtacattcccagtattcctgtgcaaactgactttctgttgagatacaggtaatcttcaaacagccagcaatagcacctcaaagctgtttcaggtgctatttaccacaagaaaaaaattaattggattctattcgtatctacattctacagagtctaagaccatagttatgtaagtctcatagtgatgttgcagtcttccaaaatcaaaaccccaagtgaaatgcgaagcaataaaaagaccaattcattattttagtaaaaatagctaaatggtaattcaattacatccaaagcgaataaatataaaattagcatacaagctatgtattcttgtgaacaatgcggctaggctacatttgtaaggggattttggattaacttacacaggattgtactcccatgctacttttggtacatactcaactcgttgctgagtacctttcactgtgtcatctataacttaattcagaatttcagaccaagtcaaaatgaattgacaatgtccgagtttctttcctttcgagtcgtataactgtactgttgttaatagctccagcctccagcagtggagtcattggccgttggacatatatacagttgcaatggaagtgctaccagcagagttatgcgagaagaggttcaactaaaggtcttcgccgagtgtcaggtaggtccatcgtataagctattatggctgagagcagtgaacaggcagctgggactaaccccaaaccaagtcttgtaactgaataaccaaatgccaactctaggttctgtctggtattggtacttcctgccatgcaaagtttcaaactctcagcatactgtaaaagtaccatcccaaatttttttgatgtatcagtgccatgataatagtaacagtcattaccttgataggactcaagaatatacagagctagtccgcatgacactttgtcaacaaaacttaatgagccatacacaaaagcacaaccatttagatcttcacctactaaaattccttccatgctgatacttgttacctagtatcaagagaaacagtgaaaagatgtgaacgatgagaagagaactcccaggcataacatgattatgtatggcatatggaaatttggacaaatttaatcacaaatttacatgataacacgctacttaaaatcaagcagctgaaatgcttcccaataagctaaccaaatgcagatgatagacatacagctttgcaaggttaaaaactacacgatggaaaatacttctaagctatattataggctaaaaatttgccatagaaatgttttagtatattaactctttaaaatataagcagaaactgaagtttaacaacttactgtcataagagcattggcaactcctattgtgattgatagtgcatacatgaagttgtgcattccacttggtagaacaacaattccaacaccagacaatatccaaagcatggccccagcagaaaagtaattttttaaacgccaacttgaccatctagtttcctagaaacaataaaaattatgttaagttgagtagcaaaatagataattaaatactaaggacatgctctgacctgtaatatgacagatactatcaagctgcagacatagataatagcaggtacctgaaatatgaagagcagcgcaaattaattcgtgaaaatccatattatgacattgaacacaaaatcatctaaaatggttaaagtaataaatgaacaatggtctaatgttgatataattcagattattttttctagtctcaaccattgaagtcccaggattgaccagctagtgaactggagtttatacatagctagcttagttatagcatatgcagtgagcttcagccagattagactattcatagttcaaaaatttggcacattaattagttatattagactgattttacttatttgggctgacggtggcggctggacggtggtggctggacgggggtgtccgtggcggtggtggtggcggtggcggtggtggctgacggtggcggctggcgacggtggtggctgtggctgtggcagtggcggtggcagctgtcgacgatggtacctatggcggcgatggttgaaggccatcatccggctgacggtgcgtcggcggcggcggcggtatgtggaggcggggaaggggtctggcggcggggaaggaggagtccgggtgcgggagcgccgtcgacggcgggaacaactgtgggcggtggccttggccgaatcgctgaagggacaatgttgttgaccgacgacgatccttcttgtgcggattggtggtgtgggtttggacagggaatcgcgggcgaaagccttgccgagccatttggctggctgacaaccgcaacgccgtttggcgtcattcccctccttggaggcgttgttttagcatacccctttcctttccctaccatattctccaggtgaaaaccttgcttcggttccgaacgagcggtggcggcgatccacgtcgcatcctccttgggggcaccgctttggagaaacctcttcgtgcaaggatattgtcattggtctatgcattggcttcgaacttcagtcctaggccttgacgaggccttctagctccacattttgttttgcttttctcagtttgggtcctctctctcttgtttggtgtgttcaacttgtcttgaactacactctcttctggagtggatctttgtaataattggttgtagttctttttgagcaaaggccgggatattatattccattatctaaaaaaaaacttgttgtacaattgcatgcgaacaaccatcccaatgacatattcaacaccagcgctagtgtaatacatgagataaattaaataaaacaacatttacaaagcaaatatatgaaaaagaaccttaccaatgctttggatgattgtggcatttccaaatcatttatgacgtagaaagcaagaagtgcctgaccaaatacagaaacgttatagttgatgtgtcctctagctattagttcaaagcataaacaagagcattgtagtttaaacctagtgaaaaaggtaatacgtcaatatacacaaatactgcacaaataatcaaacaaaattcccattatccagtaaacatattagaaacagaaaaatgctaatgcatcgtgagaatgtgcttctatagtatgtctcaaaattagtatgttagtagagaatttcacagaaaaaagaatctaggaaaaaaagaaatatataaagttcatatataatatccaccaccatatttaagcatgaactagtcaatatttcatcccaaaacatacaaagtttttgctgcataataacctatgcgtgaatttggaattacatgcaaaagaatttactatgttccaccatgccatggtccatggaacacagttaacaaggtaaactattttggagtacaatacattaatctctacgagatatcctttgtcatacagaataaccatatgcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatataaactattaaataatctcacaaataagtatcatctattttactttgaaaaatatgagaaatcacaaactaattttgtagatcatgtctcttgctaacatttttagacttgctaactaattaaattgataatactttcaagctacacaaaataaattagataaatacttatcttagctaacttaatatagagtaaaatacatgagggtgtagtggtggtagtgtttggataggggggtgttggcaccctttggcaccccccttaccttcgccactgaccatatgcttgaaaataaacaagtgatacaaggccattatatacatggaactaaaaatgcattatatttttatcaaaggaaagaagatttcagtcccataagaaaaataggaaaagattatagatacctgtgaaacattggtaaccaatctagtaaacatgtatactagagcaacttggtagtacaatactttcttgaaccagtgggtccatgaaatcctggaaagtctcttattctggcaatgctgatttaacctaaaaaattaaaagtcattcaaatactgcaaaaatgaggaaaacctagtggaagaaaaaccatcaaaattatatggcctttaaactatgaactccacaagtgttttttatcttaccctggctcttccgttccaatcaagaacacaacgacgaaacaagatccaagggcaatggacacatatgctatccatcgatactgaaataggattccaaaatttaagataaatccaaaagatcaggcaaatagtaaaatattatcttaaaacaagagagtacctgaactatcacgctcactgactgacgtagactaaatatcaacaaagcaatgccatacaggctaagatttgcgatctagcacgagcacagaaaaggatcatcagattcagctcttttgtaatacctgagttaagaataattagattaaattaatgttctaaccattgtgaaggcattacggcagcttactaatgcaacccgacttgttgggtttgatgtcatgcagttcaccattgaccttagaaaatacgcagatgatgtacacaagtcaaatgcaggaatcacaagaaaagaaaatggagataaacaatgaaaggaagaggcattacatatgagagacctgagtaactgcccagccaacattgaaaatagcagcgaatgtgctatatccaacagtctccattgtagatgaaatagttcccgtaagtttgcaaggcaaacagctaccaaaaacagatgagaaggaaattgctactaaaatggatcctcctgcatgccacagtttaaaatgtccaaagcgatcaatctggataaaaaaaaaagaagatagaatttacatatctagtttggaactatacacaataaacacaggaaaactagtagcgaacgtctaagagaagataagccatgagaatatgatgtcacagctttataacaatgctttagtaaacaatcatgttctttcttaggtcgtaccagttctccaacgaagattgttgcgaagccatctgccaattgaccagaaagcatgacaacagcagcatcactgaaaaggtgaataaaaggtaaaatgtctaaaagaatcctgaagcagcacgtaatcctttcaaacttccaatgtttctcgtagaaaatttctttcagcatctctgatagaacatttctcgagatacgaatacaagtataatgttctgatgatctggtccaacaattccatactgtatgcagtctctacggcatgtctttgatcataaatgagccaataatttccaaaaaaaaaaaagtcaaagttgctaactttgctatagccgcaacagttgcttggacatcatgaagttgtggctagtcttaactcttaagtggcacaataccaataatgatgcaaaaaattcatccgaaaaaagatgaccaatcgttacattcatttgcaggatatcccggtgaaatatctattgcaccacatttaggacatcctgactttaaatatgaacctatgtttttgtacaattcctcatcaagcagagtggattaagtgtttgaaaacaactaaaaaaagtgcactaatggcttcattcaatatgatttagaaatatgtgtaaataacatgatacaaaaattaacagaacaaatggacaacaaaatctatccctcaaaggcacataccttggactaagcccaatatctgtcaagaaaaccagcaaataagtaaaccaacatgaagaagtgatgtcatttagcatatgcccagaaccatatgaaagtattggaactctccctaatggttcatccagttcttcaatcgatgactgattatccattatcttaaccatattttatgtttgccagactaaaggtatcacctacacaaaaaaggaatacatgttgatttcagtatgtaactagcaatctcaatcccaactttgaataaacaaaacaataataaaatgccattttgccaaaagttaaaagttttgaaaaataaaaaatgcctacggtcctgcacactattttagaggcttgaaaatgaagttgcttagcttacaacgagtgtaataagtcaaaccgacagactttttattcagaaacatcaactgaagttatataagaagatagttggtacgtcatgactggcagcataacagttgcttttgtagtgcttataacaaggcttcaagctatgtcagatggatttgagttttattccttaactagaaaaaatgtctgtgcgttgcaacgggtgaaaactattttaatcatgagctgcaattaggagtctgatcgtatcaagttagcatgcgagttttttaaagagatatctatacggctccttctgtatttacaaaagcgaacgaacttaaaaaccgactcatacacggatgatgtaccaaagtaccggcaaaaacatcttcaatttttataatagtagagatgtatgactggtttttactgactgctgtaaaacacattacatggaccatcttaaagcagcaattgatatgactactgtacttgctaacttccaggaaaaaagttcaagttgtattagttcttacatatatgagaatcatgaaatgaatcaaatgccaatctaaagtggtgggcacaagaagataaggagataaactgaaggttccttttgttgttgtaaagttttttaaaaaaaaaaaacagcaagcaaatttcaatcacaatggtaatagatcagcaccttcagaaggttgggatgatatggatatgatcaagaatccccaaaggcattattgtagcatatataccagttgactaaaaagttcagatttgaggtaaaagcaactactctgcacacaacatcaacagccacccaaatcaacgtgttatcgctgggtcccaactcgaatcatcaacgaggagtatcgcaagtgcccgaaagctaaagataaaaatgcaatggcctacaaaagaaatattcgcatttccactaactttacgagacatcaacctgatccccctttcctctctgcctttccttccaaaaattgatcctaatcgaacacaacgcaggagcccacacatactctctgcctgctccccccacccaacgtagcaactgacattcgaaccgtaaccaaacaaagttaaaatttaccaaatgaagaaaacccaattttcgcggagccccatgcccgtcggaactccctccaaactctgctacacccaccccaaaacaacacagagcagcacttccatggctggccccaactccatggcgagcaacctctgtgccttaagcccgcaacagactctacccatccaataaccccggaacaatccagtcaaacagatgccgcacatgctcacctcgctgctgctgctacggcgaggaaccggagcgaaacacctccctccgcaagagcaggacgtacgggaagggcaaggcggaggaagaacgaaggcgacgctcggtggtgtcgcgtggacggcagcaggaggaggagaggagaggaggaggagtgggcagggagcgagccgtgcgggaggaggagacgcaacgcaaacacggaggaggaggaggagagaggaggaaccgagggaaatggaaggagactgggcgagcgaaaggcgtggctgacgcgggcccccaccaccgatcccatggaatggagtctggactttggagagacgagagcgacggagatttgatttattctaatccttctgtttagtttattagtggcgtcgcgcgcgcgtcaattcctccgttttcgtggccgccgccaacacgcgggacggcgggacggggacgttttgctctcggctcgtgttctcctctgctccctccatcccacgaaaaaatccatttctaacattccaaaatagaattagtagagaataagactaactaaaatatttttaattattaaaaaacataataagactaatatgtagataaatggtattgaagtaaaaaccttctcgttttacgttgatgatagataagatagtagaagttggtttttctaaaataaaatttaaactctataagttgagtttttttacgatggaggaagtaaagctgaagaggtggccgtgaccgtgagttgccttgattaaaaaaaagtctatctatacggctattagtatgcgtctcgagtaattagtactccataaactaagtcatggctgcgtctcgatggtgttttcttccgaataattttgtgtggtgatcatgttttcttctgtctgcaagaacatggggtgggatgggagaaacgtaacgtacgtagtgacctgtagggcttgctttgtcaacaagtgagttgttagtcttgtcctattcttaaacaatgaattttcacaagtgcaaagcacatgaattttcttaggacatgtacaatggaagacacccatagagtaccctcactaactgaaggcactcacgtgtaggggtgggcagatttagaccgaaccgaagaatcgaaccgaaaaaaccgagaccgagaaattcggttagttgttcggtcccagccatcaaaagactaaatttatttcggtcattttggttattaggctcggttaaccgaattgaccgaaattttggctcaatagatctaggaagcacgataaatataaatatatatatatatatatatatatatatatatatatatatatatatatatatttgtgtgtgtgtgtgtgaaaaaatgtctcaaaagaggggaagtgctgttaaaattttcattccaaacttactcctgaaaaatttcagtcggaccaagaccgagaccgaaaagactgaaattgaatttgccagccctgtgtttttttaggatgaaattcagtcctaagttttcaaatactgaaatgaccgaaagaccataaaccaagactgaatttttcagtctaaccgaacgtccaccccctgctcacgtggacactcgtctcccaattaaggccacaactaagtgggttcttcaaaacccgaaacaactggatcaaggtactctatcccacagtagatatcccaatcaaaaagccacggatattaatttcctctcctacccctgccggcaacacgtctctctgctccctctcgttcttttcgctgctctctccatccctcaacttgctctctgctctctccctctctctcaacaaagcagacggcaagccgtgcggatcgccgtagcggatggccccgccccaccctgccgtcggcattgaagcggcggcatcgacggcgcgttggtctcggatagtattgtagcgtattgccataggttaagagtaatattttactaaatccttttagaaagcggcttttacacgaaacctacatgtgacagtagatttctggacagtgtgagacactgacgcaaatcattgattcaaatatttgctgcacaaatttgatagataacgggtgtaatatttcgttatttcactatcattgcaaaagaatgaaagtgctcacataatacttgattgattctagggataaaatggttttctgaaagacttaactaaggtccatggataagaacattgatatcttgtagaacttgcgtttaaacttattttcatctatgagacaaatatttgcattaccacatgcacaccttcgcacacgccggacgccctgcctgctctaacatctctaaccttctcaaaattgagcacatcagcacacacacccatatccccccaaaaaagaaaattacaaagacccatattcactggaactccctccaaaggtcaaactctacagcctctgctcaagtcacccttaataccgacccatgcactatccatgctaagcaatccaacagccattagacatttaattgattattaattatcacaaacttgaaaaatgactttatttgtctatttagaaaactctgtataaaacattacatcgtttgataattcaaaaagcgtgttaatgagaaatgcccaggggtcttctggctagctccacaaggtggtgggctagacgacctgggttcaaagcctcacccctcctaattatttgatattaggtccttccctaatattctagtttttcaaaaagcgtgttaatagaaaatgaaaaaaatgccacccctaaactcactatcgaaggggtggattctcccaaaatctccatgccccctaaacaatccatattcttagattttgtagttatagaatatagaaaataaattcttacacagtcataattcttaaaattttaagcttccctaatatagccttagtaatatgtatagaatcacggatttctaattgaaacaaaacacatccgtagagccgtaaagtagggcagggaagagcaaggtcgaaggtggaaggcacggcaggaggagaggaggtagaagacacgcatagtagtaggacatggattttcattcctccacgacatgatatttcctcgttgtttacctatcatttaaatagtcataaaattttttaaaaaacttaacaatatagattaatacgaaatatagcaccccacaaacacaagaccaaattcgacttctacatgttgtaacaaacagaacaaattaaactgaaaatagctatatatcgtacattcgcatatatatttattattattttacaactagtagaagttaaattttaacttatatgtttgtggagtgatatactttatattaatctatcttaccaaattgtttcaatttttttttgataattatttaagtgaaattactttcccatagtagcaaagcaaagcggaggaggaaacggaggaaacagggggctagcgcgcgcgaaaggcgtggctgatgcgggtcctcccgtcttgggtcaggtgtggatggagattttgtttattggtggagtagtggcgtcgcgcgtcagctcgatcggcaggctcgtccggtcgtcccttcgtggccaccaacacacgctgccgggacggcaggcaggacggggacgttccttccaattccttcgcttgtcttttagccgggagaggtagcggggaagtgttcgctacgagtatgcgtgctcggtgtgtacggcgttcaaatggtctatccaacgtatggttgtaccgtgtttagttctaaataattctttaaacttctaactttttcatcacatcaaaattttcctatacacataaacttttaactttttcatcacatcattttaattttaaccaaacttttaattttaatgtgaactaaacgcacgcttgatcgtccgcaagaattgaggaatacgggtggagtatgtgagaaaaggtagcagtgtgtagagcttgcttcgtcaacgagtgcttgtctacttggccactgtttgttgtcactatccatcgaggatgtcttttaacaaatacacagatactttcttacgcctagttaggagagtttagccatggtagtagtttcatattagaatctttagctcccaaacagcgtgtattctcactcactcaaattataagaatatatagttacatagtctaaaaagtaaactgaaatcagctactcacagaattttaaacaccccccccacccccaaaaaaaaacacccaacaggaccttacttattagtagctgaagatactagactattagtacattgatgcaaggttattatattcctacaacaaaatgaaagtgttgtgtttactcggatgggagaaaagagaagaaatataaaggaggatgagaattgttgttgaggagttgggcgcagtgacggatctatcaagattcttagcatggacaaacacatatggacaatttataatgttatttaacactaaaaatattagtaaagcctattaagtgggatacaattgttaatagaggatttgttggtaaaatatattatttccatttttaaataattatacctgcattatttaactttgaccgctaataatgttagactactatgaacaaatgttatatacttcaataaatatttacaaaatattaaaaaagataaatagtcaaagtttaaatatagatagtaaccgtggtaatctatttgggaatggagggagaaagttacaggagagaaaaggtcacgttcggtggggactcctactcagttttctaaaatttcaacttaggctgtgttctttccacaagtttcccaacccctttccctcgtttttcgcgtgcacgcttttcaaactgctaaatagtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagtagacctgtctagatcctaccctaaaatttttcaccatgtcacatcgaatatttgaacacctacatgaagtattaaatataggctaaaaaataactaattgcacatattgcgactaatttgcgagacgaatcttttaagcctaattgctccataatttgacaatgttgtgctacattaaacatttgctaatgacggattaattaggcttaataaatttgtctcgcggtttactgacggattctgtaattagttgtttgttagtgtctgaacacgccatacgacatcctatataatatccgatgtgacgcgccaaaactttacactcctagatctaaacacccctgagatgatgtttgtttggagcagtaaagcgaaaaatgttttcccattacgtgttgaatgcgatgggccgaggaaaaaccacacattgtttgggttcacatgagaagcgatatgcaaattgctcttcatatttgctccttataaaaacaagagggatgacattttgtactgggttggttatgacttcgcattgggctggccagttcatagtgctcaaagcccacaaacaataacgcaattgcgttgtactgcaatctaattacggaggaaaggagttgaaccaaagttttattatactcatggtgattttcttaataaaaaagtaagtgacattctttttaaaaaatatttctcatggtataacacaaggtgtcactttctttttaaagaagctaatgagtcatcgaaaaccctctccgtctgcctttctattgaaactagtcttcagagcaagctagacctttgcagtgcaagaatttttttcaaaattttttctataaaaattcattaattattgtttaaatattataaaatttatataaaattcttgtgttttaataggtggctaaatatataattaaatcagtactaaaatatctcaaacaagcactctgccatgacatgtatgcccttaatcaagaaaataccaaattactggtgttaagttaaaaagttccaaaaaaacaaataagaatagtagtatggcacttcaagaatagtttgagcacctcgcgaaaaaaagaacagttttattgaagcataaactattactcactccggttccgtttaatcttttatagctttaagtaccaattcttcatgttttctccaacaataatataaatcctagttattctcttatttttgttgtcctttttgtggacagcaaatgaccctcataaaagctcaggctggagtgaacaagagcatcatccaacagggctcgaatcatgttgtgcatgtggtcctttttgctctgttttgcttcttcgttgtctatctcttgtcaaagttctctagaagatagtaaatatttagaagataatagtcaggttttgtcacctaacgataccattggttttatgttatacttgtactgcatatggcaatgtagtatctgaagtatgtgttagcttctctgacagactgatatggatataatttatcctaatataggtacaattatattctatgttgtttgtggacacacgttttttttgttttaaatgatccatggaagatgcgagttttttttgggcatttaccaaatttgaattaataatatttttttttcatcattatataacactgccacatcattcaaaaccactttaaattgatcagaggatgaaaggcaaacaatatgcaaagtttagggacaaatttgggctttaatgaaaagtggggattaaggacttttctccttagtcattgaaaaaacaacacgttcaagacaacaaatatgtgatcatatttactgttcaacatgtagcaatataagataggataagaccaatcttagaactacggatttggatggagtatgatccattcccaccaagataatttattataattagactatcccaccaaattattttaggtacacgatgctaccattgaggagcaaacttcaataagaacagggaaaccgcaaatcacaagtcagttgcaggaagttgggtcaaacggaatcgatgacaacaacactaactccagagaggcaaaaataaataaatatattacattgcaatagttaattctcctttattaatactacccccattctagaaaaaacacagttttgcggtttttctatctaacatttgactgttcgtcttatttgaaaaaaaattattggtatgtttattgttattactccatccgtcccataatatatgagattttgactttttcatgcactgtttgaccactcgtcttatttaaaaaaattgtgcaaatatagaaaatgaaaatttgagcttaaaatactttggataataaagtaagtcacaaataaaataaataaatattacaaatttttttgaataagacaaatggtcaaacagtgcaaataaaaagtcaaaatcccttatattatgggacggagggagtagatgataaaacattaatagtactttaagcgtgacaaatttttgttaattttttcaaataagagggtaacccacgactacacgtaaaatgagacggagggagtatcttccaccaaaagggaagctactcgcggctcatcttgatgattgtgctggaggattcttctgtttctctttaagtgcaagtattgcaaggaaacgttggaggaataattagactctccactctacacatttatattttcgtacaaatcctatataataaaacttaacatgcaaaaatatcatattatcctacactaacaattattacatcttaaacctcaaacatgttgtattatatctatataatttattaatattagagctttgaaatgcaagcatttaaatcatcaacataacatttcaatatagaccaatttatttgacttccatatgtattttcatcattttttacgatatccaaagtacctaaccgttatcatcacttagttaatattatttttttcttctctcattaagtcatattatctcagttgcttctaacccttagatgattaatctatggttcgaattatcttctttattttcttttctcatagctacatcatcttacttttatatttgaataattatctaaaaaagctgccgcaagttctttaagggaaaaacttttaaatctaactataatataattgtaatataattcaactataatatataagtattaaaataatatatgcaactttatatctaccttatatagaaattacaatatagttatagtatagttacactatagcgtaattacattgtacttacactacaactatgctatactatagttacatttaaaagttgtttttttagcaattacgatatactatttaaaatatcaaaaaccacatcaacttatataatattatgtcgtttagctatcttacacactattttcacttgttatcatatttctcttgcagtaatgtgtgaggttttacctcttaataaataagaggacgaaaataaacagcacattgcaggggacagtcttgagatgatggatacaactgctgcatcgtagcctattatttacacccacgaggatagataatcagcgatacttacagggtgttcccattccttgccggggtcttcatagcatgagtgttcaatggttccatctgccaggtgataggcttcgatgtgctccaggccagttctatccccacagtcgaagcccgggtagacggcgtcaccaacgatcgaggggaatgtagcaggggacacggatagcgagcagtcatggccgatgaacacggcccgaccaccgagaccacggacaggcaccgtcttcctcccatccaaatccacccggtacgcctggtacaacctcttgttaccacttagggtacggtgcaccagcaacagctcgccaatattgttgtccaccaggtgcgcgctgccgagcatcctgctgaacctgtgttgcaacgtcaggtcggcggcctccaccagctgcggcgtctggctctcccggctgacctccaccaccatgatggcatcgctggtaacgccgtagaagcgacccgctaatgacatgctcggccggagacaatcgctgaggttgaccgccgtccagcacttgtcgccgggcttggcgacggcgaggaacactgtgttatggatcaccaccgtgcggtcgtcggcgaggccaaagccgtccacgctgagatcacacagcggcagaaggaggtccaacaaagtggtgaccggtgggaggtcggtgagctggtgggtgagtgggtttagaaggcgggcgacatgggtgctctcatggagcaggaggacgaggccctccgtggaggggctgaatactctgtggccccggaactccgggaggtgcgccaggatgcactctccggtggagaggttgaggaggaggcagtggta

SEQ ID NO: 39633 - DNA, 9791 bp, Oryza sativa
ccgtcggcctgggagcggaggggatcgtgtggagtggccaaaatgggcgctgaaccagttgccgatgagacgcctggctggggtgtggggatggggattttggctgtttggctgggcggcaacgcaacgggtgggtgggttccaactatatatagtccgtctgggttacgcttacgcctgctactagattacgtctccgattatgtctctgcgtccatactaaaatcaggccacctaggaaacacatatttaatggaggtatatattaaaaggctatccatctaaggatctactacctcagtttcgaaataaatgcagttgtgggtatccgtatccagcgtttgactgtctgtcttatttaatttttttaaaaaaaattaaaaatagtcacacataaagtattattcatgttttatcatccactccctccattccataatataaggcacaaccattttttttaagatgttccataatataaggtatgcatgcatatagacaattgtcacgtcctgattttcgtttcaggatttataaattatttaataaattattattagaatttatattaaatgttcattaatttacaagtgaagttaaatgtgggaaataaaattttctaaatataaagcatggctggatttaagttttattaaattctccattgttaattatactctctggaattttctcggatttttcggagctcaactcttaattttaatcctacaaagagtagttcagcaattatttaaatattaaattaatcattaaatgatctgattttaattttgttaagtactttgagtgtccaagtattttcaggatttttcctgaaattatttgagcaatggaagtatttttaacaattcaaagatcattttggtgattgatttatttggaaaagtaataaaaatcctcctcctcagcttgggcccttttcggcccattccttcctcttctctctcccttcctcagcccagcctaaagtctgctttacctccctctcgcaacagtgtcatcttcttcctccagagcccctgttctgcccgatgccgtgcgttgcaacgccgccttctccgttcgatccggtgcatccgttgcttccctcccaaaattgattgaaaaaacggattcctctctatctcctctacctaatcccgaagaaaccctcatcaaattcgttatctatctcacgaatttcggccgtttttattcgggtgaactcggataaatcctaacttccttcaccaaatccatccgttcctgagccgatctcctccacccatacctataaatagcatcccctagtcgtcctcttccgtttgccccaagtcccgagctccatcgtcgcccgtagagccgccgccacgttgccctagccgccgccgtcgccggcgatccttcagccgcgtcgcgccgctgctgtggtcgtcgccggccgtcgttcgtcgccgtccgtcgttgttctttgcaccggtgagttcgcgtcgtcgtcctctacgtgtaggtgttctcggatagcccaaccgagctctcttttgccggtcgtcgcgtggaagccgtgccatggccggcgatgacgtcagcgatgacgtcattaatcccttttcttagttttctttattagatgaaaatcgattaaacttcggaaattcataactaaatcatcgtaactcggattcgagtggttcaagttgctaaattcattacatgttaaaaatatccacatgtactgtttatgcttgtttttgtactgttttgttgattttgttctttcgcttaagtttctgacgttttggaggagagcgttttcgttgaggaaggttcagaagcgtttgaggaagctcaaggcaagtcacacagatcccaaaggaccctttaagcatgttgaacccgtttaaagctaatgttttatttcaacttatgcattattttcgaatgtcatcgggtggtgagcctttcccaattaattaatggccgaagatgactttattttcctatgagttataattcgattagctagaaccttatatattggtttggttcagctaaatgctatatatatataattgcttagccatgcttagaaacattagctcattaatggggtgaatcatattacatcatttcttatggttagatttaaattatggttagatttaaatgtagctcatggttatcgtgttatgataattaattgataattaaaacttgtcaatggtgggttgtgagtatatggttttgaaggtcgtgctcatgacaattaaggaccagttcgcgagctattgttgtgaaacatttaccgtgccaaccacaagccagcgtgggcaacgactttaccttttgtatagcatggttcattacggggtgccaaactgagaagcggcgagaagtccgtggggtcgctggggagtccatgccttgtttataagggggtgattatgatccaggaatggtgcactgtggtgagttgtgttgtgcgaagggtattgtcacgatttccccctttgcagtgccgtggtggtacttcggggcatggcaacatgtgtggaatcgtgtcttgtgggtacagtggtacacctttggccagagtaaaactattcgaatagccgtgcccgcggttatgggcgggttgagcaatgtttttcgtgattagtctcacacctctcacaaataattattgatgcaataactggtaataatttgtttagctcctggtttggagttagatctgtacagccgggtatggttgtttaggatggttgggcctgtgcagcattggggtgctgttcagtgttgattaaaattgatgattaattactctactgttttacttctcttaaatgtttgctaaatgctgcttttgcaaatgagcctatattatgccatcctttggtattcttgtgcacttgcatatttgctgtgtggcttgttgagtatgtcatatgctcatccttgcaataatcaatcaacctcagttgaagagaaaggatccagaaggagcagacgtttggcttataccccagttgagctgcctgtgggagtggagctgaagccatcgctagaccgttattccgctgttgtttttcttttcttttgtaagtatgtaacgttattattatgatggatttgtatattaaattgtcagtttgtgtacctcggctgatttctggacgaggattttatgcacaaattagttcgaaaattactagtgaatttccgggcgtgacaacaattaactataaccacttctccaataaattattacttttttaaatcgtacactctcatgctctctaagagcaggtacaatagcagactattagccagctataaatatattttaatgagataaaagatgagagagaagagcatcggtctacagatctgtagccaactgcaccacggactacaagacacaatatgtgtatgataggtgggaccataaattaatactccctccatctacttttgatagtcatatttcatcttggcacacagaccaaggataagtaattctacttatcatccatttaaacatgctactagtcattcctcgtaaacaagcgattcattaatatttacatttctcaatgcccatgtagccaatcatgtgtggaagaatagagagtcacgcattaaattcgagaaaatcattaagaggataggttgttggattgaaatatgcctatcaaaaataaaattttcagatttagaaatataactatcaaaaatagatggagggagtagtatagtaagcaactattatatgaattagctattagattggctataaatgaattagagctagcagtgggctatactattaaacttgctataattctattggatgcatgcattgtatttattaggatgatccaaactacaagatgataataattatttgttggtctttgggttaggggtggttatgccttatattttggaatggagggagtaataacaataaaaaatttaatcataatttttttaaataagacgaacggtcaaaccttagacgtaaacagtgcaaaatattacttattttgggacggagggagtaagttacatgtactaattttccctaaaaacatttatatactaatttaagttaaaaaagaatagtatacacctattccacctatatagtaggtggtaataattaatttcttattttggaactggaaaattaatataatagggaaattaagattcaaacacgttacaagtaggtatttgtttgatttgaattttgaaaaaaaaataatgtatcaaatctataacttaaatccaaatgaataggtttcactgtaaagaacctgaactcagtttccaattcaggaactattgaacaatgtaaaattaatttgaggctttgaactggttgtgtttgaggaaaaagagaaagagaatattggggagatacatcaaggtgagctatcagtgcatgaataatttaagtattaattattttaaagttttaaaaaaggatttttttttgaatgcctagttttaaaaaaggattgatatgatttttttaaaaacgactcttctgtagaaaagttttgcaaaaaatacacacgtttaataattcgggaagcgtatgggtgaaaaagaggtgttttctctatcaatctcgagttgaaacaaattctcctgggactcttactgttgctagactacatttcatgattattaggaaatactaatatgtaaagaaaatactaatattccacagattctactatgaaatattcacttggtcgaatgtggtattggctcacgatcaataatatatgagaaatgcgtactttcattcatcctaccagtatggacatttgtacagtttagttggttcaagttcgaaaccagtggtcttggaccagattttttgttgcatcggattctattggtgcttatgctttcgtctcctataacatggttaacattaggtatgatttaaattaaaagaagagtttatgtgagataaaccttagtaataatattttccttatttcaaactgttaaattaatattccctctaccccaaataagagggcgcccttttttttaaaaaaaaatcaaacttggcaatttttgactaataattatactatcaatatctatgataacactagatttatatattttaaaatactttcatgttatactaatttatagttgatgataacataatacgaaatgaaataaactaatggtcaaattatacaattaaaccataagaccatctataaaattcataggctttacaattaagattccaacgcaaacacaatttggtacttcttcaaccggatttccaatgcaaacacaatttggtatatcttcaaccggatttctggattgttgatcaatgcaaaacttttgatcgagactccaagctttaggatgcgctcgtttcaagttattaggaaccctttctcttaccatgcaaaacgaagcaatggatcagtgcataattaattcaatattagcaaaaaaaacttaaaaataaattaatataaatttttttaaagcaacttatatatagaaaatttttgtaaaaaaaatacactgtttaatagtttgggaagcttgtgtataaaaactgaggaagtaaaagttggacaagtgaagtataaaagcacaccttaagataattttgtattactccattaattaggaaggaaccagaaattttttttcctaaaaataattattcattttgaagccttccttctagtgtcttcccctccccttcccgtcctctcctctcctccatcctcccctccggcctccacccgccgtcgtccgtcgccgttgcgcgcgcgccaccccctccctccttcccgtgcgccgccgcctcgtcgttccatctaagtcgcgagggaacgagctgaaccccatctgcgctggtaagcgcgatggcgaacccgctgcacggctcgggtccgcttcgatccaggtaaaacccgcacccacagccagcgaattttcgttcgatccaatcttgcgccggtggcgtccgaatccctcgtctttgctccggagaactgaatcgagtccctgataactttggggggttgtcggggttctttcggtattgattgcaggaatgcgtcgagctcggacgagatccagctgcggatcgatccggtgcacggcgatcttgatgaggagatcgatgggctgcactcgagggttcgcctactgaaaggcgtaagatttccatttctctccatccttgtttctttctgtttttttttaatttctgttaggtatgctcaattgtggactttttgccattatttgcaagttagaggtctattggtttgtgtgtgcatttgaactttagacctgctcccaatatgttcaggtgttaatatgcagtgctgtaagataaactttgtgcttctcaaatgtttgattcgtaatttgatcgatcaactatattgtttcttgtgcgtctcatcttgtcagtttgttttatacttgatataatcttcaaactaaggagcaagggctgcttgcctgcttctttgatatatgttgttaatatcaataccatatgttaagttacaaaatggttgttgtctaggttgtttcaatgatgtgatggcattttcgacactgatatgatgtcaaactccgattaggtgatcaggacattgtcttgatctatttattagtttacataattattacattgcagtgttccatctgctcttttattttcttttgcttgcttggcactagtgacctatcaattgtaagagccgtagtttggtcatcccctaagtattttttttctctacaactaaacatctaaaagaaatattgttgtaaatcccgaactcatggagagttaagaatttataaaggttctttagatatttacttttagcaaaataaatccttcttgtacgtccaaactaaggctcctatagtgacatggtacttaatattgtctttgttgttatgagcattatgtaatttcattgaaccttcatatggaattgcaccttttgtattaggccgctgtacaatcccataaattatgtgtacatgttatgccagatttcaaccagtaacgagtatgactttataagaaaatccttcaagttatgattttttttttcctttgttcataagctgttgatcttgggttctgttcacatttctgggcgctcagtttgtgaggcttgattgattttttccaggtggcccaggagataaatgctgaagccaagttccagaatgatttcctcagccaactggtactatgtcttgccttttcctttaagcttgtggtcatgacatgttttcctctggtaaataaatatttgttggccttatggctatgtctttttttaccttgatagtggcatgcatttaacccttcatttccttttcctttgtgaatttgtctagcctatccatgccttatgcctaactatcaggatgtatgcttcagagatatttacctatactatttctacatgcttcttcatgtgaaagtatacagatatccatgtttggagttccatttgttctgagttcaattgttgtatatagtcttgaatctattttctttcatgagttgttgtaatatcattctatagttgaatgatgttactgcaatcgcaacagtggattttcttcatgttttctccaacaataatataaatcctagttattctctgatttttgttatcctttttgtggacagcaaatgaccctcataaaagctcaggctggagtgaagcataacatgcgaaggatgaacaagagcatcatccaacagggctcgaatcatgttgtgcacgtggtcctttttgctctgttttgcttcttcgttgtctatctcttgtcaaagttctctagaagataataacactgttagacatatggctataagatagttgagttctgtcaacctagtgaccatgagggtataccattggttttaacttgtatactacatatggacacatctctgaagtttatgtaatggcttctgtgatatggatataatatatcctgacataggtatgttactctatggattaatgcatacaagctatactcttaattccagtttttcttaatcagaataatttcgaagttcctaattaataaatgcaaattatcttaggaactgttctttactccactttccctaacctttactttctatttttgtgcgcacgcttcctgatcaggtaaacagtgcgtttttttttcaaaaaaaaaaatctataggaaagttgctttaaaatatcttagtaattcattatcaagttttattagctaatattgaattaatcatgcactaatccactgcttcgtttcgcgtgacaagagaaagggttcccaacaccttgaaacgagcagagcctaaagcttgaagtctaaatcaatagttttgcattgtccaacaatccggaaatccagttgaagaaataccaaattgtatttgcgttggaatcttaattttagtgtcatactaactctgtccctaattgtaaggcttatatattatatataaggaataagttcactttgggtccctccatttgttgcccagtccgattttcgtcaaccaggtatgacccatcccccaacttatgaaaactgggcaaacatggtccctcggcggttttggctgacgtggcgcatacgtggcttgtttgactaggcctccgtcccacgtggcattgacgtggcgcttacgtgaaaattatctctcggaaaaataataaaaagaatggccccacatgtcagctgcacaaaaaaataattttaaaatggtggggcccatgtgggccccacatgtcagcctcactctcacttcttccctctcccttctctctcttcttcggttcttccctctcccttctcgctcttcttccctttcctctctctccttcccgggcagaggacggcgcgggtgggcggcggagcaagcgagctccggcggcggcggcgggcgtggtcggcgccgatcccgaccggagcgccgccggtccgagtgaaggcgagcagagcggcggcgccctggaagacgccatcgacgccgccgacgaccaagacgccctccgcgcgcgccgggacggcatcgctgagcgcctctacaccgcgctcgtcgtcctcccaccgccgctccacaagccacctacgccgcgctctcccctcccgacgccgtgctccgcctcctcgcctccctcccctgcgaggacctcgccgcccgctccacgtcgctcgacgatgacctagtcgctgtggacgcatccacctccgagtccctcgcggcgctcgaggcccgcgaggccgccgtccccgcgcgcctcgccgaggccgaggcggcgctctccgtggccgtcgcggaggccgagtccgcggagcccccgcccaccgacgtccgtggcgcgctccggtggatgtgcggccgccggccgcatggacgctcccgcgttgtggggcttcattgcggcccgccgtccagagctcgtcgccgtccggaaggaggttggccccgccgtcgccgcggaggatggtgttggtgaggaccagttctgggtgccgtcgccgcggcggaggtggcgagggtggtggtggaggcggagttggtagcggcagcggtggcgagggatgtggcggtgccggggagcggcggcggagtcggtggtggtggcgctagagagagaagagagaggaaaggggatagaaatgaaaacgacgacgctgagtcgcagccgcacgcggacgaaagctcgacgccatccccc

SEQ ID NO: 39634 - DNA, 29798 bp, Oryza sativa
  unsure (1)..(29798): unsure at all n locations
tgggccccaccattttaaaattattattttgtgcagctgacatgtggggccattctttttattatttttccggggagaaaattgccacgtaagcgctacttcaatgccacgtgggacggaggcctagtcaaacaagccacgtatgcgccacgtcagccaaaaccgccgagggaccatgtttgcccggttttcgtaagttgggggatgggtcgtacccggttttacggtcaagggacgaaaatcggactaggtgacaaattgagggacccaaagtaaacttattcctttatataaagaaatactttgaccattaatttattttatgttgtattatgtgattaccaacttagtatcacatgaaagtattttagaatataaatatgaagtataataatatgatatgcataataattatcatagatattcatagatattggtaatataattattagtaaaaaatgttgagtttgatttttttttaaaaaaaagggtgccctcttatttggtacagagggagtattaatttaacagtttgaaataagaaaaatattattactaaggtttatctcacataaactcttcttttagtttaaatcattacaacttagatcccacctatataggtaggtatatttttattagctttttctcatactcttactataatatagcgggtgcatatatttttattagccttttctcatattaatatggatttcctaggagtccttattactttggggctaatataccaagggatctcgtctcctatcggtatcagatctgatactctatatgtgtctgtcggtattcgtcatggaacaagccgatacctgttggtatcagccaccgtgtatcacgtttcatatcggagctaagagggggaagaagaagattcaaaactgttgaggacgagcaacctggaagggcttccttccttggcacttggcaacaacaatgatcggtggtggtctccatcaacaacgatggcaccggcactcccccctgtcccttgttagcaggcacgccctgctatcaccggtgaaccctacacagttagcaacgatgttagaggagaagcaactgctcaaagggaacgcggaccatacgaagcgccatgcgaacaggtgagaagcaccatgggaagtggacaacacgacgtcatatggatgatgggatcccatccaaatgatagggacgagatcatggtagttcgtatttccacattactttactcggtttttcccttaggctttgtttggtttggacgggattacagaagattggagagaattaagaccatgttcagttaatcctcgagagagattgggagttattccttctcaatccacttcaattccttccaaaccgaacaaggttttaaaggggaataataccatgttataacacatgtgaaataaattccctccaatccctcccactttaggccttgttcggttaatccctgtgagggagggattggagagaatttattccacacctattgtggtttggaattatttcccatcaatcctcttcaattctctctaaaccaaacaatgccaaggatttacccaaaataaccttattagaaagaagttagaagcagagacataatcggagatgggtctatttggtagagctccaactcctaaatttagcttcagcagttgggtctggagtggagttgtggagcttcataaacccaccttcacctctctaattcattttgtgagagagcttcacccaactccgctcctgcttaaggtggagctgaaactgtttggctgaacttcagctccagaaaagatggagctgaaactgtagctgtgccaaacaggcctgtaatccagtagcgggcgtaacgtaacccggaccgactcgactaaagcaacggcctcttcgcagtacacgtatagcgtgggccggctcgaccgcacgtccgcacccaaccgcgagctcgatcgagttcaggagcaccagaacaaccaagaaatcacattttggcccactccacccaccgctgtagtacacgagctttcgctttggcctcgccgacgaccgcacggtggtgatccacaacacaagtttcctcgccgtcgccaagcccggcgacaagtgctggacggcggtcgacctcagcgatcatctccggccgatcatgtcgttcgcgggccccttctatgccgtcaccactcaccagcgatgccatcatggtggtggaggtcagccgggagaaccagacgccgcagctggtggaggccgccgcgacctgacattgcaacacaggttcagcaggatgctcggcagcgcgcacctggtggacaacaatggcgagctgttgctagtgcaccgtaccctaagtggtgacaagaggttgtaccaggcgtaccgagtggatttggatgggaggaagatggtgcctgtccgtggtctcggtggtcgggccgtgttcatcggccatgactgctcgctgtccgtgtccccagccacattccctccatcgttggtgacgccgtctacccgggcttcggctgtggggatagaactggccgggagcacatcgaaacctatgataacctggcagatggaaccattgaacactcattctatgaaaacagcgaaaaggattgggaacaccctttgagtatcgccgattatggctgtgtttagttcacactggaagtttggttgaaattggtacgatgtaataaaaaagtgtgtgtatgaaaggtttgatgtgatggaaagttggaagtttgaaaaaaaactttagaactaaatagagcctatatatccttgtgggtgtgaaagtctggttgcaaactcagatgcaagcagcacccgtgagtcacgcgcgcgcgcgccctgaactgcctagccgcgtaccgccgctctgagtggggaaatcgtgtggattaggtaggttagggtttgggccactggaatatatacctctctgatttatgggtcaaataggccaagagaatagaaaagacattatattactggtccaaatttagtagtgtgtatataatacagggtcgggcatgagttatctatggataaaaattaaaacccagctactacccattacttcttcgggtttcggacgggcatgcccatgggcaaaaaaacagacccacacccaaacccatcgggccaggtatccacggatacccggacccgtgggtaaaattgccaaccctacccgtgacaaaattgtctttcagggtaattgcccctaaatactactgggaacacctcagcataaaatgtcacaacccacttcagtgctgttgtacaagcattccaatttctgcgtcactttctgactttctaccattgcctacatttatttagatattaatgaatctagacatatgcatgtgtttaaattcattaacatctatatgtatataggcaatgctagaaagttttacattgtaaaatacattgtgaaatggagcgggtaggaagagtattagtcgtcaggtacagtggcaaattaagcaaaaccgttgaagggaaaacgtgttcacgaaaatacagccaagatagaagtcgtcataatgaaaaaaaaaactagaaacatcttaggtttctgcgccatttccaaacaaaatatcatgtcgataactcgagaatcctgtcttattgaaaagagacaagtgagcctcaggtaggccatcttcacaccgaagataagcaagaggaaaggctagggtaaaaggaagatttgagtagttccgcggccagcaatgcggctctacaaaggaattgctcgctgttgcccacgagcaccaaaaagttttccaatgtttctctactgtaccatttgctctccctattctaacattccgcgttgcttgaaaatttcgaacatagttgaaccaatcttcgctggtgactcaacaacagtaaccccagcctctctgagagccttgattttgtcttgtgccgtacccttgccccctgacacaattgctgccataagagaagagtgaaagtagattagtacatgcaatagctgaacttgatttaaaacgacaaaagagaatgtatatcaacaaacattttttatggaaaaattgggattcatatcctgtcatacataatgttaaccatgttttaggagtaggaatcaaactttgctgaccgctaccatagtacttgatcatggtgtcatacataatgttaaccacgttataggagatggaaggcaaaggcacgatagaatccgatgcaactaaaaatctggtccaaaaccaccggtttcgaactgtataaatgtccatactggttggaagaatgaagtatgcatttctcatatattactgatcgtgaaccaataccacattcgacccagtgaatctttcatagtaaaatctgtggaattttagtatttctttacttatcagtatttgctaataatcataaaatgtagtctagcgacagtaagagtcccaggagcatttgtttcaactcaagattgtacaattgattgaatggagaaaagaatatgcataatccagaaaagcatgaatcacaaaagaaaaatcaaataaaaaaaacttattaagtgaatacctccagcatgacccatgcgacgcccaggtggagcagtgagtccagctatgaatgcaacaacaggcttttgtgttttgctctcctgaaataattgcatgtcaacttcagtaagttgatatgttattgctcatctaatattaaaacacataaaaatgtaagtttcagcaatcatgcaactggacacacacaatagtattagcaatgattgacttcatctgtcactttagtacctggacatgtacagtcctcgagtcatttcatatcataacaaaaagttgaaaactgaatttgttgcatttatcataagacagcaagaccgcttgagtttattgaaagttgaaaccgaactattgtgaataactttaatagtgacaaaggttaataggacatgtacataagaggttatccaaattactattgatagccgaaatcctgattcccaacaaacaaacctgaatgaaggctgcagcatcctcctcagcagtacctccaatttctccgatgagaacaatacctaataggcacagggaaacagttaccaatgatattcattctgtcacccacctagtagtaatgatactgcctaactccgtgactctagtaaacaattgttagaaacctcagtcccttaactaattaatatgtgggatttcaagataaagaaaattgtaaaaagcaggagctctgttttccatatacaatccattttgcttatcctgataaattcaactaagtcagagcaaacaattgtgaaaaatcactaggttggcatatacagggtaactgatggtatacaatgaaaatcaagattaagcctgtccaataaattattgtcaaatacaaaagcaagtagaatattgaacttaaaactaaacatgcagatctaactgagaggctagaggtaaagcagaacatagcaaactaaggacaatttgaattaatattgtgcaacctcagtcagccagtcacagacagggtacctttgtctgaggatcatcaacaaacttttcaaggccatcaacaaaatttgggccaatgaaagggatcaccaccaatgccaacacacgttgactgccccaagcctacggctgttgtttgaaacacctgccagtgaagaaagaaatacaccttaggcaaatgttttcacagattgttagccacactaaaattgatgtgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatgataccagggcaatttggtccaatcaaccgagtttttgattgcttgttcagagcagccttcactttcacctgaaagttacaaagaaacatttaaatgggtcacctcattaatttcctttgacaaaaggcaagtaaaaatagaactgagataatctaaaatataggaaagagtaaagaacgaccaactatgaaacagcatgattgataacactgttttaaggaaaaacagattaccagctcaaaagattattgacaccactgcaattgaactgatcggtggtcatgctgaaactaatggcagctaaaatctcttatttatatgtgtcgtgtgtacagccacttgaataaagtgaaaataatcacgtatgttatttccaatggtctcactatttttttttctagcttctgtgtacaattatgatgaagagaaaacatttgggaatcatcatgcacggaaagaaacatcatattaatggcatgctgaaattgttgtaaattaccatgtcatgctgaggtatcccttcggtaatgcagacaacaaggtcaagttcggcctccatcgcttccattattgcagcagcagcaaatggtggtggaacatatataacagatgcattcgcctttgtctcagccttagcttctgccacagagttgaacaccggaaggcctaggtgctcggttccacctttcttaggggtaaccccacctacctgttattgtgagaagtacttcaattaaatagggtaaaaaaagtacacgacaagctaatcagtcaaattacttttgtttccataaatcaaaattgtaacactaactaaagcattgcagaaacaagtaaacaatgataattaaatagggtaaaaaaaagtacacgacaagctaatcaatcaaattacttttgtttccagaaatcaaaattgtaacacctaactgaagcattgcagaaacaagtaaacaatgataagacatgccatttctttgttgaattgcattcaaaaccaaactagtgctataccatgtaaaaataatcatattttaacaatttcagtgtcaaccttgtgagctgttagaacataatgaaattataacatacaatctgacaagcaccacactgaggttgtcagaaccctctagctggtgcgagacctttatgtaatgagatcttactacattccgtaagcacagaacactatctaatgtacatagcaaacaaaccacaagcaaaacatgccttggtgtatccatccaactctttgaagaatgataagatcttaaattcttaatacaaaagatctactttggtcggattttccaagacagcttacaaggtttcaatgtgtgcagaaagtactactcagtgtacctagcaaccaaaccacaacaagcaacacatgcttcggtgcatccatatgacatttgttcctcatgcaattttccaagagcatcttaaaatgtctcaaagcattcatgatggtatttgtttctcatgctaatatgctgttttagatcaaccagttcctagatttacaaagcatcaagaaattcataaaaacttagtttacttaaggatttttttccctcatcagtaatttgttttccatgcgtaatcactagattgcagtgaaaaacatcactagagccataaaattactagataatatgaacagagtcgtcattactgaagcaccatcaccattcagatttattgagacgtggcaacgaatcatagctttttagccatttcacataacttcgggcaaccaaccccatacggagggaatttatggtagcacatttcaactccaagataaccccagttcggtgtatggcgcaaacaccgttcttctctttccgattgtgaatccagccataaacatagcacctggctggaaaccaaaccctaaaatccgagaaaatgggggatcggcgaccacgcatctacgagatcgcacgccatcggacaccggctctccctcaaaccctaaaatcacgccgccacatggaacgaaatgcggggatcgaagaggacaaacccgagccgaccggggccgcggggatgtgggggaccgggacgtaccatggtggtgccgtactcgatggcctgctcggtgtggaaggtgccgttcttcccggtgatgccctggcagatcacgcgggtgctcttgtccacgacaccgccggcgacggcgcggccgcggccgccgccgcgaagccccgcgcgtggaggaggcgggaggccgcggatcccagcagctgggacgcgcggcgggcggaggcggccatggtgggtggctggtggtggcagcggcgggcggcggcggcggcgcgtgccccttttctcctctcgattcgatttcgtttggggtttttgggcgagtgcgctcctcctccgtttttgtttacttttctggggtctcctcgcgatccattcttgcaggggaagttgggtggtcaaactttccacctagacccttgtatttgtcgctattatcgtgatgataaaaatatagaactccaaattatgctttttctgattgttattgtatttttttttctcattggaaaataataaggaatatactccctccgtttcaaaatgtttaacatcgttgactttttagcacatgtttaaccgttcgtcttattaaaaaaatttgtgaaatatgtaaaactatatgtgtacatgaaagtatatttaacaataaatcaaatgatatgaaaaaaataaataattacttaatttttttgaataagacgaatggtcaaacatgtactaaaaaatcaacggtgttaaacattttgaaacgggggagtatatgagagacatggaagtcaattgtaaagcccatacaaggatgtttcctccctcacaaagaccaaaaagaaaaggaatcttcctctctcccttagtccctctacttcattttccttcaaatttattattcctacccagatatgagttgtcatattccaaagtctcgatataatgcctttccatcattccatggggttgtcaatgtatgacctaccaagaagtttgaggtttttcaatcttcttgtaattcgttggatcaaattacacctaacctgacatgtaattcacgatatttctttttttttccttctaatgatttggtggtaaagtcataggtatctcctagcgatgaaaataatgtggaaatttttcgaccatgccaatactatttttgtaaaaaaaattggtatcatttcttacttttttttctataaaatttagcttttcatcttcatcatattaaagttgccattacttaaattcataaatatagaaaaaattccaacgataccatttccataaaaataataaaaaataatattgtttccgaccatttccattcctacctccaggggcggatccaacatggatgttgggaggactcaacagggggcggagctaaaacgaaatgaaatgagtgccacttgcttaatttactctactttagatcgaatttaagctaatacggatgtctaagtttcatgaccagattccttggcaccccgtaatatactctgcctttgtccatggacccaagttaccctaccctactagatcaccgttgatagaaggatagaggaaggggggaagaggaggaagagaaggggggagggagtgctgaagaaggaaaaaggggatgagtcccccccccccccctcccccctaatcttatcatggatccacccctgcctacctcctcttatgaaactaagaaataagggtacggtgtcactgattgtgcaaaggttaattaggtagattgaaatgaatcaatggaaacccatgcttggcttgcctgtatgtccctaccttctcaatctgaatcaagaggataaaaaacttctgaatatcatattgaactggttgaggcctgagggagaaatcagtgcgtttgttttaacgctctcataattttgaccacgacgagacgatgaaacctaccgattaatcaaatcagtcgtgtgtaaacagcttctaactatgttttgcactaaagctgcattcgctggtctcacttctacttcttctacggttttctttaccctgtcgctgcaaactgcctctgaacactgaacccgtgcatgaatcatgatctcatcaacattactgagcctactactacggtactactctgctacataaatcacaactctgattcagtgatgaagagaacttcacttctaaaagagtatcaacttgttttttacatcggttacatcatagtacaggtacacaatcaacaaggcatgcagtgctccatccacaattacatcccaatacaccaccaccattcacagcctactccgatcccaaaaaagagaggtaagtcgcgtcgacgaacagtcttttcatcttcctccattggcagccattgctaacactccaacacctgaagaactcctcatttgggggtgaaggcctgaaattcacacacaaacatcaccaaattagtgactgaatcaatgtggtatctctgatgagatattcaggttgcaggagaggtgcgtataggaaactgaaactcttttaatcactcgggtgaacgtccactcgtttattacacgtcaactaaatggttataaaaaattttaacaagataaactaatatgcaatagtgtttatggactacggacctggaagatggtggcgtggccggggtcggcgagatgggcgaagaggttgtcgatggggccggtgccggtgtactctgcctggaaccaagctcccatgacggcgagcatggcgagccgcccgttcttgatctccttggtgcgcagctccttgatcttctccggcgagccggtgccccagccgagcgggtcaaaccacagaccaccagggtacctgaacattacgtttccaacacacgaacacgtatttcagccacttgaattacgtcttcgaacaagctcgtgacacacttccatggtgtcagtgagtcggtgtgtgttacccgacgtcggtgccggtgagcttgttgttggggaagatggggtcggtgttgacgcagccgggcttgatgatgtcagcccaccggcggccctcggcccagccgatgaggatgagctcgatgatgaagagggtggtggtgtcggtgaagtattgctgctcgccggcggtgtaccacgacggcgtgttgaggatgccgatcttggtcaggaactccgggatgaagatgcccgccgcgcccagcatcgcccaccggcagtgcaccagctccgcctgcacgttccaccgcaagctctccgggtccgatcctgcgtgtgtgcatgtacacatatgtcagtacgcatgtccagaggcggcggcggcgtcgccggcgacgagctaggaagaagatgagggctcaccgagacccagggggtcgaagccgaagtcgccggggaggctgcgccaagatcaatggcaagtatacgatgtcagtagagagcgagagtgtgtgtgaacgcgtcgagcaagagaggtaagatggatataccgacctgccgtcgagccacggcggcggggtgctgccggggaaccagattggcctgtcgggcgccgcggcgcgcacggcgaacgacgcccgcgcggacgacgactcggcctgcctcagcagcagcctgccgctcctgccggcgccgccgaggaaggaggaggccctggcggcgccggggagcgccgcgacggcggtggtggaggaggaggcggagacgagcgccattggtgcgtcgtgtcgtgtgcgcgtgtggtgatcgaggagacggcgcgtgtggtgaggggcggtttaagggatctgcacgcgcgggaagcgtagctgggatgggcggcttatccgcgaggggatagcgagcgcggccgcgtcgcgccacgcggcgccgggaatccaatcctttggctccgggtcacgctgacgtggcgggatcccaccgggctggtggggcccgataaaaatcagggcgaggcatgccattggacgacacgcgagctccacatttttggcacatgactcgctcgctcgctactcgctacgtgagtggtgagttgcagcagttgcatgtaacgcagtgtcctaaccaaagaaagttctttctatcaagatataatctattcattttatattataatatgttttgattttttaagtgaaacatcaaactttaagcaagttttaaaaaagaatacgtagcaacatttttaacactaaacaaatataatatgattatactatgagaggtccagattagttatactggatgataaaccctgagttccactcgaaactaaagttgttgttggcccaatctttcagtgagttgagataattacgatttgaaaaaaaatattgacgatctgattacaaccgtacaagacgttgcgttgcaccttagcgatcgatacacctctccgtgggttgttgatcttgccgatgcaaatcaaccttattcatgtaagcaaatcgaagaaacaagtaagaataagataaaatcaatatgatattgcaaataggaattaaatacacactataagctaaggttctaaagacaagcagacggacagtctagccgacacgcgcgctgcaagcaagtagcaatggctaaactttgatctaacaaaacccgagaaaccctgaagggtacctagctatttaaggaggtggaagaacgaccatgagggtattagggttgtgctccaccagattggggcgcaccccacatgggctccacatgggccggggtcccagacgaagttccaagcccataggcccactacaggtgacacaacacattgtttcctcaattgcggatgattggaatggaatttggcaatgaagctagatccgttggaaagaggactccgagatctttcgatcaagtactcacgggccgaaaataaagttcgtatgtatatttggcggccctttgaagttagtaatttagtaggtgaccgaatcgaattctagcacttagaggacttgatctttgtcttcttgctgatccatatgatgttagcaatgtttgtagcagtggtacccatggtcacatcactggattatgtcgaatctagtattatatattttaggaccaaggacgtatagaattacgaccttgttagaaaatggattacgcgcctatgctaggtgcgattgagaaatgaaaataagtgtatggttatgattaaatgtggtgaaagaatgaatggttaggattaaactttaccctacggtggataggaaatcttttcctaaacctatttgccaagtgagaccacacgactaatggttaacactagttcaatatataaattcttggcgggaaaaatatcatatattgtatcgtataaatgtcgctacaacacaacgacgtcatgtaattcttctaggttaagggacgtaattttaagagtaagagatactatgtaaatactctcttagataaaaaaagtatcatgacatttgagttttttatagtctttaaggtgtgactttaatcataacattctgtataggtttgtaaactctaatccttttattagttttcctttttgtgaaatacaataaagatgtattccagaggactttgttattgatgggtacatcatatatcactgaaaaaattagccgtgaatatgaacatcctgaacaagtctaagacttcaaccaaaatgggcaggttatactaccatgaacctaatcggtttaattatgctcacttcactaagtttattaggttatgaaagtaacttttcatcaaaaatctacacttaccattttttattttgaaactaagtttttttttagtatttgttgataatcaaagtcttgcaagtttttttaagaaaaaaaaatcaaacatcacgtatatttttttatcgaatagaggaacaagatcctatgagtctggtctggtttactccctccgacccgaaaaaagtaaatctaaaactatatgtgacatatcctagtacaacgaatctggacagaggtatatctaaattcgtagtactaggatatgtcacatccagtactatgttggttttttatggaacgtggagtattttaagagtcgtatgtgtctactctcggaatataatgttcctgaggacttctaaaaagctactagtattaagtatgactattacatctaacaacctatccatatttttcacaattacacatatataatttttgctccaagttccctttcagaggcactttgtcctttctggcaggatgtcttctcaactcataaatcaataaatcgatgtcagtgggacatatatatattttctagtactactgccctggttagttccaaagttttttttccaaactttcaactttccatcacatcaaacctttcatacaaacacaatttttctatcacatcgtaccaatttcaaccaaacttccaaacttcagtgtgaattaaacacaacctatattttaagttctacagatactactgttctgtccaagttcttttttaaagccactgtttttgcggttttgccatatattatatattttaagtagagactactgtttctacagagacttagtatattttaagttctacagagactactgtttttgccctttcgacaggttttgctctatgtcagttgatatactcaatattaaaagagaaattaaaatctcacccatagaaattaaaagaaatgtgaagccatatgctttgaaaagaacacctgccttgcaaacccaacgcaactgcaaaaggcgacagcatcaaaaaccgtgacagatcatcaaaagagcagaaatatgtgatgaagtacatacttgttggcatgttgcatcctcaatcaagagcacctcacaaacatcacaaactcaatttttttttcactaacgtgcactctcaacattcatcatgcatacaccaaattgaaaaggggacgtgactctcaaaaagatggaaagggagcgtgcaccaacaccatctctgaccagagagtgtcggtagaactgggcaattccctcgtgttcatacttcgtgtagtaactttgcagaggatgcattcaaagcgcgtgaactagctagactctgatgtttatctggtacatcattgagtaattacattgctgagcaaatgccataaaacaactcagataatacagcaaatggatgataccctactagttgatcaagattattcgttcaggtagatggttatccttgctctagagtttcttggcagattctgcacatctgaaactatcctccaaaaccatgtttttgcattaggtgcattattatactgagatgtgctgattctactagggaactctgatgcatgcatgtactcacttgattagaaaggtttgttcttcttggagccatgcttggccttgaccatctggttcagtgccttcacgcaacggcgaatcactcccatcgacttcttccccccgtctgggcgctttatcaccatggccaacgtcgcgccaccagcagccggaggcacgggaagtttatgatcagcaataatggctttctccccatttccgagcttgctggtggctttggcttctccgacgatgaggagctgcttctcttgaatcagatcctgaagggagaaccggggcacgtcgtcggcgaacggcggcgtgatcggcttcttcacagttttgcgttgctcctgggccttctgcttcgtgtcttggcattgctgctgtgcctcgagtgacttgtgctcttcattgtgatacttctctgatgtcttctcttcttcgcattgttcagctgtcttctgctccccatcttggtattgccctgtagtgttgtcttcatcttcgtattgatttggcgccttctcctcatcttgacattgctgcaatgtcttctgatcctcatcaagatattgctttggtgttttctcctcttcgtcttgatcctggaacagtttctcctgctcttcatctagataatgatgaagtttcttctccggttcttcatccagatgatcctgaagtttcttctcctgctcttcatctagataatgatgaagtttcttctccggttcttcatccaaatgatcctgaagtttcttctcatgctcttcatctagataatggtgaagtttctcctcctgctcatcacggtgttgattcagtgtctcctgtgcatcaacttcgcattgcagtggtgcctgtagaatcctcaactcctgatcttcatatggacatggtggctgcagctctgtatcctggcactggaacaatgtcttcagcttggcatcttgacgtagctgctgcacaaggggctgcacctgttgatcttgataacaagtgatgagacttgttgatcttcgtgtccgcctcgacatgccaagatcgaagcggcgagatttgttcacatcacactcggtggccattgtcagtggtatgaggagaaagatcaccaaaggagcaacttgcttcttctcaggggtggagttgttataggttgcctgatgtgattagtagatgcatagttcgtactgagaataggtgagctggtaaaatgtccatttcagaggtaatgtctggtttggtcatttggaagatcagtgcctgtcctagtaccctttaacccctacatgaagtgaaattaaagttagtatcagcagacaaagtgatcaatattctgccacaagcccacaaccatctagaatatttgttctgcaataagattttaatacatcaaaatttattttgcaagatgacaatatatattaatcacgcggcataacgaattgtaggaagtagggacaaagttctgaaataaagaaatttctgtgcattttaagctattcccaactacctaagagctgagaaccagcaatatttggtttcaagcaaaagatttgactgacacgtcttcacatactttgactgcaatgttaatctaaagctttattttgaatatatcactgacacctcagataagaggtaatgcccacttgcccaggtccaataaatagcatttcagaaacttactcgtaggttggacgaactgattctaaacaaataccttgataagtacaataccattgaagccaattctgccacctaaaagctaacaacataataattgtctaatataaaatgcacaggtacatcttatgtcacagtcaacctaaacaaagtattgatcttttcccaacattgtacatctcagggtacaccaaatatattcatttacggagttagtgatcttgcttagctgcagatggaactccctatcttgcaaacctcatcgtccactccgcagctatttcatcatgcttagttctatcagtcaagtataaatgtccaatgctcggcacaagtgggcagtctgcacggaaaaaacaatcataatatgaagttatcaagatgaaatgaagcaaaaattatgtgtatattacatagtttaaacaggactgcatgttttatcatggaagatagtgcagaaacagaacaattgtgatcatactgtaacttggaacttacatggatctgggtttgttatgatggctttaatggcaagtagcacctttgaaatagttaaagcaggactccatccttcccttaaaatgtccatactcaagttaccagtggagtcaacattgcagtgataaatccttgtcttgaaagttacctagcacagtgacagaacagttataacttgtaaccacgaattgaggtcccctaataccgaaatatcggataaaattacagcagtggatctcaattgtttcatacttctatataaacattgaaattgctgttccttcaatattgaaattttagcatgttcaactggaagagtgtattaccttccatattattaattactgaaacatcaaatcaagccacaattgccagcccatgtgtatttcctctgtattatgagtgtgctatccactctacaaaaacttgagaaattcacttactattgccaaattatatggagtgtagcattagcagaattaatatgattgccatgttggactgtattgatgtttgcatggttccatgtgctggttaaggtaaaaggtagaccactgcagggctgtgtgttaggtcaaatcagtcctagcattgccctaggcttccagcactgctatctagagaatgggggagaattccagatgctccatcaaatactgaagagcagaaatggaggttggttgttcggatccttcatatcctacctcccatcaaggaattataagttgatggtaatagctgggcaaagacagtaacagtcttactgtcttagcaaccaacaaaccatgaagcaggtgatcatgtagggctgtgtaggctacagccagcaggtgtatactgattagtcaatgtcaacactaaatggaccaaaaatctgcatttagaaggctcatttttttaccagactactatgcaaatagtatattgacataggatgaaggtgatgcccaagcacattaggcttccaatggacaaaacctttctctgtaaaattttaacacagcactatcaaccaaaacaggggatgtctaggaaaacaacattttagaaactctgcgcagttattttcttgaacactaagcataaaacagacttcagataagttttcttcataaataatcaagatcatattgaaaagaggtaaatggtgcttaccttaaaaagaacgcaggtcgctttaattaataacaaaataaactagctttaacataatctcttttgttatctatgcccttctaatcatcacactgtttgctgagttagcccttgaacagaagcattccttgtccccaaaaagattcatgagatattccattttaggatgaatcttaatccttgcagacaactcgacacattttcaaaccccttccaggctaaaatgcatagatcatacacttattttgaagaaactaaaagaagtccggtgaaggtagacttttgaaacaaaataccctatgcatttactaaacataccaatgttcatcacttttgtaataccctgttcacatagtgaagtagaactagctatacaacaatattatcccaaccaattatccatcctatttgaatttctattccacttcttcaagattttagacatgcgcatgtctcttaaaaacatttctttggatgcaagcatttcccatgttaccttaaccacacttccacgcggtaaatcaatagtcgtctatcaatagttactgaagggaatgccatatttattctagatatttgttccaataacagcgatatgatcactcatgaatcacagcattaggtagaatgcacacagacaaggagagaaaatgtcaagttacaacttaagcttctatatgatctcgtagaaagccagacacctcataaccaacagcccatttaagcaaacagaaaaaaaaaaaagaagctaattcttagttcttaccatgggaggtttaaacggatagtcaattgggaatacaatatcgaggaaaaatatccctccttcatacggagatcctacaagatgagcactgcattagatcagcaaagtgaaggtggtcataagactagttcactctacactccacaccctaattccaaacttgaaaaaaaaaaaaccgcgatttcaactagtgaaattcgcagagccgcagtaaaattcgcacgagctttatcggctgctgctagcaggggggagtaagcggagagggggaagggcgatgataccctgaggtccgatgatggtggagagccagtggtagaggttgtcgcccttagggccggcggagcagtcggaggcgttgaggtccatcagctccttctgaatccgcttccccgacgacgacaccgacgtgccgccgctggagccccaggggcgcacgccgctccatcttccacccccacctccgccgccggagccccctcctcctcctcctcagcccccgatggtgccggcgccggcgccggcggggaaaggggagcgagaggtcgggaaggaggaggaagacgacgacatggcctcgacggctggcttacgacttggccttgggggtgagggggagcggcgccgccggcggtggtggggggatggagagcgacgccggagtggggggagagcggcggagaggggaaaggttagagggagtgacgggacgatgaggggaggtgcgaatttatttatttatttttcataattgttgtgatgttcagtgtaaaatactactccctccatttcacaacataagtcattctagcatttctcatattcatattgatgtctgtttcacaatataagtcattctagcatttctcacattcacattgtgaaacggaggtgaaacggaggaagtaattgcatttcaatataaattactctatccatcttaaaaaccaaactagaggagaatttgcaacatatgttcagaaattttatgtggagttaaatcgccacctacagtggtttttttagacgggagtacaaaatatgaaaactaaaatttgagagaaactgatttgagacgtgcttttattctgcgtgacagcctgatagctccacatatactcttataaatccatttttgctgttccagtattgccagtaataatgggccaaaagcgaccaagtactcaaattttaaactgaccacacataaatccaaccctgaaaaaccataaataaatttcggtgccatgtaactgtaacatatggactgctttagaacgtagaaatttttatgtaggacttaattcttcattgtacaaaccaggccagacatttttgcatctgctgcatgagaccaaaaaaaaaacttaacaaacatgtagtactcaacaagagtataaatttagaagaaaaaaaatattagtgagtctgagagaaaaacactgttactcaacaagagtgacagtttcagtactgaagcgatatgcagggagcacaaaacactttttgagtcatacaaacatttcagaaaagaaggtttcacaattcaatactcccagcctggcattcaaaattgatgtatttgactcctttctctaggtcaacgaattttgagaaacacatgccatctaacctcaatacatctaagacaaatatggcctcctacactcctactgacaagatccacaataaatttcgggcatctcatccaaaacgcatcatttttttacagggttttacatgaacaccatgatagacagcaatgtaattaggtgagtcaaccagcacgagtgaatttgtgtagcaaaattgtctgggcttacgggcccagacgccgcaccaccgttgctgccattggagccagtgctgcaagaagaaccaacactgcatcaggacgtagagccaaaaaaaaaatgtagaaccgttagcacaaaaatatcgagaaaggactcaccttcctgcaaaaatgcatgaaccatggcctgcatattttgatccagggaaattgtattaggctcatcaaacagggaaaataagtaatcacccggtccaatctaacagtaaatattcttgatctctttgaacacactaaaaaaacttcaggatgccttctataagaaaatgcatgaaacttcaggatgtgatcatgcatttaactagtggtaaacacattttatattagcatgatcagatatctaaagtctaaggtttcttcaaattttctcgcttaccattcctatgtaatcagaggtccatgtcagacatacacaaactcaaacatgttcaattataaccttgtttgcagctccaaggtgtttactggcgttcaatggcatctaagtcatattaagaataggcaaacaaagtcccaatgaatgagccaatcagttcttttgcatgcacttgttacatttagtttcgcttggatcagaacagtttgtaatagctgccatgctgcataccaggaacaggaagacaccgtagaaatcatgtagtcatgtggatactattatagcatgcgacaggataagcccctataagtttcacagatcttaagcaagtttccatgtaaccagtaaaatattgggctggttaactaataatctaaccaacatgatctaaactgctatggtggctggtggctattagtttggtgaaaacatgcatctagttgttttaatatataaacttagtttttttttcctgcagtactaggagcaaatgaagattactaaaatgttcagaaagtaaatgtccttttagtgctgactgctgctaaccatgcttccagaaaactaaaccaggtaattaccaattgtgcaaaagtgttagtacctaataattgcagggaaattggtagtcaaagagaaagaaaccggcttacttggatcagtagatgtcaccattgccgtgctattgaagttgcatgttccgccacttgctcgtgtcctatggtaataatcattgaaagcataagaagcaacagcgacaatgtcatctgatttatagcatggttgcccaggttgaattgcactgcagtttgcagagccagggccacaggcccaatccaagctttgcttcaatgcgctatgaggagcactagaatttgctacacagaatgtccctcgcaaaactggtgaatctgtattagttgtggccatgtcttcaaatgtaaggctgtacacagtagttgcattggggaacatgatgccccaatttttctctgagacaggtccagcccgaagatcctcattgaacaactcaaatatgaatgtgcttacttgattgtttggctggccaggagtaccagaattatttaatacatggcgtatgaggtttgtattgtaggccaaagcattatccacattagcagccttctcattttgcccaccatgcgatggccacccagaagctgtgaccataacagggatcccagtgaaattcattgcttgcattgagttgtatgtagcatcaaccatagcatcaaacatattggtatagaacaaatttgtgttgggatctgaaatttggctatcagggttgagtgatcgaaacagcgcatattctaaggggaatacgccttgccctttgacatagtcataataaggttgggcgttcagcatgaagggagatgctgtgttgttcagaaattgaagatactgaagcattattgagctccatgtcgaattgaatgtagcagtagatggaggaaatggcttagagatcatgtctgttgaatgaggacttgaaattttcacctgggtattgagatttgcagccaaaagcgctgactgtaggaattgcaatgcaggtacaagaacaagagctgcatttggttctgtagtaagaacctcattccctacagcaatatgcgttatgttagtcgctggaatgtatgcagcaacattcttgttaatccaatcagcagctgtagaacgagattgccccactcgaagtagctgatcatttggaaccccaaccaccacttctattccagtatttgcaagggcagatagcatctgatggtctgaatcaagcagacgaacatgttgaatcttcttttctttcaggatagacactgtgtctgatgctgatggtgggttcgaaatatcagtgccaacattgataccaacaaatgctcctgtggaagtgaataaaattgttccatgaatatatatatggcaacagtcataaagcaaccattttgcagttcaaagcagtaatttgtttggtgtactagcttaactcttcgcatgtattcgagaaaactatctctcgcacaacttggcaaatcaaagcgcaaattgaataaatacaataaagcatcaaccctaattgaaagcaccgtgttacaataaagccatattcatagaagttaagttacaaatgtgctgttacctgaaacattgaaaaccatgagcattaacagaatcaccacgccttttaggctcgctggccacatatttcggtgctctagcatctgatttcttattatccaatgacacttttctcactttctcagaagcacttaaccgaagctgaaatatcaacattgaagaaattattcccttcaaacaatatagcacaaacttcacttaacttctatctttaggaggtaataaatttgagctgagaaaactttaatgatgagaaatacaattccccgcaaaaaaaatgatgagaaataaagaatgcatccacatttgtagaatacagccaaatatgatattaaagcatcgacctttctggttcttcccaaatcatcatcacaaaataacagtttgggacataaatgcagttcaaaagtattcagatactactagttcaaagagcttgccgaatactctgcaaatctgcaaacatccaagaaacaggaaccaggcgctcatccaagaaccaagcaattcagggaatctgagagaaatctatcagataacccgaggtggcggagagctgtctgaagaaatgcctgggaggtgaacggccgaacgggtaagaagaatgaagaggaattcaagcaagaaaacccaaaggggctacgcatgaaagcacatcaacacaaagatgaacaagcaaatcaagcagttacctctcaaaacatcaggacaaatccccaatactaacgctgcctaatcatgaggaaatcagaagaactccgttccccgacagttaaaacttcactgaatataaagcaatgagaaacgtgaaacaggaggacaagagcatggtgatgggctttgtttctgagtgaaacgtgaaattaaaatttgttttggagtcataaacaagcaagctttgaagaacactcccatcacccctcacggttaaaattccattcctttccaagaaacctcggttggtgaaaggtcacgagcacaaaagatcacaagcctccagaaacaaagcaacaaacgggaacatcgcaatcgtatcaacagtacatgaaagaaaaatgaaacaaaccaacaagagaagagaagaaaataattaagccacctgatcttgtccccggagaagagacctttcttccacttccacttcccctttccagatacacacagccaagaacgaagcacgaacttcagattggaggctggaccgctggctggagccagcaccggactactactactggaagcagtgagaaatgggaagccctcttctctctcacacacacacagagaatccgaggaggtagagtagtgtgtgtgtcagtctctcggttcttggtttggattctttcctgcttctgtttcttggaggattaaaacctctccaaggagaggtgattagtagtattgatcaaagtgcataggagacgggattaaaaagaaagaaaagatgaggggattgaccgagagctcagctcagtctcagctcagctgcgcgtgtcacagatccaattaagtttcttgggagacagacatggaggattaaagaaaagaggtgggaaaggtggaggaggaataaaaggttgagcttttctaggctcggagttgggggcgggttggcgaactgatcagcgtggtgtgggatgggatgactggcgaatgtgctggactggagcgtgcacggcgtgtgtgtgtgctgtgctgtgcagcgtgcagttccagaggagcagagaaggccagcgtagcgtactagcgtttctgtgggcacaagcacaatcggtggccatctcttggacgttcggctcataaatccagcgtattctcgagttcattttccggcgcattaagggtgtgtttggtgcaagtcacagtttgccacgcctaaggttaagtaaatttgatagttgtttagttatagttatagttgtggtaatatttttctccaacaaattcggtctcacatgtcaatggctcaaaaaatgtggtaagattcccttagacttagtaagttgtggctaacaatttgatcacctcatcttaggcaaggtgtggcaacttttattggtaagtaatggtaaagtgtggccatgaattaacttccttcaaaaacgattttggtggtgtttagttttcttcaaatttccaaatatttctgcatatcaaatgtttggacacatgcatagagcaataaatgtggacgaaaaaaacaattgcacaatttgcatataaattgcgagacgaatctttagagcctaattacgccatgatttgacaatattgtgctacaggaaacatttgctaatgacggattaattacgcttaataaattcatctccagtttacatgcggaatctgtaatttatgttgttattagtctatatttaatacttcaaatgtgcgtccgttggaggaggaactaaacacgacatttacagtaaatttggtgtggcattccataggagcttcagggattcattgaaattcaggattgaaaaagaaacgagaaacgagaaaaatgcaagtgcaaataaagtattgtaaaatatagaaaaatgctaaaatggttgtttgattaggccatggaaaagaatgcaagaatcaaataagagtatttaaaaatatagaaaaaaccaaaataatcatttgattaggtcaaagaaaaacgtaaaaattgaataagatggataaaaggaaaattttaaatatattgaagcttttgctaacttttttctaaatctttcttgtctcaaatatctttatataattgttttagggttaaatttcttgtgtttttatacaaatcaagaaaggcccgactcttcatccgctcaaaaagcgaaagcatctgaaacaaggtagcctcgagagagaaaaaaaaagggccagaaatccagataaaaggagaagaaagaattcctcacctctagcacggtgctccgatgagccatgctctcttaccacttatactactatttttgtcacataatattgtaatctttgttcatatttattatatgatgtgatgggttttattttatcttaagttataatattttagaatgaataaagtatattgttacgctatgttataggattcacacgatcacatcgctacatcagttaataaatataaacatcattaggaatgtaatattctcctttacttggcacttccccagcactgaggccactgctaatagtagtaactgaaaaccgattcgttgatgaacagtagtgttaaactggctagatctttccgaacttttgtcgccggccagtaatgcatgtggaggataggtacacaaaaccacccaaatgcaaaattccatcagtgatgcaacacatgggctttgtgagttgtaacaattgtttatgcgtatatttactactggtttgaagttgcttttgaacgattgagctatgaccgataaaccttaaaaaaatagcgaaataataataaaaataattatgagcaaaaaaattatactcgtgtcgttagctaaaaggcaatactaaaaatagaatactataaaaacaaaaatgaactctaatattaaatctcaaaatttaaatttcgggcatgcctaacgagctaaccaaaaacaattcaagtgcaaatcatcaggcctctaaaacacgagaatttattacagaaatttggttcgacctcaaatctaattatggaaatttctcattcaaaactggcccgtaaatttgtattccactgttcccaggagaagaaaaatgagaaatactgtagtctctagctcgagccactcacggcaagtcttttaaaagtacgcttctgtatatgtgaattcaaacatttctgcccatgttttgctttttgcgctcccacttttaagctgagaaaagcaccggctggacagcaaggcacgcagaacaaaaggtctttagccgtaccaatcgcatggaactataccgttgtaacgcagctttgtgatactactcttcagatgggtcatttttcatgctaaaaatttctcagtttgcatcccctttttcaatcatgaggagttaaaattttgagaaacaactacccgtttttcagaatatggaaaagctgaattttccggtttctaacttctaggttaattttttgattctatactatagctgcgttcggtagcggtacatcgagagaaaatttttctcattctccacgcccatgcttttcgaattcgaactaaaagacatgtttttgaaaaaaaaatatattggaaagttgctttaaaaatcatatcatattaatctatttttaaaatttaaaatagttaatactcatttaattatacactaatagctcacttcgttttgtgtatcttctcaatgtaatctttttctctcttctcaaggacaaccaagacggtttaggggagttgaagcttatgggaaaagctgtgactagtagtttacatgccaaggatgagagatttttcttttacgggaaaacaacaacggattcaggcatgtaaaccaactcatagttccatactctgaatagtaatgacgatgagtggtgagtctgtcacaataaaaatggtaaaaatacctcaccaacaactttctactttttgtgagaaataaaaaggatagtacgggataaaaaggcatacatgtcagtaataaatacgtacagtaattaaaagattatggaaatgatgataataacaacttaatgatttttttaattaaaatcctgatacaacgcactgtctagtctgaggaaaaattatgttcatgcgaacctgaaatttgtaaacccacatggtgccattgcacgtttgcacggctgggtcggtgaccctattcgactctcaaagatcgtcacggaacaggagtcaagggtgctattaagccccgatctctggcccttgtcgcactcgagaaaaaccaaccctaaaagttgactgtcctgtgctgtcggtagtggagatctgagtaagaggaggattacattagtgcaaacagtacttgctccattattttgtcacagtaggaagaatcacaatttcagttcccaatttcttttctgaaaaaaaaatactgtcactgctctgcttccaagactgctgcgttgactcagcggccgtttcaggttataaaacgttttgattttggtcaaagttaagctattttaaatttaactaaatttatagacaaatataataatatttataataccaaaaaagttttattaaatcaataattaaatacgtttttataataaatttgtcatgggctgaaaatgttttttttatttttctataaatttagttaaatttaaagtagcttgactttcattaaagtcaaaacgacttatcacctgaaaagggagatagtaccattttgcattgcacactttgggattcgacgtagacagggcgcgtttcgtggcagtgatcaatgcggttgttttctcgtcgctttttcgtgttcagatctaccggacgcccggcaacggagacatggcaacgttagttgcggtgagtgggcgaacgacaatagcagcggcggccggtgatggtgacggcgccggccgccggggaacaggggcgcggtgaagacggcgggaacctacgtgcacctcccgcaggccgcagcgctgtctgtgtgcctgcctaggcaggtggcaccgtgccacggcgaggtcggtgtcgctgaattgaaatcgtctccccgcggcgccatcatggcacgcgcgcgcgtgcccgggaccgaacacgaacacgaagcgacaacgccgcgtcgtgcgcggcccggcgttcggtcggtcgggtggcgtcgtcctcccgtcggcaacggcaaggcccagagcgcgtgttgtgctccaacgcactgaggcctccgtgccattctgtggcctgcttggtgacgtatgtgggccttttttattcggaattactaaagctccgtcgacagaaaattctacctcaaatcttgtaaattttggacttcacgattcgtgctcttcttctccaactccggcgaccaactcttcttctctggcgccgacgaacccaaactccggtagagggccgacgaattagggtccgggggtgggggtggggtggggggg

SEQ ID NO: 39635 - DNA, 29316 bp, Oryza sativa
gcctcgccggtgccgttgacaccattcggccagccggcgaggccgggcggtggcgcgctggggcggcggcggcggcggtggcggaggcgctgaggagcggtggcgcgtgaggaattgggaaagagaggagagaggatttttagggttggttgcctgcacgaatcttaaagcaatcggatggtccaaaatttgcaatatttgtgagggggttttctgtcaaatgatctatagacagtccctttttatttgacggggcctttagtaaagaagaggaaaaagtacaccgaaagggtccctcaatttgtcatcgagttaggccctgtttagttcccaaatttttttcccaaaaacatcacatcgaatctttggagacatacatggagcattaaatataaataaaaacaaaaactaattgcacagttatgggagaaatcgcgagacaaatcttttgagcctaattagtccatgattagctataagtgctacagtaatccacatgtgctaatgacggcttaattaggctcaaaagattcgtctcgcggtttccaggcgagttatgaaattagtttttttattcgtgtccgaaaactccttccgacatccggtcaaacgtccgatgtgacacctaaaaattttcatttcgcgaactaaacgcggccttacaaaatcgttccccaaccgcaaaaccagatatattacatctctcaacttataaaattgttcacttcatgtacttcggtggttttcaccctagttttgtccgacgtagccgctgactcagcgtgggacccacgtggatcccacatgtcaggatgccacgtcagtacctctctcttcccctcctctctccctcggggacatgacggggaacagcggcaagagaaaaggcggcccggcgctccccggtgacgggtgcacgcgatggccacaaccttctcctccgggaggccgatgccggtgatcggttgaaggggttggccacgagcggcatgacggggctgagcgccaatgacgggaagtcgagcatgctcggtgacagcaccacctggtgctggtgctgcgctgccttcttcagggacgccgccccacggccgcggccaccgccatcactagcagagtgggcgggagtgggcgcgccaccggtttgagctcaccgagtgggcgcgcctcgtcaccgccaagggcgtggaggatatcgtcttcgtcaacaagctcagggaaggtgaaagggtagttgggacgacaacggcgacgggcggtgggagggcgacaacgacgacgtgagcggtacatggacgacgtcgaccattgcccgccagtgcctcggcgaggcggctcacgcccggccttgcgtccgcctccgcacccaccgtgtctcccgttcagctcgtcgccgtcggcttcctctgggccctcttgtcacgcccagaaattcacgaaccagaatttctaagctgaatgtgcattaaacccctgtccaggaccagccatggtacacaaacgacaattgttgacatacagatccacgtcttataaaaatataaaagattacaaatgcagcggaaaagataaaagagagctaagtctgaagacttgactcctgcagtgggtgactccattccacaggcatccttgacggcagcgacgaaaccaacttcttcgagacagctccaactgagaagaacatcaactctggtgtggggaagagagagcatgactgagtactacctactgtactcagcaagtcataccagaagggcaaaggaggctaaaggttcatttgcataaagcagacatttaaaagcagtagttgaaagcagtaaaacaattgttgtaattaatcaatattaaccaatcactgtccaacgctacaccacgttgcaacaggcccaaccaaccacctgaactacaccagttcattatctaactaggggtgagactaatcacggttaatctggttgaccacccataaccgcgggcacggctattcgaatagttttactctgatcagaggtgtacaactatacccacaagacacagccccatgacacgttttcgtgcgccgacatgccaccacgacataccggaaagaggccgtgataggacccttcgcataaccccctctaaccgatcgtaccacacctcagggttcgcccccgttcccagtaggcaacgggcagcccccctctcgtgccacggtgaatccgaaagccgatcaaccgaacaccccggccgacccaactccatcaagcccaccctaacctgggtacgtcggctagaggaaagctacactacaagcccagccgttgcccacgctggcttgtggtaagtacgatgaattcttccagggtttcccgcgaaccggtccttaatctccatgggcacgactagtaaaaccatgcacccacagcccaccatgtagtgtattttaattagctaacaccattgcggtgtcactattccaaagctatgccaataattaaagtctatgcattaatgtgattccccctttatgtaatagttgaactaaacatggctaagcattccctaaaccaacatctaatcattttaatacccaagttatcaatggcataaggtaaacaatatatggctgagtagtaggacccatcccacatgatattgtaaaacaatgcaacatttaatagaaatgcgggacatttgtaaattggttacaatatgatcaattgtaatgcatgacttgccttgctcttgtaccaatgagaccacagcaatgtcttcggggaaccgcggatcaacgaaacggccgaaatctatgcgacaaacaaagcacacaagcaaaacaggctataagactactgaaacagagaacaaaaccatttttaatggattctatcatttttatgaatttacttagacttgaatgtacttaatcggaactcggatgaattagttataattttagaagattaaatgtgtttttactataaaaagaaaagccttaatgagatttattgcgcaataaagcatcccggataacgttagcaaaggggggggtttgcttaaataggagcgggggcggagagtcgtggccgggaaaccccccgatttggccagcgacgtgggggagtggggaggaagagagagggagggattcgaaacgaatcccgcccattttagggcgtgtgcgagggcggggaagcggggaggaggcggcgacgtgggcgcgggtgcggagtggggcgcgagaggagcagcgtgggggcggcggtttcggtggcagtggtggcggttgccggaggttagggacgaccccgacaggtggggtccacctgtcggcgtcccagagagaggagggagggagtttagactgggccatggccacggggctggcccagggaggaggggaagatgtgcgcgagaggcgggtggactgggccgacggcccaacaagaagaaaaagggagaaaagaaaagaaaggaaaagggaaatcgatttccatggaattaaataatgcacatgctcatttttaattggttaaaattattttttgggctctgaaaattccactaaaaatcctgttagaatattttgacatgtagaatccaagaaaagttccacatgccgattctaattatgatttgcatttttttgatttagggtttctctcttgcttttaatcaaataatttcttgcaacaatttattaattgaattttggctagggtgaagaacttcagggcgtgacacctcttcccctcatgcctccctctcgccctccccgacggtagcgaggtgtggtggagctcgagggcagcgagggtggcgcggcgtcgtgggcgggcgctaggtagcagagctcgagaacagcgagggcggtgcggagatggggcagggctcgtggactgcgaccccggcgcggcggcctgctcccgcgtcgcaaccgccgccgttgcctcgtcgcccgccgccacgtcaccgaccaccggatcacctttcccacctcgccccggcgtcctcctccccagccgtcggccggcgttgcacagagaagagaagagaagagtgagaaagagaagaggaagggataggagggggaagaaagagggtgataacatggcatcctgacatgtgggtcccacgctgtctcagccgccacgtaggacaaaatcggggtcaaaaccaccgagggacctggtttacactggttttgtaagttgggggacaccggatatctggttttgtagttgggagatgattttgtaactcaacgacaagttgagggaccttcggtgtactttttcctaaagaagatagccaacagagtcacaatttccatggaaaccgattgaattccgtgaaaaaccgaggttttgacgtggctaggaagtagtagccgtctggaaattcgatggatttcatccaaattcaaaattgaactgatagaaaccaaaaaattcaaataaaatcctacaaaatagtatgatatttgcataacatgttgggttattttttcttcttcaaaaactcggtgagttccgtgcctttctcgaactgtacggtaggaaagaaaaaaataataatggtttagacaaaagaaaaccctttccttgaactgtacaggatgaatttcatgtattccatgtcatagaagctaccgtacaattacagtatagcatgtagtgtttattggactctaaactgtgtataccgtatacgtagagatggaaaaaacaatcaggcgatcggaatcgatcagagatgtaaaccattaaacacgcctctctagactctacatctaaaatttatatggtcacttaacctgaagactgttcataatcagaatgaacaattagatggacctcgaggcctcgactaattaatcagcctgactgttcattaattgtgtttggatgccccttttcccaacctctctctcgttttccgcgcgcacgttttttaaataaacggtgtgttttttaaaaaaaattgtataccaaaattattttaaaaaataaattaatccattttaaaaaaaatagcaaatatttaattaatcacgtgctaatgagctgctctattttacgtgcgtatgctcccatccggctgtagcgaacacacccaaaccatttgacaaggtaaggcaaggattatgccttcaggggacaaggattcttcagtattgttcaaaaaaaaaagttgtaaaaggaaaagcaaggattctgaccagcaactgtttacgaccatcttaacaaactggtgtgacacattacgattgaatcttgatttttcaaaaatactttaaatccaggatgagacgtttgcagactagcaaatctctctcctttatgggtcgcgtcaagcaagcacacgggttcttttcgcggaataagtttacttcatgaccctcaaagtcatcgaaatctaatccattaccctaaaccacaaaaccgaatatctcgacccccaaactcttaaaaccggtgcaatttgactccctgggtggttttggagggcggtttcgctgacgtgacgcctacgtggcagtattaactcggtcttttttccacgtggcgttgatgtggcgcttaggtggcattagaaataaaaaatatgtgtgggacccatctatcattcatacacaaaataaaaaattgtggggcccactgacatgtgggccctacatcatcctctatctcactacccttcttcttcctcctctctccgttgtttctctctctctcccttgacatgagccgtcggcaggaggggctcgagtgccggagtggtggtgggcgggtgccggagtggtggtggcggtgggcggtggatggtgtacctcggacgacgggcgcggaagcagctccttctaccgtaccgggcattgagcgacggacctcgggtgacggtgggcggtggacggtggggagcatgggcggcgggagctgaagcggcggcggcgacggcggtgggctggaccgtctggctgctgcccgccccctccatctcctcctcctcgtagtcgtcgccgctgacctccccgaccatgccaagtaccagatcgagaccagccgcccgccgccgccaccgctctcgtctccgacctttcagctgcggccacagccaccacccacgggacgcgtcgccgccgctccaggtcagcatgcggcagcaccgtcatgagcgcgagtgcgggaggaggcattggcagtggcgacaacacgagctcggcggctccgcctttcccctctcctttccagccctcacgcaccgccaccgcctcacatgtcacccatcacctccgttccccccttacctgctctcctctcctctcctctctccacttggctaggccgatggcgaggctgccgccaccaccgccgctctggcccccgcttgccgccgctccagctccagcctcccgtgcttcccttggccggccaaaggggagaggagaaagagaaagaaagagagaagagaggaagaagaaagggaagagagaatgacatgtgaggcccacatgtcagtgggcctcacaattttttgtgtgtgtgaatgacagatgggtcccacgcatattttttatttctaatgccacctaagcgctacatcaatgccacgcggaaataagaccgagtcaatactgtcacgtagacgccacgtcagcgaaaccgccctccaaaaccgcccagggagtcaaattgcaccggttttaagagtttggtggtcgagatatctggttttgtggtttagggtcatggattagatttcgatcacttttgagggtcatgaagtgaacttattcctctattcgctcgtgtgcaatgttcgttccgaacaacagcccaagcttacgtatatgggccgtactacggagcccaagcaaagattctcgtgggcttaattgggcttctcggccgaccacaagaaccaaatctttgcagaaaaagttggagcagctgccaactttctctggacgaacatgccattgccatccatgggaagactgataaatctctctacccccggctgtaaagggtaagcactatatatactatatgacaggaaggtgataaagcagggatgctaaattgctactaggatcctcaaagtcttatagtggtcgtcatatcattggtggaatgtgccttgaataatttggttacctagcagagcaagtttttgaggtcctatctttgagtagattcccttgttttgggatcaggtcacacaacaggtagtgctggaggagcgaaatatgaccttcttttacactacaagggaggttgactcagctcataaacttagatctaatattaaacattaaacaatgaaaagacatctaacattaaaagtacttcatctgcgttaatccaagctggcatgcttgtcgcagaaaggcccttcgacgaggagttttgacgtttccaacgtcaattgttgttatctttggggtaggtggcctctattctatattctcttctctgtacttactccccgtgcattcttttctactatcctctaggacttctgcacttacgaaggtgaagcttgccctgtgtaatatcatttgacgtaatatattcaagtggaaaactctcccaatacaaaacaaacagttctctaaaaaaatacaaaacaaacatattatccaaatatatttaattttatatttaataaaattaattgggagttataaatgttactattttttctataaatttaatcaaacctaaagaaatttgattaataaaaaagttgaacaacttatagtatcaaatagatatagtaccttggatggagattttgggatggagagggagtaacagaaatcgtcgcatgcaaggtggtttttctacggcatgcagcacctaggccgcatgccgttggatggatcccacgattggtgctgtatgtaaagtgctttgggcgtatatattttgtatattgtggtggacggtatataccagacattatacatgaggtaaagagaagactactttacaagccgtggtcccgcctcccccgctttttttttatttttcccctccaaattattgccgaccacacatctcgccgttgtgttccagaacacaccatccgcggattcccccttcctcccccgagcgccgccaccaccatccccccaccctcctccctcctccgcctcgtcgacgcggcggcgatggcgtccacgcggcagcagaacctgggcccggatgttctaccccatgccactgccgatggatgcgcggcggcggttgatgttagggtgtccagcgacattgccagtcaataagaaccgggcacaatcaagaagaacccggcggatgatgttagggtgtccagcgacggatctcatcctgagttgcgacgaacacgaatgccacaagcacgagagagagagagagagagagagagagaggtggaggcggcggaggggaggctgctgctgctgctgcggcggcggcgcatttgaattggggtgggaggaggcggaggggaggcggcggcggcggcggtggagggggatggtgaagctgagcacggtggcggtggtggcgtgggtgctggcgtcggcggcgctctgggcggggctgcactggcgcttccgccgcccggcgctgcacaaggccgaggaggccctcgtctgcatttgcgaggagcgcgcccgcatgctgcaggaccagttcgccgtctccgtcaaccacgtccacgccctcgccatcctcgtcgtgaccttccactacgacaagcaccctcccgcgctcgaccaggtcggtccgacgagcttccgccgcgatgatgatgatgttgcatctgttgtttttttttttgccccccgcagttaattgcgataatgcctcgatttttactcgacatcttggccgtgtactttgctctgctgctttcggcttcatttaattctacagtgaccttccatgtcagccatggccatggattactgctccggtcccttgttattaaatggagcgcactttttgttgggactgggaggaagtgaattgattgtgcttgcttgcttctgttggtagtactagtgatttcttcggctgtgtggctgaatcttcttcgttgtgttgtgcgtgtgtgcaggacacgttcgccgtgtacgtcgcgaggacgtccttcgagcggccgctgctgagcggcgtggcgtacgcgcagcgggtggtgcacgccgacagagagagcttcgagcggcagcaagggtggatcatcaagaccatgaagcacgagccgtccccagcgcaggacgagtacgccccggtgatctactcccagcctcccaggagaccatctcctacatcgaggaagaggagaggagagtcctaagtccatgtcaacatttcatatctcaggaagagtttgaagcaaatgaggaaacagggaggctgatctgtggccacagctatcatgtgcaatgcataaagcagtggctttctaggaagaacacctgccctgtctgcaaaactgttgtctcaaagacatgaaatccaatcagtccctaagcacacttgaactgaaaagtgtgaaaaggacttgctctttcacagtgttgtttgtgattgtacagctctgtttgtacatgatgctttgtgtaagcacaagcctgaagcaaaccatctcatttgcatatagcagtttacatgttttcagttttcccagtgtctactgagtgttaagcatttgcttgtagaaacttacatgttttcagttttcccagtgtctactgaatattaattcaggtgaaagaaaaaaaataagaagagaacagtttttttcactaatctcagtcggttttcatgtctgttggattcgttcgcatgcaaaggcaaccgtatccacccgatcttccggttggttttatatactgaattgctatatcttaatcgacagttttcttgcaacgaatatgtcacttttcatattttataaaaatttacacggtagttacacaccacttagatatgtaattagtatgtaattttaggacttacatatgtaattttgagacttacattgtaaatacactaaaattacatatgtaatttaaggacttacaatgtacttacaatgtaaaaacataccgactattttttggtgaaaaatatggcgccataaatatagctactcccattttttttgtttgaaattatattgcctttttctgaatctcaattctgacccctgcatttcccagcgagaagcttcagacagttcagtgtcaggactctcctcttcctcttgacgttggacgacggcgccctcggcttcgacgaggatgacatcctccgtgacttttccattctcgtcgtcgccgccgagccgctccctctcgcctccaccggcctcctcggcgtgttcgtcacctctgcatcggcggcgctcgcttctccgagctccctctcgatcgcctcggcccgcattgcgatctcctcgctggttcgccgcgcttccgtccacgcctccgccgccgccgccttcatctcggccaccgcgtggaccacctcggcgcgccccgtcaggtactcgtactcgaacctggggatcgtgaattcgtgacgttcctggacgacgagctccgcgacgtcgcggccgcggcggtggccagcgtcgcgctctcgacgatggccttcagcctcgccgtcgccgcggcctccgacgccctcgccgccccgagctccctcaccgactctctgatcctctgctccgccgcggcgatctcggcgtcgatgttctccgcgtcggacatggcgcgccggttctccgtctccgtcagcgtcttctccttctccgccgcctcggcgtcatcctccagctgccgaaggatcgccgccagcttggagatggtctcgtcggccctctcgtcggccgccgtgacggcttccaggcgagacctcgccttgagcagcttggcgttcagctacttcacctgcgcgctcgccgccttctcctgctccgtgaggcgggggatctcgtcggtgacccgcgccgtctccctgcgcgttcgctcgatggacgtcgtgaatcggaggccctcttccttgatggactccagcacgatcctcgccgagctcagctccgcctccgccgcctgcagcgatgactcttcgtgttcctgctcgtgtctcctcgacgccattgcagtggcagtgtggcacccgttgctcccaccactgccaggacgccgtgctcctcgcttgctccgtccgcatctcgctccacgccgccgccgccgtcgccgcgcgggccggagctcaccggaacattcttcggccggagactcgtcaagcctggacggagcgctggaccgctggttcggtcgacgggggatgcagtcggcgggcggcgggctgctttaaggaagatgcaggacgcgtgtgccggggaggggggcgcgcaggcgcggtggcggcgccggcgggcgactggcaatcggcggcggtggccggagattaggtcacggaggtcggaagctatcgagacgatggagagggatggaagatatggaatgtatcgaacatatatgtgtggtcgagaaaaaaagtgagtagtcgtactccgtagtccgtacaaaaagcatcttacggtggggtcaggtgtattttggatgcacgcgcaaaataaaaatacgacgctacctgtacatgatatgtaaaggtgtgcacgaatcttagagcaagttcaatagtatagccaactactagctctaatttatctatagccaatctaatagctcattcatacaatagttacatactacactattaatatatggtcccacctgtcatacacacactgtaggagtccgtgctacagctggctaccaatctgtagcctgctgcacttctctctgctcgtttatctttttaaaatatatttacagctagcttatagcccgctattatagctatcgtgcggatgctagccaggtgccgcagcacctaggtgctaaaaggacgttccgccatgatgtttagattccctgtgaccaatcgcgtaggtaagcatgaccaaactagttggccctccaacaagccaacaactactcctgcgcacgtttttttgtctgatgctgcagttttatagtactatgaatacagtctgatgagtgatgacattgacacccacctgctgcagttttatattgaattcggacagcagtcaccactccctcagtccctcgtcgcgtttcgtcggagacaatggcgacgccagcacctgatgtctcggccatcggcgcggccctccgatccccggcggcgacggtaagcgaggccgacgtcgagaagctccggctcatcgaagaactgacctccgacgtggacgccgtgcaggagcgcgtcctctcggagatcctcggccgcaacgccggcgcggagtacctcaccaggtgcggccacgacgccggcgacaccggccgcgccaccttccgggccaaggtgccggtggtgtcgtacgacgacctgaagccgtacatccagcgcgtcgccgacggggactgctcgcccgtcctatcgacgcaccccatcaccgagttcctcaccagctccggcacgtcggccggcgagtgcaagctgatactcgtcgccatggacgactccggccgccgccaggcactgcacggtctcattggacctgtcttgaaactgtaagtcaacctcttctacatggcacttcgccagtccgaagaaaagtgatatcgaacatttcgcaatgtatatatagatatgtccctgggcttgaaaagggtaaggggctctacttcatgttcgtcaagtcagagacgaagacacgaggcggcctcacggcgtggtttgccctgacgagcgtctacaaaagcgagcaattcaagagcatggcaattgcctacacgagccccacggcggccatcctctgcgaggacgcgttccagagcatgtacgcgcagatggtgtgcggcctgtgccagcgccacgacgtggtgcgcttcggagctgtgttcgcggccgcacttgttcgggcgatccgcttcctccagctcaactggggccagctcgccgcggacatcgaggccggcgagctcggcccacacgttgccgatccgtcggtgcgcgaggccgtctccgggatcctccggtcggacgccgagctcgcggagttcgtccgcatcgagtgctccaagggtgactgggccggcatcatcacgcgtatttggccgaacaccaagtacgtggatgccatcgtcaccggcgccatggcacaatacatccggaccctgcagtactacagtggcggcctgccgatcgtgagcacctcgtatgcgtcctccgagtgtttcttcggcatcaacctccgccccgtgtgcgacccgtccgaggtgtcctacaccatcatgcccaacacggcctacttcgagttcctcccggtcggcgaggtcgtcgacgcgaccaacctcgtcgacctcgcccgcgtggaggtcgggcgggagtacgaggtggtgatcaccacctacgccggtctgagccggtaccgcgtcggcgacgtcctccgcgtgacggggttccacaacgcggcaccgcagttccggttcgtgcgccgccaaagcgtgctgctatccgtcgagttagacaagaccgacgaggccgagctgcaccgcgcggtggagcgcgcctcctcggcgctcctccgcccgcgcggcgtgtccgtcgcggagtacaccagccgcgcgtgcaccgaacgcatcccgggacattatgtggtctactgggagctactgaccgagtcacccgtcggcgccggcgacggtgacacggtggacggggagacgctcggcaggtgctgcctcgagatggaggaggcactcagcgcggtgtacaggcagggcagggttgcggacggctcgatcgggccactcgagatccggatcgtccgtcccggcacgttcgaggaggtcatggacttggccgtctcccgcggcacgtccattgggcagtacaaggtgccccagtgcgtgactgtcccatccgtggtggagctgctggactcgcgcgtcgtgtctagccaattcagccctgccctgccgcattggatcccgactccacgatccgactagcaatgcatcctgtttggcatctttattttaggaaaggaaaacgtacaccgaaggtccctcaacttgtcatccaatcacaaaattatccttgaatcgcaaaccagatacaacacgtcccccaacttataaaaccaatgcaaactaagtccttggcggttttgactctggttttgtccgacgtggcagctgactcagcgtgggacccatatgggtcccacatgtcagcctcttcttcccctcctctctcttctcttcctctctcatccctttccacggcgacggtgatggagagcagcgatctgggagtagacgacgttcggtgggggaggagctgggcccgaccggcgaccggcggggaaagagcggggcacggccggtgagggcggagatgggcgcggccggcagccgacggggaggagctggaggcggcggtggggacgccgcggcgacggcagcggtggaggcgggggcggcggcggaggcaggggcgggggcgccgcggcggcggcgcgggagcgcaaggccgggagctaggttccgcagggcggggaggacgacaaggtggtttggcggcgaggcgggggagagcaaggagaggacgtcgatggtggtggccccggccgcgacggccgtggcatcgacgccgctctccctcatccacgcgaacgcccctgcagcgctctggaacgagccgcacgcggtcttgatcccgacgtcggtggcccggtccacggcgagcgcgatctgggcataggcaaggagcacgtcccacctctgctcgagggaggggtccgggagcgacggctgcttgacggagctcgacacggtggggcacgcgcggcatcccaacgtatgcgcgctcctcggctgttgcgtcgaccgcgacctctacctcgtcttcatcttctctggccgcggctccgtctccgccaacctccacgatcagtacaccaccaccaccacccaatgacacaaacgtaacaccaaacagtaacagcacgaacacgccgccattaatggcgtttgacgttttcttgatcgattttgccccgatgtgtatgttgcattgcagacgagaaggcgccggcgatgtggtgggcggtggggtggattgcttcggcgcgtcggggcgggggatgtcgtgttgagatccgccgtcgcctcgtcgcccgtcgccggccgccgaactctcgcctcccccaccggcttgctgtcctgcccactgccgaactgaggagagggagagaaaagaggagagagagaggaagagaggggatgggaagaaggggctgacatgtgggacccacaactgagtcagctgccacatccgataaaaccggagtcaaaaccgccgggggaccgccgggggatctagtttgcactggttttgtaagttgggggacgtgttgtatccggttttgcggtttaaggacgattttgtaattcgatgacaagttgagggaccttcggtttacttttcctttaggaaaaggcacggcccaagataagtcgagccggcacagtccgatcgccacggtgtgtcgtatctgtccacgggctgcacctacagcccagggatgacctaataggactcgggccgtgctgtaccagtccgaaggcacggcttacccaccgcgctcattctcgaaataaatctattttgcctcccctatctatttgggtcgtgtcttatatggttaaaataagtttattttgcctccctcagctcttcgggcttgctgtcgacgggctacttcctgagggagtgggggatgttgggtcacagttgtgctgatcgttgggttgtgccatgctaggttggcacgccgtgccaaggaagagacctaggcacggtccaactgttgggtcgggctggcagggctcgacaacagtcggggcgtgccgtgtctgagtcagaccaaaccttagtgttgtgggccagatcatcgggctacaggccttctggcctttactgctgcagttttatggagtctaaataaagtctgatgggtgtcaatgtcatcactcatcagattttattggataagtttacctttggtccctcaatttgtcgtcgagtctgaaattcatccttgaaccgaaataccatatataacttatccttcaactcgcaatactgtatcaactttagtcccttggcagtattgtggccggtattggctgatgtggcgagtgaaactcacgtggccccacatgtcagcggctcaactcttctacctctccctcttcccccctctctctccatctctcgcatcgaacgacggcgagtccgggccagggatggcgcgctaccgtgtggatggcgacggcggcacggtagtgagagcggtgtcggcacccgctcatgccgcaccacctcgaccagcttcgccaggacatcacctttctcatgacgagcagatttgagttattgatctttttttcttccttctggttctcctttgctgtttgccattgagagcaaagctgagttcttgatgtccctacttctagttctcttcacgatctgtgttcttatgccttaatgcctttatgtcgggggaatgtacggtggtgaaaaactgaaaaaaaaacacagcaccatctatagattttagggggcctgtgatgatatatgcctggaacaaaaatactcactttctggactgatttggctttgcttcaccaaaactaggagctttgcttcttctctgaaagcgtgtatgttgtggactcgtcctgccgtcgcaccgccactgccttttggaggatgagctcgtggtgacattcattttgttttgttggatttgctgtgcgttcatgcaggcgaccactcgacaagtcgacatcgactgcatacacggcaccaccaccagcaagagggccgcggggaaggacaaggccgccatgcaggagtgtcatgcgtcgccacctccagcaaattacttcaagaataaggccgactacaatgctgctgcagcatccgcatccgcgggcgccatcaactacaagtgacgatctacaagcccgggagcggcggcgctgagacgggctccgactccgacctcaccgaagatgacaacgcctgttgggaatctctcctctctgaatgtttaagtactaatcactagcactaacataaacacttgtatttactcggtggacacaaacacacaagaactgaacaacgcacagctttggtcaaggcaaccacacaccggctcacttcgttttctttttcttttatagactcacacagtacatgcagataacagccagccaattctcatgaccgggactcacgctatgcacacaaacgtgcagatgccatgcaactaactaactaactaatcctacttattctcctgcgaagaagtcacttcgcggctgcttatccgggatgctgatcctcatgcatagctagctcctaactaatctcatacgtgcatgtatgcatgcatatgctaggaccgattcactcggctaatactgaccttgcgttgcttgcaatccggctacttctctcagcactccacatgcagttgagcctggtcttcatgaatgttgtttgctccactctcgcgccaccgcatcgcacggcacgtcggcatctcgcccatgagatggaaacaaactaactatgcagcgtccatgtacctcacgtacatagcttctagcatgtgacctatacaaaccacttactacatgcatatgaccaaacaaaaaacatacttttacactaatgacaagattattgctaacaacgccatgctcaccccgggcccccggccatggtggacctccccgacgacgtcctctctccctgaggcgacggcaccgatggagtgagctggaaaggtggtggaggcgatgtgtgcgtcggcggagcgacgcgtgaagcgaggagcgcgtgcattgcggcggaggtttgctgttcatgagagatggggaagaaaggaaaaatggagagaagatttggtcgctgacatgtggatccacatgggttctactcgctacgtctaccgaaaccggccatcatatgatcgagggatgaaagttgacatagtattgtaatttggggatggaccatattggtggacctaaattgaacttattccgactttattcatactccataaaactgcagctgtagttggccagaaagcccgtagcccaatggtctagcccacagcacagagatttgatccgatcagacatggcacaactcgactgtgctagcccgacccgactgttggaccgtgcctgggcggctgggcctcttccttggcacagcgtgccgatccggcacggcatgacccaacaatcagcacaaccgtgacccgacatcccccgcttcctcaggcggtagtccgttgacagcgggcccgaagagatgagggaggcataatagacttatttcagccatacaaggcacggcccaaagagataagggaggcaaaatagatttatttcgaggatgaacacggtgggctggtcgtgccttcagatcggcacagcacaacccgagtcttattatgtcgtgcctaggcgtaggtgcagcccgtggacggacacggcatgacacaacacggtgtgtcggtcagactgtgccgggccgacggatgttgcactagtggagaacccatttttactactggttggtaactctctttagtcctggttttccaactgggagtagaaatccgggactaaagatgaacttttttagttctggttggtgttaccaaccgggagtaaagagagaatagcagcagtatcagatggtccctttttcttttcttttttcctttttattttctcccgaatcaagtgacatgcaaatccccaaatccccaaatcaaagtaacatcccaaattcacatcacaaaatccacatcacaaatcttaaagttacttatacacacaaatcaaatacatcacaaatcctaaataattatacacaaatcaaatatatcacaaatccataaaataaatcacaaatttatacatctcagtgtatcacaaattaaaaaaaaacaaagccgctaccgcccctcgtcacggccgccgcctgcggccccgccggccgccggcccaccggatgggaaggggaggaggaagaggagaggaggaaggggaggaggtggaggagaggggatgaggaagagaggatagatctgatctgtaggagaggagagggggagagatttgatctgtgtgagttgcgattgtggaggagaggataagtgatagggattatatactacgcgttcaattttagtgccggttagtaataggactaaagatccagatgatctttagcgggactaaagatcctcggccccctgacatacatctgacaggggatgaacctggactaaagatgatctttagtaccggttggtaataacaaccggaactaaagatgatagaatcccggtagggtttttaaccgggactaaagatcatttttagttccggttctttttggaaccgggactattgtggttttgggtcgactcagcaaagatcatttctccactagtgttgggccgtgctttttcccaaaggggataatattaaactactaggcggcgcctggtagtatttctgctaaaaaaaacaccagtagtgacaacccggacaagccaaattaaatcaacacatataccctattaaaaaacggttttgctatttcacttgcgatagatttttgggcttctacctttcgatttttgaccgtaggatcttgtgtcaagattcatgttcctttaaattcaacttgcagttacacttagttacataacatttacacttacttacatagcacattcaattacagtgcatcaaaatttaatttttacaacaactttttttcgttagatttatgatttctgacatgcttgttcttgttttgttaattcactaaaaagagttattacaaattccgcaagatttgaagttacagatctatcgaaagataaataggtagttcctttttttccaaaattaagatgctaaacaggatgcattgctagtcggatcgaggacatcttcgggtcatggagccagggtccagtgtggcagggcggggctgaagtgtcccgggacgcgttcggtgcacgcgcggctggtgtactccacgatggacgcgccgcgcgggcggaggagcgccgaggaggcgcgctccaccgcgcgctgcagctcggcctcgtcggtcttgtctgcctcgatggatagcagcacgctttggcggcgcacgaaccggaactgcggcgccgcgttgtggaaccccgtcacgcagaggacgtcaccgacgcggtatcggttcagcccagcgtaggtggtgaccaccacctcgtactccctcccgtcctccacgcgggcgagttccacgaggttgctcgcgtcgacggcctcgccgacggggaggaactcgaagtaggccgtgttgggcatgatggtgtaggacacctcggacgggccgcacaagggacggaggttgaggccgaagaagcactcggaggaagcatacatgccgctcacaatcggcaggccgccgctgtaatactgcagggtcgggatgtactgtgccatcacgccggtgacgacgacattcagacacttggtttttggccaaaggcgcgtgacaatgccggtccagtcgcccctggagcactctcggtcctgatgaactcggcaagctcagcgtccggccggaggataacggcgacagcctcgcgcacagacgggtcggtgacgcgggggttgagctctccggtctcgatgtccgccgcgagctgagcccagttgagctggaggaagcggatagcccggacgagcgcagcggcgaacacggcgcctacgcgcagcacgtcgtggcgctggcacaggccgcacaacatctgcgcgtacatgctctgtgacgcgtcctcgcagaggatggccgccattgggctcgtgtaggcgtaggccctcttgaagtgttcgcttttgtatacgctcgtcaaggcgggctgcgccgtgaggccgcctggtgttttcgtctccgatctggcgaacagaaagtagagccccttccccgtgtgaagcccaggcacgtacctatgaaatgagtgcaccattaactaccaaaagtacttctaggagggacatggaaacggtgaaagatctacaagaattgataatagagagtacaacaatatctaccactataccacaaattaaattcaaaaatcgatctacacattaataaatagaaaagaaaattttggatatgctcgggacgcaactcagcatcggacgcctgatgggagggggaaaaatcgggtgccgacgtcagcatgacgcatgcgtgcaaaaccactttaaactattttttctcttaaattatttattcaaatcatgatccgattgcactattaaattcgttgcatttaaatctttaaaacaagaccacacatggatatattctaacaattgttttttgcttattattgaactatttttaaatattgcacgctgttccaccaattatatcagaattgtttcctaagtagatcaaaaatgtttcaatcgtttaaatcgggcgttgtttcaccttatataaaaataatatttcagcaaatagcgaaagaatgtttcagtgcactgcaacatttgatccatacatagtgaaacattataagtacactaggtaaaatatttttggtagaacaaaaaatgaaacgaattcccttaatagagggtttccataatatgtgggtgatttgttgcaaaaaaaatttttaattcactgcaacattagatctatacatacatagtgaaacatttttggtggaacaaaaaatgaaacgaattcccttaatagagagtttctaaaatatgtggctaattttgttgcaatgacatgcgtgatgggacacgtggcgggagctgcggggggacacgtggagagaaggcgtgtgcggaggaggcgcccgtggggggggggggcgattttctccccccgatccggggcattgtccatatgcttgatatgtcttttttatttctcaaacgtaagggttgaaagttgattttttaggaagagtatatacatattgtatgaacattatcaaattattttacagggttttataattaactatatagatggtatcagaacatatgaggggataatgggacattatcccgaaagattaaaagagttttcccttctccgagtgtgtgctataatttttttaaactattgtttttggaactacctatatatttctcgataaattttctcttaaaaaattaacagatataactataatataattattgtgtaattatatcgtaacatgtatataacttgtacgcacctttcaaacattctatgataactagttgggcggcctgcacaattacgtggctagcatcaatttaatattatctattttttacacatgattttatttaaaattatcattcccgtgattctaataattttatagtttttaaaagccacgacagtcgctaccccttactcctttggcacctatttatttacttacttgatctaccactacttctattcgtcctctttagaactttaaaaattaggccctatagtttttaaagttcattgtcttgttgggtttcgttttcatagtttttagaagtatcatcaaacatagccaatttactactctgtggccagtccactgccacctctctttattgtcattgtgattttaaaaatcaaaaataattattgtctatttccttttttactttctataagtctcgccaaatcgttagtggcttcgccgctatactcctctacagcccacccgctgcctctcctccttattgttattgagattttaaaaatagaaaatgattatcattggggtttatttttactctccataagtcccgcaatcgtcgtggccatgcatgctgcttaacggcatgcccattttcactcctcttaattgtcattgggattctatttgagatcattttgtatagtttttagatatcccatcaaccactagcactctactcctttacatgcctattacttctcccctctttattgtcacttgtcatcgttgtgttctataaggaccttttttttaaagaaattggatatttttcatccttgaacacttataattatttttctatttttcaaatttattttatttgttatttcgaactttaattaattttgtcatgtgctctagattgtctcttatttcaatacttattattttttattacaaattttagttatttataaattgtattctagttgagctcttattttctttttctattttctgaatttattttatttttattttgaatgttaattaatctcgtattgtgttatatatagattattcttttaatatttttttattatttccaattttaattgtttcaaaattgtatattcctacttgaactcacttttttattttttttttatgattttggattttatttgattttttttattaatctcgtattaatatcttatacggactcttctttcaatattgcttatttttaatttcgaatttttgttatttttaaattgtatttctacgttaacttttcttttattttttttataatttcatattttattttatttttattctgaattttaattaatctcgtatttgattcttatatggactcttattttaatattctttatttttaattctgaatttcagttatttttaaattgtatttctacttggactcttttttttctagtttcagattttattttatttttattctgaattttgattaatcttgtattgggttcttatatgaactcttctttcaatattgcctatttttaattccagattttagctatttttaaattgtatttctacatggactcttcttttctttttctcctattaatgtgggaatttctaaccctcacagcgaacgtggtgcctactttcaaatatgttttaataatatagtagatagatagatatgatattttcgtgaaacggaggttgtgggatcgaatcccctcacgtatatatcagcacacgaattgtgaagcaaatctaacgattctaaattacatacatgttacatagtaattatatataaattacactacgactatattgtatttacctttaacaatttttttttaaaaataatttatcatcaaatatatagcaaccgataataaaaaaatgtttttatgtaataattcaaactttcaattgacggcggttaacttacacgttcaagacagatgtagcgagactgctcagcacctcgcggcgggccatctcatccgtgacgatgggcatcagcttgcgctcgccggccgaagtgccggagcttgtgaagaactcgatgatggggtgcgttgacaagatgggcgaacggtccccgttggcaatgcgcttgacgtacggcttcaggtcgtcgtacgacgccaccggcaccttggcccggaaggtggcgcggtcggtgtcgctggcgtcgaggccgcacttgtcgaggtactccgcatcggcgttgcggccgaggatctccgccaggacacgctcctgcacggcgtccacgttggaggtcagctcctcgatgagccggagattctcgacgtcgggctccttcgccgccgccatgagcgacgacgacaggctccgcgaggccgcgccgatggtcgagatgcctttcgctgccattggcagactggctccaccgaaacaattactacgagggagtggttgctagatcgagctcgtagcgtgcaagggacaggaaatgatgtgtgtttatgttgggtggcgtatttatgcttacgtactactagtaattcacaatgtaagttattctattatttttcacatttatattgattttaatgaatctaaataaatatatatgtctagatttattaacatcaatataaatgtggaaaatgttagaatgactcacattgtgaaacggagggagtacaaaattgcagctcacgcctcaagggcttccataagacggtacgatgtaacattttatatgacaacatgtgcaaagggtagtcatgatactcatagaagctacaaaacgttgacaaaatgacgttaattaatataagtagttgatatgctagtacttcttccgccctaaaatataagaatctagaaatagataagacatttcctactattatgaatttgaacagattcataatactattaaaaatatctcatctgttactaggtttttatattttactttatttcatgttatgagacgttttgacttctgttttaagtttgaccaagtttataggaaaaagtagttacatttttaactcaagacaaatttattatgaaaatatatttaattattaatttgatgaaactaatttagtattataaatattattgcatctgtctataaacttagttaaacttaaaacagtttgactttaatcagagtcttacaacctgaaacggagtaacggagttagtaggatggatggagtactaaacaagctcaagtgcccatagatcagatgtttttttttctaggggcagtgatctaagggtgtgttcagttcacactaaaattataagtttggttgcaattggaacgatgtgatggaagagttagaaatttgtgtgtaggaaagttttgatgtgataaaaaagttgaaagttttaagaaagtttgaaactaaacacggcgtaacatggctgatctgcgaataagagacgcgttgcgaagtggaataattacgtggaattgtgttttttttttaaacggcaagggcccagactagggccttgaaagatctggatggatgttgcaaaagtgatacagtaggagttttacagcagggtcctcagagaaatataaattacaaacaaaccctcaaaaagagaaaaaaccttagagcctattcagattgatgacattttcaatcatatcattatttagtaaaattgataattatgtggttacgtttagtttgttaccaaatattggcaatatgtatagaattttgacaacattattaagccaatcctaccaaaattttggcaatgttgctaatttgttaaaattttggcattgccaaattttgttaaggtttattttagcacccatcagaacagacccttttagggcccctttgatttgtaagaaaagtgtaggaaatttgaaggatttcaatcctataaaaaaatttcctatgaaaccttttgaaacaaatgattgaatcctatactatcctttaaaattcctatgaaatggataatcctatagagattttggaggaaagttagcaagaggtccaacctcatagaaaaattcctttgagtctatctctctcatccgattcctatgtttttcatgtggtccaatcaaacggtcattcatgtgtttttcctatattttctaatcctatgttttacacctgcattcctgtcagaatcctgcgtttttttctattcctccgtttttctattcctgcgattcaaaggggccttaaagatatgataaaaagcaattgggtccttgtaccaccatcggccgagctattttcggtgacgctggcgagccttcatggatgaagtggaaaagcaccttgagctcgtcagtcttgcacagctcaaattgcagggcctccaatcggtggaggtttgcttttgattttgccggaggtatgaagaacggccggctcaaccttacagatgatgtcgccggaagtagaagaaatggccgacgctgacctcctagaacttgcgttagaaatttgaggatggagtgatgaaactcaatttcgacataatctttttccagattctattcttgccatgggttcacgaacaagagctggcttacccaacacaaaggccaccacaggcagtttattccaagggcacaaagcataccatggccgctgacgtcggagtaaatcgaagccaccagcccaccaccaccaagggcaggatggacgccggagcttggaccaaagtagctttactaaaacacgccataacgacgactacgagactaacccaactatgctaatacttaatacgggcggagctagacacccccccccccctcccccacccccggccggagacggaagggagggggccagaacggtggaggagtttttactctcagtcgctggagctttcgcgagcgaggcgttgtttggttctaaactttttcttcaaacttctaatttttttatcacatcaaaacttttctatacacataaacttttaacttttccatcgcatcgttccaatttcaacgaaacttctaattttgacgtgaactaaagacaccccaagcccgcatggaagtagctgttcccggaacgatagctcgtgaggttttattcgtgcagattgatagtactattaaataattttataaatttacttgtatatttggatgagttaatattgctaattatctgctctaaaagatttcgcatgtcaagtgatattatacaatattaaaatcggctctttaccagtttaccagaagtacatagtgtttgtttggtgggattatattactctagtaattataattagcatgaatgatttggttggctagaaaggctgcacaagttgattggcaattaatggatactaaaattgaacagccatcgataagataccaaaaatctaggtactttagttgatggacccatattctattttatctcatagacattattttttctttagtttataaaaaaatagattttgtgatgtacaaaaatctgtagaatattagtcatgtatttttttaatttaatatatcttaagcgatatatattgtaatatcttttttatatcacttagcaaaataacatttttgaaatggcattttagaacatatcatatttgggtggtgagtcgatattcatcttgatatattttctatacatagactataacaaaaaaatattttagaatgtaacatatattttctatatagactatgaaaaagcgatatatcattttgtatcatttttggaatgtcattttcacaaatatcatattttggcggtgagtggacattgatcttgatatattttctatatagactataaaaaatatatattttagaatgtaacatatatatgtgtaaaatatcagacatgtgatttttttttaattttaatacaatgccaagtgatataacccatttatatagccgatagacacgatgactaactgataaaaactgaaagtactttagcgattaattgaagtattaattattacaaatttaaaaaataaatttattttatttataaaaaacttctatatagaaaatttttatagttcgggaacgtgcgcacattaaactagagatttttttcaaccaaaactcaagctgtgtttagatctaaagtttggatccaaacttcagtcctttttcatcacatcaacctctcatacacacacaacttttcagttacatcatcttcaatttcaaccaaaatccaaactttatgctgaactaaacacagcctcagtcttaccgacatattactaacatttggcttatccaaaagtcgatagatcacaagcatgcccatgtgtgacgttggcttggctaaaagaattgattacagagatgctcctgtagagagactttcgtgtcaggatgtgacacttggactctgggagggcatagcacaacacaactttctgggagggcagagcacaacacaacttgtagtaccaagcaaacaacttggtgataatgaaacggagtaggtgcatctcggttgcattaggaacaatagcttggtggttgcggattgagggatacaaatcaaatccgacatatatttgagagagttaacgtgaacttattccttacctaaatcaagtatacaattggtcacagggaatctaaacatcatgcatccatgcatcgattttttgttactccttcccgtctcaaaatatatatactttggtggtgttcttttatcctaaagatgaagattaagttttttacgcaaaacgagatggtattaatgtatgattgattgagttttaattattacaaacttaaaaaatatattaatattatattttagagcaactttcatatagaaagtttttacacgaaaagcaccgtttagtagtttaaaaaacatgccacgaaaatcttaatcttaa

SEQ ID NO: 39636 - DNA, 3323 bp, Oryza sativa
agaccttaaaaacaatgaaatctaagttcattccctcaaagatattacctaataacctgcaaaaacttgctctgctaggtaaccaaattattaaggcacattccactggtgaccactataagcctttaaggatcccagtacaatttagcatccctgctttatcaccttcctttcatatatatgcacaacagtgcttaccctttacagcccgggcgagagagagttatcagagtcttcccatggatggcatgttcgttcccttactcccactgttcatatgggcttctagtttttgccgcactcaacatgcagaccatatcagattgcttggtctgacattttatgcaaacagaaatggatattttttagataatgaacagaaatggatatagggcataaactttacaaaacattgcaggatgctaatttttcttcttcttcttttttttttttgcaggagactaatacttcctttttacctctatatcaacgggaagaagatgtattcagcatagaagagattccaaatgaaccggtagtactgtgaaatagcatcctgcaagacaagaaaaaatggtaattatctatgcgagaagcaaggtgacataagtataattgaaacacaaccatatttatcccctaaattatgtcctatcagatatttacggtagttttgcaagtgagcttacaagaagaaatgggttaaccaaatttaaaatcgaagcccaatgattgagattaggatcaattgtgccatctcatccaaaaacaaggacagtcaatttgcatatgtgacatggcaagtggcaacttgagatttattttaattgtgttgctcttttgattagtaaggaggcgcaaaatgacatatcttcccaagaaataaaaagaccttacaacagtgagatcatgttaaagagaatagaatggaaaatatttgtttgagtaaaacagccacaagcaagctcacatatagaatgtttctattagcattttatactaatgaagtatcttatttttctaacaaaagaagttctttttaaaaggtttcagaactgaagtcaaaagtttcaccttagtatattttgcttgctccagaacccatgtctgaaaaaatggaacagaaaacaaacaagttacagttaaaatgtgtgtaacagcttcacagaagcaaaacaagatactagctgtgaatgaaactgcttcttatcaagtcattattctgtagccattttagtttctgttaaaatttatgtgcagcctcacttagcagttgttttgacaatgacacgttaaacctgcaagccttccatgtgtgtaattctatataattcaataaaaaaactaatgggcagccgatcatcacaacccatgaagtaagctaacaatgtcaataaactaatcatgaaacattgtgccaaatagttagagcatagatacacgagggtttttcgtctctagaagcctaacacatatacctggaaaattataccaacggcaagggcagcatgcacaggcaccattacagtgcgcctgaaagcctgcatattggaacataatcagttattaaaaaggaaccacgtaatgcatcttagtattgcagtatgcaataaaaagcctaaacaccttgatctggaaagtccaatgaccagaaaaatatcctcaggagttaggataaaagaatttacatgctgacgcggttcagaaatcacaaatataaaaggttgagtttggcaattctttatattgaacaatatttgtagaatattgtagtggaaaatcattgaaaatactattgcttgaatcataaaaaaaatacaaacaaagaacatacaagtcaagctaggaaatattgaaacatatgacaagccctaacgtttgtatggaagtggactccctagcaagttggaaatccaacatgccaaacattggcaagtcagaaataaactagtgatctaagtaggatgtcaatcttacaaaaatttggtagcaaatccaatgcatgccaattgtgttcactgctaccaaaatttggcaacaatcggcatagaaccatacagccccaaatgttaccatcacctattctaggtggaactactaagaggataaacaccaacaatagcaccgtatagttatgtttctaccatataataccaatttgattgtcctccaattcatggttttaccatctaaacatcatccgcagttgaaacaggagaaatcaacaaaatacagtataccaatatccagttaaatgcacaacatgccatacaacatgtgctgcatgtttataggtgaacaggctggaatattaaaagtagtaaagcaacctgaggcatgagaaaagctacagcaatagcagcaacataatttgctatcaataaaccagagccaagaaatgcaatgtttctgacaccgagctttgtcgccaaagttgatatttgatacctgaatgaggaaaaaagatataattagagtgttagtagtccactcattgacatttattaaacaatggtatagtgtatcagaactgcttccaattgctcctattcaatcttaagcaaagctaaataaaaatctgttaagcttaaacatagaattctgcacctttttcacatttgtgttatgttttaatgtactacttcctccgtcccaaaatataacaacttctagagttcacactttgtcccaaatataacaacctagtacttgtaaaatgtgacattgaccactaaactacctataccacccctaatatcccttggctttattatagccctaactagttggcctataggcaacaaagtctttttacccctctccttaatacccatgctgaaggctaaaacctgctggagggagtatatttgattgcttgtttcggataagatctcctaaggactagaaattatgtaacacaggcataacttatttggctaacaatttggctagcataatttggagaagtacataacagtctcttgatgagggttctgtctaccattttggttatgtcgggccaatgcctctgatcttgccagaatcagcattctctgttcgcctagtaagctggtaaccccagaagtactctgataatttcttgctgtctacaaaagctggcgttctgtcctttagtttatagaaactaggtgctgcaaccaattactgccattttttttgggacctttaatctaaatattgcattatccaaacgacaaggaatggctgctcaaagagaattatttactcatttgtgctttcatcaccataaggcagtgaaatagtagtttatttgtgctgctcaaatacctgtatgcaatatt

SEQ ID NO: 39637 - DNA, 5247 bp, Oryza sativa
  unsure (1)..(5247): unsure at all n locations
nnnnnnnnnnnnnnnnnnnnnnnnnnnnnnnnnnnnnnnnnnnnnagagaaatgccacatttgtcacttgtgcctatctgacccaaccaatcttgccgcgagtctgcaacaaccgcagctcatggcgcgtagtggtggttactggttgctgctaccaacgttcagtttgcagcacgtttttttctctcctgttccaatgatatggtacatcatactacagttcaggaagagtacaattgtacaacgaacctatcatactgtcatgtactcctgtctgtccacgctgacctccagctaacacacatgcatccacacaagttgaggcaggcaagaaacactaaacaacatcgccgtgttttcctcatggaagtgacgctgacatgcgtcgatgcaatattaattatagtgtgtctgcattagacttgtgtcgtgggagatggaagagccgtcaagccaagccacaccttcttaaagacggccaagctatgcgggtagggatcactagaagtgaagtcattgccatcaggcacagccgcacaggcagagctgagagcttaggagcacattggtttcttgcaagtaaccataggccagaagtagacgataagctagctagctaatccaagcctgtgactgtgaaggagtcgagtcgtctttgccaagtcgctgtgccgttgaaagggacaagggtctcctggacagagatctcgcccgttaaatttgcctctcttttgcttctttccctccgatctctatagctgtgcaagtgaaggaagaaaggaacagcctgaattatttctccggttagtccccgtcctgtgtgtgtgctatgcgaaggagcaagtggtgtttgccttgttttcccatggccagcacggcggcgctgcccatcgagacggcgttctctcttccggctccgttgccgtcgtggccgtcgtcaggtacgtattgcatatttgtgcatacctcgtgtttttttttgttcttctggttattatgttattatttgcacgaatggttttgtgtacctctcgaatggaattgatttcttgcaaaacttggtgatcctgatcattacagcacttcgcttcttttgctaaattactaaggtttgcctttcgatactcggttactgttcttctcacgcacagctccacttagcaaattctgattattattatttttttcaatcttgtcctgatcacgcattcatcattaattttcctcttgactacaagtccaatatgattggaacatatccagagaaaaatacatgcatggcaaatgcaggagttatatggctaaatgcaaataaggcagctttaggcgatgctggcgaggtagcttacctgcaatgacgactaggaacatactttgctatattcatgggctacaagatcctcctctagtcctcggttgctctgaaatgctcgtattggtgtgcccttttctgaacagacactgataaccatgatttccaaagaatatatatgttatcaaatgagaatagaaagcatataccagcataatcttatgccttcatctagctagccagggttgtttggaagacaaatgcgcatctctatccagaacaccacaacttgaatagaccatttctgctctctgttgctatcattatgacttgctaattttttcagctctataaacacttggctaaacgaatttctattcttagttatggcctgccattttgataggcccagttttgtggttttgtcaactctgtaacatctttgtctgactggcgtttgtttgtttgcttgcttgcttgcttctttttcttttcgagatgctgactggcctttctgaattttcagtttcagatggaggatttgcaaagggtagcattgaccttggtggtctagaggtgcgccaagtcaccacgtttgccaaggtctggtccaccggccaagacggcggcggcgccaccttcttcaggccggagcaggtccccgccggcttcagcgccctcggccactacgcgcagcgcaacgaccggccgctcttcggccacgtcctcgtcgcccgcgacgtctccggcggcgggctccttgccccgccgctggactacgcgcccgtctggtccagccaggacgacgccgcccacttctggctccccacgcctcccgatggctacagggcgatcggcgtcgcggtcacggcctcgccggacaagccgccgcgcgacgaggtcgcgtgcgtccgcgccgacttcaccgacgcgtgcgaggcggaggcgacggtgtgggacaaggacgggttcagcgccgtcgccctgaggccggcggttcgcggcgtggacgcccgcggcgtgcacgccggcacgttcgtcctcgccaggagcgacgcgacggcggcgagcgcgtcggcgctggcgtgcctcaagaacaacggcgcggcgtacacgtcctgcatgcccgacctcgcccaggtgaacgcgctcctcgccgcctacgcgccgcagctgttcctccaccccgacgagccctacctgccgtcgtcggtgacgtggttcttccagaacggcgcgctgctgtaccagaagggtagccagaccccgacgccggtcgccgccgacgggtcgaacctcccgcagggcggcggcaacgacggcgggtactggctcgacctgccggtggacaacttccagagggagcgggtcaagaagggcgacctccccggcgcgaaggtgtacgtgcaggcgaagccgatgctgggcgcgacggcgaccgacctcgccgtgtggttcttctacccgttcaacggcccggcgagggcgaaggtggggcccctcaccatcccgctcggcaagatcggcgagcacgtcggcgactgggagcacgtgaccctccgcgtgagcaacttctccggcgagctcctccgcatgtacttctcgcagcacagcgcgggcgcgtgggtggacgcgccgcagctcgagtacctcgacggcgggaaccggccgtcggcgtactcgtcgctgcacgggcacgcgctgtacccgagggcagggctggtgctgcagggcgacgcgaggctgggcgtcgggatacgcaacgactgcgacagggggagcaggctggacaccggcggcgccgggcggtgcgaggtggtgtcggcggagtacctcggcggcggcggcggcggcgtggccgagccgacgtggctgctgttcgaccgggagtgggggccgagggaggagtacgacatcggccgcgagatcaaccgcgtggcgaagctgctgccgcggtcgacgagggagcggctgcggaagctcgtcgagagcgtcttcgtcggcgagggcccgacggggccgaggatgaagggcagctggagaaacgacgagagggaggccaagtaaaaattttggcggttctcaaatttcagacgacgacacgcggtgatgacgagtgaaaagtttattatatggggtttctcaaattcaaatcagattgttacggagcaattctgaaaaacgatgacagagtgcatggtgaaatatattcttttaagataagatttaatcaaacttaaaattccaatcacaattgtttctcaaatgtttggttttttaaaaaaatactgtacatagattcaccataagaactcctataataatatcataaaatttattgtattttgtaaacttactctaaaaaaattctaatacaaaatgtcatcttaaaaagtaaatattttttaaacatcaaatatttatgattgaataaagtaccgttgtacaaaatttcaagtcaaactcgaccaaatagatctatattttttttcctttttctttcaaatgtgtatatcgaacttgcagttcactttctttacgatggtgtatttgtattgtaaatatatcatatttctagtaatatgtgaaaacaaatgtaatttctggtaaatttcacttttaagtaagttttatatttttcttctcattttgacgcaacttatgcttatacttattagccaaaatttaatttttcaacatttaatctgaagctgattttaggggtttttcatcgaattttatttttcatcactaaaaacacgtacataaaagttttatttataaattatatttcgtttgtataaatatattgtttggcttcttccccgaataagctaaatgattgggctgtaccttcctctccgcagccataggataacaaacgcacggttctcatcttccatcgtcactcaccgacaccatccgtaggtcttccaggagctccttcctgccacgtcatcaatggcgatgatgggtggctgacagtcaaacgcaccccacgcctcctccccttcccccctctctccctccatggcttccctcgcctcccctcctctcccctgccgcgccgccgccaccgccagccgcagcgggcgtcctgctccgcgcctcctcggccctccgccgccgcccgcttcccctctcctctcctccgcttcggcgcgcttcccgcgtgccccctgcaacgccgcacgctggagccggcgcgacgccgtgcgggtaagcttgccaaatcccggtccataatttcctattagttagtcaatgcgaggtcattatctaaaaaaaacgtcaatgcgatgttacctgccgctgagcacgagtaatttttgtgtactattgctctgattgattacagatagaaaaacataaggctaattggatcgattaaacatgagcagcttgtaataagttgttaatcttgcggagagcctaggtatgcttggggatatagtaagtgacattgccagtgtgccgcagcaagttcggctgctatgctcgctaggttagctagcaggaaagtgtgacacccgaactcccgaagcaagtgtatattcatttttcggggctacattatcacttcatttcactatatttcgtctggagcatgcaatgtcgctgtttctttttctgaatgtagcattggcacacataatgatcttgtgctgcatcttagatgaatgtttgaagctaatttggtttgattagttccagagccaacattgtacaacatatgttatctcttgctcgaaatttgtgaaagcttgtgcctagatgaggcattctttgctaaagcagtgattctggctggaagcaagccagcaataaacacaaatgattcaggtttaactatgaataagcttgtagatttaaggcacttagagagtgcaaacatggattctattatgtaactcaatctgagtttgaaggtatgg

SEQ ID NO: 39638 - DNA, 1830 bp, Oryza sativa
ttcaaaaatggtaaaggtggtgcctgatagatccgaattccaatatgaagcagttcgcataagtctaaagaaagcaatcttgcggatgttcttgtagtgattgagacatttatttttcttgagccaattgttttctagcaaatagtcagtactttaacagaactgtgagaattagtgttaccagatgcagggttctaaaaaggcttagatatgttgggcatgatctgttgggtatttggccttataacaagtatgatggctgagatgacctgtttaaatgcattactctgctcaggcatattattcatgatagctatgaatgaataatatgcctatgaatgcattactctgctcaggcatatttttgttacttattttctatgcttatttaaaaacactgtgtgccttgtatgcataacgatgttgaacctggtacaggtttgctctcaagctggtgcagctggaccagccccattatcgaagacattgtcagacctcaaggattcctgctggagatttttacggccacatacaattcgaggaactgccttgggatccatgtgtggttctagttttccttttatattggtcaaatttgagttttcatcttttggtgctaattttgctgtgttaatacagagcattagttgctagagctttgatagagaacccccaactgataaattggtggttggtattcaaagcgttctatgggctcgtggcgttaatctgtggcaatggttacatcgttgggatcaatcagatctatgacattagaatcgataagtatgtataatctctctatagattcatataagaaattatggtgatgttatgaattaccattaagaacaaaatttccttgcctatttcttttaactgtattctgacatttctaattttatgctgctttacagggtaaacaagccatatttaccaattgctgccggtgatctctcagttcagacagcatggttattggtggtattatttgcagctgcgggattttcaattgttgtgacaaactttggacctttcattacctctctatattgccttggtctatttcttggcaccatatactctgttcctccattcagacttaagagatatcctgttgctgcttttcttatcattgcaacggtactttgctcctatcttctctttgttcacttcagtaaccattggatttttttttatctgtttgtttttgtgtttagaagcattcttaacgtagtttgttagcaatgtattgctggtcgaattgtggttactcaaaataaaatagaacacctaatcttttcattcaaagtgcatgtaatcagagcactttaactcatctgattcaaagttggactgactgaatctatgatatattttttgtcaacaaataatctgtgagatatacctagtaagtatctgaactcatctggttcgaagcttatgaaagtgaaagacctatttgccaactgagcatgactgagagctagcagtgcgactagcaaatcacctcaaccattcctcttgctattctaattttcgagaatagatcttgtaataccttctgaacaattgttccttggttccctaatagttagcaaacaatgcactgtgcaattcagaaactttaaaatccccatgtttatgctgcatatgatttgattactaactcatatttatttttcaatatttcattcattatatatatatatatattttgacaaaccaccattcaatttttattaggtccgtggttttcttctcaactttggtgtgtactatgctactagagcagcactgggtcttacattccaatggaggtaaaatagt

SEQ ID NO: 39639 - DNA, 840 bp, Oryza sativa
tcttaaagtggggcgtgaaccaaaaatttggggaaataagctgctattagaactaaatcgattaaatccacacaagtgatatgatggatttgggtgtcttattaaatactgagatacgtatttgattgcacacagcaaagaacaaaatcgttcttggaacaacagatcaaaactaccagtaaaaacaaatcaccctagatggatcatggatctcccttccgctccacgcgagatcaggggaggggcctccgcctatcgagaaccgccgctgcggcgggaggggactgccacaagcgagattgggccgaaaatccccaaatcccagcgaggccgcaacaactaaccgaagaaaatatatttaaaaaaaaaatgaaaccgcgtacctgggcggagcacgatctggaggcgacggcgggtcgcggtctcgcggaggatggatggatggtggcggtcgagatcgcctcaagctcgttgcatctctctctcgctggttcgtctgttttttttttcccgtctttttctccttttttcggttcgaaattatctacgcccctgtccccctcgatttgttgtcgcctgcttccaatccaaattccgattgcgaattcgcctccctctgccgcgtgagcaggacgggcgtgagcccgtgaggcaatcggtgggctctggcgtcgcaagcgagcagagatgggccgggccaacactttgggccgtcagcagtacccgtggaccgtggtcgtgacatatatgtacatcttctccaaagttcctctcaaagggaaaaaaaaaactacctatatattcctcgacaaattctcttaaaagaaactactaacagat

SEQ ID NO: 39640 - DNA, 919 bp, Oryza sativa
attgatgtacaaaatattattgtgcggccttgtccatggacactcaatatataatacaggtaggcatccttatcatcatcactacacctgtaaatcaaacaaaaaaataatgtgacaatttaatttttccatggaaaagtaaaagctagaaaaacgacagttaaaaaccccaaaaaatctaaaagcagaaaatacatactcaataaaagactcttcaagtttctcaggtaagatagaagccttcgtcagatcaactatttctgcgttaggtttcatacgggcctgcttcgaaagtgcttcaatagaactcaaatcagtagatgcagacgcttttgcagtaactaggcctcgcttcaactttttccgaaaattagctgagagagcaagtgttgctgagaatacaaatgtctgtctcttctttatttgcaatataggcacagtttcgcaacttggcgtggtcccaacagtttgttcatcagaaccgttagtcactggtaacatctcaatgatagattgcagttcatggaaatggcctcgctctatcattctatcagcctcgtccaacacgaagaatgataatgaatgtaactgggtacagaaacaagcaatgttacaattaacactatatcttcagcataaaattatcagaaaataaaaaccacaatgagaagaaggttataataaattttatttgtataatagaagtgtatgttctacttctatctttcttacaaaagtggggctttgctatgaactaacaaggcaaacgaaaggcacaagaaatgatgagcatggataggaatcctggtggtcaagggtggaaaaccttatgcaagaaaataataagtactgaaaaaagttcgcctaaaaaataaattggattcaacatggcttcaaatgccttagtaggatccctatc

SEQ ID NO: 39641 - DNA, 10279 bp, Oryza sativa
tttgttacaaggctaaatgcaaattccagtgttaatacctgcttggcaagctccctggtgggtgttaaaataagagcacgaagtggactttctctagaattttcatcttgtgtactctcatcctcccgagacaatctcatggccttctcttgttcttcaagaaggcgctgcaagatagggaggccaaaagcaagtgttttaccagaacctgtctctgctgcaccaataacatcctgttacaacataaacatcaccacagttagaagaccaaaggcatggaacaacaataaatagtataaaaagttatctcagttgcatattctcttatttccactgaactgagaggggtccaagctggcatgattagtttatggcactttatccaggtatatgttaggcgacttttaaatgtggaatcataagaagaaatgtctaacttcgactaaataaagtaggctatcaagttaataaccaaagcaacaaatggtgcataagcaggtgaataatgaaatagaagttcatcattttcccatataaaagcttggccaatggcctacaagttagcacttgacgaaccttgccttgatgagccgctgcaggaaagcaagccttttgtattggtgttggttctttgaatccaagcctgcgcaccgctgtaataagaagagggtgcagtctaagctctcgccatgcatagacttcatcctctcccaaaatcagcccatcattgttatcttgttccatgtcattgccatcttgcatatctgtgagcacacaacagtgttaagtagactcgcaatgctgatccgacaaatttagtaacaatgactgctacaaacccagacagaagaaatgctgaaacttcagtacgtgagataccagataaaatgctcctaaaagcctttaagtgaaagcaattagcaccttccacattgtcatcggagacatcttccttgctctccattgtttactgcatttccttcacctttctcttcttcctgctcctcctcttctttttcaccctcttctcacccttctctccctcctcctcacattcaactaccaaatcaccatcaccaggtaaagcatagtcatcgtcacctcgcttccgcttcttcctcttcttcttcttctgatcctttcctgccttcctgtcaatttctcctagatcctccacggcaccgccaaagattccgaagtccgcctcgtcgatctcctcaagctccaggaaccctaccgcccaatcaaccaaacacctcctcgtcagagaccaaacgcattaactgaaccaaggatccaatacacgataaattcaaacccttacctccttccttgcctccggcgagtacgaggaaggggtcctcgaccatcgtgccggccgaggaggtcgaggcggcggcggcagcggcggctctcctaggtttcttcgcgccacgactcttctttcccttgcgtacctggctggtctcctgaggcggagtggagggatccgaggactgcagctgcggaggcggtggcggcggcggcgctgcggccatcggagacggaagcggcgggttggggggaggcggtggcggtgtgggcggcagcaggagggggaagaagaggcgagggttttggttttggacttgtttcctacatgggcctttttgggcctaatggctaacgggtcaacccgttgtggctcgacgaaaaaaaagcccgagctgaaacggccctccctccccaagttggatcgttattcttgggtaagcctgggccgttcgatggagcttccgtggcccagatcgcgtagggctgaggggcggagagccggagaccatgttgcacgcaagaccctgcacgagcataattttacgctttgcacctcgtggacttggatcggccagttttggataacaatcatccaaacccgtatcgttttctgcaacttagaccacgatatctagagttaagtgaaatttacttcaaattttgtaacaccagcactaagtatagcttaggtagttagtgatgaaacatgttaagttatatacttggcacatatcctcgtatttatggctaattttttagtggtcgaaagtaaggcgttacagtaactttgccaagatcaatatatgtcggagcaattttggaggtgctcgtagccgtaaggatagaaaagtattcctggtttggggcgttttcaatgaagtttccatagccaagatcgagtaagtgcaaacattcgatattgttttttacatgacaccctatttgacatgatttttttttcgcaccctcttgagttggatctcttattcgaaaagagattttgtggccatcgtctaccatatgtctgtatgactttgccattgacatgctccactttatgggaacctatgttctatctgtggcgcgtattctcgacttggttttgcattgactagtgtcgaaattgtgccctcaagattgcaatgtcttcaacaaacgttgagcatagcgtggccctaggggtatgcggttatgggcctctctcgaagctctcaccccttatgggtagtgcgacgctgtcatgtcagaaatagttatagcttgcaatttaatgtgttagtgtcttgatgcgccctagcaaactaactagagtcttttgggttcggcgccaagccgccaacaatctgctccctccgtccaaaaaaaaagccaacctagacaccgataaagacattacatagtacaacgaatgtcttatttttttgggttggctttttttggatggaggaagtacatcagcaggttgtagggttggctagttagaaaatgctatacatcacatttcgagaaaaaaaacaaggggttttttataatatcattatttgttttgtgattaatgttttatctccatctccaacgaatctctaggacttctacgggtttgtcgagtggttagattgcaggattaaggttggggtaggtgtttaagatgtggttacgaagagaaggggcggtgggctgtcgggatggacggcagaggaatggtgtgataagggagagagaaatatgcctgagagtagagggtgttcccccagctaatcctgggttagacaccttacccatattaaccgtggaccgggccaaatcaaatcttcacccacgtagcagcccacgcccccgcatcgatccaccgaaaaactaccccgccgcacgtacggatcgaccgacgcgaggtgaggtgggcacctggcgcgactcccgcgacgtcgactgccacatcccaccgcgagtccgcgaccccacacacacacaaaagaaaaccgcgctgtctgctaccacaacccactgacgagcgggtccccccgcccgcgtcgccctcaggagccccacccgccatcgacagagtacgagacgagaccgtaccgccgcgcgtctcatgtgccacgaccgaatggagacgcgaaaaagaggaaaaaaaggaaggcagcaaaagctggccaagggaggcgaggccagcgcagtgagaggaagaagagccattttaaaaccttcccccttctccctcccccgatcctcctccgcccccacgaatccccatcccgcattcgcctccgccccccccggcgcgaggagcggcggcggcggcgagccacgaaccctagccgtctccttcgccgtccctctctctccagccgttgcgggaggaggaggaggaggcgcggttgctgttggtggcggctgtcgtccctgacgcggagttctctcgctagggttttttttttgtgtgtgtgtgtggggggggggggggggatgcgcggcatgggggggcggtaccacatggagatgcccaccgggatgagggagctggaccgcgtgcagcagcagatcgccagccacccctacgccttcgaggtgagcgcgcccccccttctaggtctctgggtggggttttgggtctgattcgtgggaggccgcggtgtttggtgtgtggttggtcgcaggtgtgctcctacttcttgcaggggtactacaacgtgctcgcgaacagcccggagctggcgtgccaattctacacggattacagcaccgccgtgaggctggactgccagacgatgaaatcctcgttcggggagactgttgaggtatggaacgaagctagcatattcttctctgctgtattttcttgcttagcgtcagtaaattaatcacctttgtgctggcccttgcgattttcttttttcgcgagatattcaatgcaaagataatgtttgttcgttggaccaaatgtgtgctatgctgttatgtttttttttactgggattagaatatgctgtgatgtttttattattgggatgatttttggttcatggtgagatttcatcttcaatcgttgtgtatggttggtgaacaaatgtgccattgagttttgacgacaaacaagcagtggctgttgtgtccagtaagaattagtgttacgaaaacttaccacttaccggcagcagtttttttttctttttctttggtatgtctgatagtctgagtatgtttctctatacatgttttgcggcagggttggtttgtactattgatgtggcaacttctgaggttgtttatttagtccaggcgttagctggctgtttattaattcaccagctgggaaaaaaatactgtggacatgggataccatagatcagagcattgtggattggggtgatggagtccctttgtattatctgtgcattttattagttatgcagggtccttgcttgatgattgtacctgtttggtgcctaactgctcaatgcccttttatgttttatttcattgatcactttcttgaaaactggggtttaaattatgaaatccactatatgtaggttattttgcttgcattgtttctgtttacaaaatatcactatggtataatttaacttgtgttatcatccttgcaaacatcggcaggaaatcaatgacatgatcatatccatgaatgtacacaagattgaggttaagacagctaatttcgtgcagtcatggggtggggctctccagatgttggttactggcctagtgcaattaaaggactaccctgttcgcaagagatttgctcagactatgcttcttgctcctcagaataatggatattatgtattcagtgacatctttaagcttatctgtgatgaatatgattactatgaaggggctgattacagtcacactgacaacattctccagatggatgctcataataccatgactgaaacaggtattattttccaacggcgctttaatgaatttcagatctaaacaatctgcatatgttcatgatcttctcctacttttttttgggccatgttttttattacatgataatgttttgcaatgtatgttaataaattaagcccatttcagtgcttgttttcttttgtaaaagtaagttttcttatattctgtgaagtaaggtatgcacgccacaaacgtcttctttgatatattctctagagtccagataatagaaaacctcatcactagttcaccagattcttctgttttttgtcgctaagtttaatccactggctacattctcattgagtacataatatgaagcatctgaatagtgtgcttctccacataaactcctcagttatcttgtttccaaatatttgttgtgtgtgtgtatgtgttttgcattgatgttgttagaaaatttctccaatggtaaccgtgattatagtgataatgtttactttttattgttggttgattctttagcgtctgattgtatgcctgaagaacttgaggcaaaggaagctttagctcctgctgatattgaggaaaggggtcctgcttttatgcctgaaaatcatgaagttcagcagcaagatcctttggaatatggggttgtgatcgacgatgattctccttctgaagagcttactccttcgttccccagttctactgacagtaaacaggatgcacctcttggccccattgtccatccttctgtaactacccctgaggaagagcctatgggagaaccagccaaacaaacatacgcttcagtggtaagcaggcatatgctgccttttagtcaagttgaattcctaatttctttctttggttgatgttgaactctttggactgaatggaattttgtcagctgcgaacaaaaggacaccctagccatcaggctattcactccattcctctcaacaaggccacggcaagtagtgtggagtcacaactgaatggacatatgactaagcaggtgcagcctgtgcatgaaaaagccaacctggacacccgttatgatgctagcggccctgaggatgaaggtttggcttttgtatacaactttgctaatgcttctgatcattttattatgatcttttttgaaattgttttgttattactactagcctactaggtataggaaccaatattggactaaattcacctagcccttctctatttcaactaccctctgcctttttagcactctaaatagaattttaatctaatttttggtagttattcacactttcctgttttttaatgtaaacacaatcccatttttggattgttggaactcaatttctttacctaaccatcaattgccaaccctgattcaacatttaaacaaccctttcctttattggtgtaattgacacttcctgttctggatgcaagatcaaattccttttatgggtagtttgtgagtcgaaatattttatcaacgccctttttagtggccagcttatgagttaagtaaattcttacgtcgatagttgttgctagcacacgagcgcatattcggtggttgtttataattattattttctttcgcagtattttttggggctgatgtgttgtcatggatgctaattcttgcttattgcttatttcaagagttgttacatgctaaacaaattactttttaattgtgataatacactattagttttgtgagtgtcttgtccatagtcattcggcttgatatatctaacttttatatgcaattggtatgcactgcttttgtgggtacagtattctattgtctgtcttcctgtagccttgactgattttttgaacttgtgtaacaaaggcactatgcacacttagtttttattctcgtgtcaaatatatttggttgtctatttttgtttgcactaaatggtatgcactgtttatccaaaaattgctgttggaaataatctttcctgattttctgctgtggacctgactgctgaattatttctcttgtcttagaagagtttttgtcagtttatatcgggaacctttctccatctacttcagtctttgatcttgagaaggtattccaggcttttggaagaattaaacctgacggggttgctatacggagccgcaaggtttcttgccttctatgttgtgctctcctccccccccccccccccaattttttctttgttatttgcttcctaatttcatgtatttgtgtgtaggaggctggaattttctttggctttgttgagtacgaagacatgtctggtatccataatgctttgagggtgagtttctcttagttcagcatatgaaagtaacctgaatacagaagaggaaaaaagagagaagataaatggtgccttgagacacttaataggccgtgcctgctatactctatagaatatctttttatgctaatctgaacaatgcatagaacatgctacagtgtctgcataaagggaatcctataacaatagttttctggagctgtaatattctacagcggaaggagtaatattatgctaatggctgagaactgttgagtggtggaccaacgaatgcttgttttgcaaatagtccaaagcctatggtcaagcatatagtagatgcattgttaaaacaaacgtcttgatttctcagttttgtttaatgcatgatgtttagagttcatagagcaatgaaggttagtgtgctgtaatggtaattaatctgtatgatcttacattagttctgaatgctatcttgttttgattaatatttgtacatcaggcatctccaatagagctgaatggccgcttaatacatgttgaagagaggaggcaaatctatcggggaggtggagcaagtaagtatcgatctggattttctcatccatatagttaagcagttttttattgttttgtttagactattttttgtaccgataatctagacaaccatttgtattaatgctgaggtagcggcagtaagaaagtagggttatagtagaatgtgccctgactagtgatgtttaagcctgaatttgttgaatgaggttcctgaaacctcatctttcttgagggtatatatggacttctcattctctgacgcacattatctttttactactgtttagtgcgctatagaacatcacctccaagacattgttattactagtatgaaatattttacttgctcccaaagaaacatgataaatcatctgtaatgtacatatgcccagtaactgagttttttagtaagccatgtctgtctgtttcctgtgttacccctttgctaggactgttaattctagtttcttgctctgcaggacgggggagaggaagacctgctgacttctctaggggtcaatcgggtgggcggtatgatggggattatgctactcggtcaaagggaaatgggtaccaaagaagggtttgacgccagtacgatggctaaagtcaaatttctcacctgctctgctggtgaatggttgtacccccttggtgatctcgacatggtgcggtccggccatatttttgtcacaacaaagcgtaatattaggtggtagtcatttttggatgggcatctgttaccattttgttgctggtttttgccgtcgtttggtcagaacaaaacctcagctgcatcgacctggaaagatttcataatgttatcgctgaattggtgtccgttgagaacaccattgaaaagttctagtctcagtgatatgttttaggaattgtccttttgctgccatgtcttgtttcacaccggcagcggcaggagcgattcctgcttgcaaatagcttgataaaccttttacattagcttataaaatctcatgttatctcttagactcttaacatagtatgttggttcactgcttcattctaatttgtgcgtggagcagtgccacttggcacgagctcgtgcactgggcggcgaacaatcacatggccggtgtccatctaccgcctagtcgcacgcacaggtctcactcgctagctgccttgatgcatgaagccatgcgctgacgactgatgcatgcgcccatctccgtgccattctccggcgtcctatagccaggaatgggcgagactcttcttttgcctcgcggtagaaccagtaatgggcgatactcttcttttgccgggcgaaacattgagattccaccgcgaggcaaaagcaaacaactttggggtagatgcaaaatacattcatcggttttgattcgtgaaaggaaaaagagaacttcatgatatagttacatccaacttccaaccgcggtattatttattcttcggtttgtaagcaccagcgcatttagtagtagaaagcacagcgcatttagcacgttgtcagcccgtctcgcacggatcaaacggccacggaagccagctgcctcacatgccccggctgcgccgccacggccacgtcctgctcgccttctccgaggtcgtcgttgtcgtcgtcgtcctgttcccacaggaagctggcgtacgcggcgaggacattgctgccaattccagaaaccaaagacaaaaaaaaaaaaaaacacgccaccacggttagcgctaagccatctgatcagtgtaatactccgaaatgtactcacagcgccgcggggctcgcgggtggctaccgagtaccgacctgttgtgcggcgcggcctgcacggacttgtggaagtaggtgagggatctgtccagatcgcggtgcacctcccacaccagcttggcgtactgcgacatgatctcgccgtcgctgggatccgccagcatggcgcgcgagtagtactcctccgccctcctcgcgtcgcccttcacctgatcgatcatccagtgatgatagcaatcaaaatttatgaatccacgagtttacgagaaccattgatcacacggtgtttcacagcattataccaggtgtgccgtgcttgatcgatgggtttttagtacagatatatacctcgtgcaggaactgcgcgtattgcgcaggaacagcgcgtcgcccggctgctcgtccatcatcctcttgtactgcgcgtcagcgccgccaccttctc

SEQ ID NO: 39642 - DNA, 8030 bp, Oryza sativa
cccggcggcggcggcggcgccatcttgttgaaggtgttgtagatggagaaggagagctccgtgtggaggccggtggtattgttcttgctaccaccaccaccgtcggaggacgggtggagggaaggcaggtggccgtcggagaaggctcgccgcagctggagagaggacggcgcagccgccgccgacgacggcgagaggaaggagtgcaggaacggcgtcgacgagctcctcagcagcatcgtctcgtttctctcacaccgtctccgcgtcgtctctagctatagcttggcatcaaattcctcgagatctcacctcccgtgtcttcatttatagtatcacatgatggatcgagccgtgttagtttaatccgtcggcatggttgttttcagacttgctggtaaggcattaaagcgtgttcaagttggtgcatgcacgtgaatcctcatcggttttacaaggaaagaaaacccctcgagattgagatcggcaacgtttgctcggtctagaaacaaaaaaaagttcaaccatgcgtacaagttcatgtatacatatctcactgacctcgtgactctggcttgacctctcgttttcaacgacgagcatacagcccttgctagtgtgcagttgcttagcctttctttcggagaagccgctagatttttgggccacttggccgagatcttatctcgttgagtcgttggattggcttggtgaccgcgagaacctcgtgggcatggacatgcagctgaacgatcaccgtggcctccggtttagcctacctccacgtgcacggccctgactccgtggccgcaagtcaaaaggcataatatatatgagtactacacgcatagtcaaaatgccgtgtaagcagcaaatgcaccgcacaagctttggagcaaaaggattacttgacacaaatcgtcaaacaaaaacgacaccagaaagaaaatgagaaggctagctacgctgacgagagaaaagaaaaaaaaagggaaaataatgatcctactagtgcattcatcaatcgactagcgtgaaaccattcttgatgtactgcagacaagggaacggcaggtccagcgcgtgctcgaccatgttcgatttcgacagaagcttgccaagaacaaagtccctacggctaagcccaagccgtgcaccgcttgctatggccctgtcacggcaggcgacgagggtgatgttgcagagccaagggacggccgctgtgaaggctagcccgaaatgctgcttgtacgccctgcagacctgggagacatgtttgcccagcggaagaatgctatccacagaggaggttttctccacaccagcaacagatagctccgagtcagagtgtaggttcaccaccacggtgccatggacagggtggactttcatctcaaggttcttgaggaatgttccctctgcgtcccagagcttgcgaggaaatatgtcgtcgccgtcatacgcatcgatgaagaccaaatcgtatacattgctgtcgtttgcgacgaaatcttcagcgtccgcgatatggaggaaaagccggtcatggatgcctccccacaacagctcattgccattggcaggcttcgtgggctccggtggtaaccctttcacaggtaatgaggggaaacccatagaatcaattgaagctgaagcaacaactggatcaatttccacaatatgaacaacagcacctgaaagagtcgatatatgatcaaacatatgtatcaagtgcaaagctacagaatttgaagtttagactccagcaaattaagaaaatctggcaggacaaaaccactgagtatcaacaatctgaattcaagcagttttgtgaaaggaatacgctttttatgaactaatagaagttggcaattttgcagttaaacaagttaggtgtagcttgactacagactgcaggaagcaaagtatcggaaaactgaaatttccatatgtggtgtactagctagggaatgagcattcttgaggctagtgactatatttacctctgaatttgctagccaaaaccaatggtaagctgccaccaccatggccaatacaaagaattttcatattgttctgtccagaaactgcttgatggagatcataagaacaacaaggtagtgctgtcaaccctgctgataccatactcttaacatctgtaaataccttctgtcagatgtgtaatatggtacggaagcaaaagataaaatgcagaagtcaacccaattgctttactttatcattgaagactttgatgcatgtgcaggcaaccatattatgatgataatgacatctaagtaacttgcacttgcaatcttgtagcaaataaataatcaggggaatcattttactgatatcatttgactaccacgaagtatgtgtacactgtgtatttgtgttgtgcatatgaatggatttttctgtgttgtggattaacagatataaatgataccgtgaagtaaaacctaacactgacctattatggtcatcaagatttcatcaaaagattgaagtgaactcacaaggaacagccaaacaatgtggttgctgcatcaagtacatccccgtgtcacccgaagacctgtagcaggccattactttggcaacactttgccgcgtatgatcattgaaccgcattactcgccactggtaacctagtatcttaaactggttggcaccaaatgaatttgggtatattcttgcgttcctttcttgaagccatctctctgttactgtccactcgtcactggcctgaaccgcacaacagttagtctcaacatgaatgcaaaacagatatcatcaattcatcataaaaagctaaatcatggctaacaagctagaactttattaacggtagagcttccacagtgattgctgaatagaccatactccataggcacatctagattaggagaacaagtgttgccattgacctaaacgctttgcccgaaactggaactacaccaaaacagcaagcttttgactgaaaacagcacgattgcaaaagcccgatctctacagagaaatctgaggcctaagttgcaaacatttgaggaacggaggctgtactgtctcgctaacgagttcctgtccccgcttcataagtttttcaatcctttcctttctccggccccagcaaggaagcagatcaagccggaaaacagaggcgaggtttaccgggcgggatgcggggtacgcggagacggagacgacgccgttgccgtgctcggagtggcggcggaagacggtgtgcgccccctcgccggggccctcgtcctcgccccaccactcccggtggtaggaccagtccccctcgtccagaggaggctggcgccgagcgcccgcggcgacagcagccggggatgccgccgatgagagccgccggatggcgccgcgggcgcacctcgacgccgccgcccgcagcatagtgtgctcgctctcccccttgattgcgcgggcgtgtcctgttgacggcggcggcgagagccggtgacccgcacaaggagaagcccacaggaaacggcccaaaagcccccgaagtacaagggcccaatcctcctgggaagctgagaatgattcaactggacctctacatggatgcttgacatttgtccactcaccaaccctattccattgctaccatatgtaggaactaccaacattcaaatgtctttacatgtcctctaaaaaaagtctttacatgcagaaaatgcataaatatcttaaattgtttcagaaatttgaaatgtaccaatagaaattttgggactcaataaattgtttcagaaatttgaaaatgtactgatatgaaagagaagaaaacaatgtttgacaaatttgaatatgtaccaacagtataaaaatgtttcagaatcagaaatttgtaaaatgtactaagaaaaagaaaaaggaaaagaatgtactaccaacagaaaagaaaataaataaataatggcccatgcaggtctcgaacctgcgaccttcgcgttattagcacgacgctctaaccagctgagctaataggccgagttgaggattttataagctactcattaattaagttactaaaaagaaacattaactgcgcatgattcgatttcccgacctcgcaggccacacgctaacaaccgagcacgagcaacattgcgacgccgactatggttgcgacgccaaaatttctggctctcatagatcacgttagtaaccgaacaacgtgacaattaaccaaagcacacgcgcgagcgtgcgttggctagatgcatagtcggccttggtgctcggtgcagagccgatcgctagtcaatgtacgcaaccagccaccgctctaccggtccgcggcccaatcacgccaagtacagaagtgaagaggatcataatccgcagccatcgcgcgccgcaagcacagcaccaggagaagatgatccgattgaagtgcaaaaccgtgccagtagctaaacattattcgcgcatatcgcatcctccacacgttattcttatttctcttgcatcaagatacaaagttaattacaagcagacacgacacgcatctgggtgttcttttgttatcacccagagtccagagagaacaccagacctaagccggcaggcagagcaccgttgcatgtcccctgcgtcacaggctcgatctcacacccacagaccgatccagtagctaactaagctaatctaggacatcttagcgtgctgctcccgctgcatcgccacgtactcgaacaggctcccgtcgtacatgcgccggatggcctccctcgccaggtacccttcctcgtccctcgccagcacgtacaggatcgtccactccagcttcgccgcgaacctacacacacgtcagcaaaacaaaaccaatttcagtatcatctgtcaattgagagtactgcattgtctatttgaacacatctagtgtgttaaaagactgatgatggcttaccatccgaagagatcgagcacttcgcggttcccctcggtcatctgccacacctccctgtaggtgagcctgtcaggggacgtgcgcgcgtacttgctgaagatgttctcgaagttcaccggcatgaacctgcacccccacgaaatgttcggatcagtattctgggcagcagcgagagtgacgaaattcagaagaggatgtatgattaccggccctcgttatcgtaggtcccagagtcactcccgtgcttactcctgtggatgttgtggatgtagatcgggaagaacggggacggcagccagccctacaatgatcacagttcaaaaaaaaggagtttgagatgctatcgctcaagttatacccaagatcgatcagctcactcacaggcagcgtggggtagctcatggacacgttcacgaccagagcaatgaggaaggacatgatcatgttgaacccaagcgcacggcaccctgcaggttccgtcagtgcaccgatcatgcatgccatttgattgcaagatggcgatcaaatgaatgttagtatagtaactcatttgggtcaaatatatactgtaccttcgtaggtttcccatgggtagatgatgccgttgtcgtcgcggtcgaagaaggcgacgtgctgctgcagcacgctgaggtggtggtgctcgtgatcgtccgtcgtggttccgtctgggtggtagatgtccggcgccgccagcgctctcgcaagatctgatcatcaaacaacgagagacgcatccatcttcagctaattgtattattgttgaagtattcgaaccatggagaagatgtgtactaaagaaggcatctcgcatttgtgcttacatggcttggggacgtgttcctcgaggtcgccgcggacggggcgctcgacggtgaccggcgactgcagcgcgacgatggtcagcgagtccttggcctccacgcccgacacgccgcgcatgtccccgaccttgcgggctgccacggcggcgccgcccctcccgtcagtcgccctcgtcgcgcccggggcttcggtgccggcgcggtcgccgttgcgcccggccttggtcgtcgttgtcccctgcatccctccgcttccgcttggcgcggcccaaacgaccgaaacacactcgattccctgtgaagagctcgtagtcttttgagagatcgatgagatcgactagtcgcagttgcaacgtgtagcggcggtgcaggaagtagcgtcgcggccgcggcggggatatataggacgtcgcgatgggcgcgtggcgacgtgtccaccgggaagggcacggtggcgcgacgtgggcgcgtgcatggcgttcggagagtcgcgcggccgtaacgtgtcgctcggtggacagagagggggagcgtacgtcgtcgtgtcgcgagtcttcgtgtttcggtttcggcatcacgcctcctccgggtacgcctcagaaagccaacaggtggggtagcaatcttgtcccatccgtcacgccgacccagaatcccagatggtacagaagcagggggacgttgcctcgttgcacttgcacgttgctctgtatcgcaagtctgcatcattgcaggtaaggttaaaccatgggccgggcccaattaatgaacgagctcatatcatgtagtaagagaaatatggcggaaaaagtacaccgaatgtctcttaacttgtcgtcgagttacaaaatcatccttgaaccacaaaatcaaatagaacgcatccctcaacttacaaaaccagtacaaaccagttctctctgcggtttttgactccgggtttatctgatgtggcagctgactcaacgtgggactcatgtgggtcccacatgtcggtctcttgtttccctccccttgttgaatagcctctgtagaccaagtccacatacccctgcctctcactcctttttttttctccctgcctgtcgcatagagaagcaccagagagagttgacgggcgatggcaggaaatagccaagggaccatgacccggtcggcagcggagggagtagatggatgtaacgctccgcttttcgtgagatgttaaaaactaattcgccaaaatcctatatgcgaaaatttcgttatttgtgtgagagtctaagttgtgccaagatctcaattcaaatctccattgttgttccctcccgtcgccatcaaaatcctccacctctaaaatgtcaatcccgattcatcttctaaagtcaaacatcgaaattcaatcccgtccttaaaattccttgccaatatttctctcgattccaagaatatcaaatcccaaccttgaatccctccttgtctatcgatctatctacctgttcatctatctatctacctatctatccatctatctatctatctacaagttatccatcggttcgtccgtctatctaacaacctttgaattcctgtcccaactccaaggatgtaaatccaaacatatcccagccttgagcttcaacctccaagattcctcctttttcctctttctttggaaaccaccccaaataattcttcggctctctagatacaaaaccaattcgaaaatattgagttttcactttgatctcccttccttgactccaccatattcccatgagtccaaatatcaagttcgaaattcaaattccaaatctcaatcccttcggaatcgatctcctcggcaaaagtctattttgcctccctcttggtcgttgggccgattcttcctccctcggcccatctcccctcccagccttcctctccccccctctcacgtgcgccgcacgtgcctgctcagccgagcaagagagaggcagcgcctctcttcttcctcgctctcttctcgtctctctctctctctcgccgctccccgccagcgctccgccgattcaaaccgccaccgccttcgctcgttcccgcgcgcgctctcgtcgtggtggccgaccgccctcggtcgccgtccgccctggcccgcctgcgccgtgcagccgcccgtgcccactctgtcgtcaccccacctctgcgccgctgtgcgcgtgcgtccaagacgtggaggcagggcctcggctcccctctctcgcatgctctcccacctccct

SEQ ID NO: 39643 - DNA, 3087 bp, Oryza sativa
ctctcgccgtcaccgtccgctgccaagcaccggggaggccggtgcgtgcgaggacgcgtgacgcgggactccgggcaccctcctccttcctcttccccggcccgagaacggagagctcgctcccgcgccgtcggcgctcgacaccgcgcccgttccggctcggtagtgcctccctcccgttccccttcctcactcgccctctccctccctagctcacgtggtagctcggctagccttccggtagttcgtagaagccgcccaagccccgccgccgcctggcatggcctcgccgccattaccgcccgctcccggaggctgccgtcgtcgccagccctccacggtgccactccaccccatccgtcgccggaaaacgggtttcccaactcccttgggtgctcccaccgccttgaatcgacctctcgtctaccgccgccgtttcccctctttgctcgccgccggcatgcgccaccgcgattcgtcgccgccggcctctctccggtgaatccgggccggtgattcgctccctcttgtccctcccatcactccggtgtccttccccctcccttgaatccccgtgtgttgccccggcgaatgtcgccgccgtccgccgtccatctcggcctcccccttcttcctccacacgccggcccgcgtggctgccacgaaggcgcctcgtcggcgccagctcggccggaccgggtcaagctgaccccggtcagccgctccctccgtcccccgctcgcgcgcgtgggcccgtcgtctcctagtcctccgtgcaccgcgccgtgcaccgctccccctcctgaaccccagcaccgcccctgcgtgcgcctccctcatcgtgaaccaggccgccgccatgcgggccccacccgggaccccgtgaggtgaacttggtccaccggaccgctccctctctcccgggcgcccctaatgggccgcctcctcgcgcccgcgccggcccatttggttcggccgagccgcaatagccttcaggccgcgccctagccgcccgaaggaagtctaaatgacatccctctttccttttcttttccaagggatttaataaatcctttttcccctattctataaatcaattccttattccaaaattctataaatcatttcccttgatcctgcacgtaagtgacagtcaataatattcttgagaatattatttctataaatttcataaatcaatttccccttgttccacaaatatcttccttcgcccagaaattccacttaaacttccaaaattcatatatctcgatccgttcgtctgattgcccccgttcaacttccagtaattccgtaaaattgagatctatggcactattaattagtctaaatagggtctttcttttggtcttttggttaggttttcgattgtttgcatatagtcgcggttaccggattttcgtcgatcgtggatttctcgaagattcgtgaagctcagtgaagaccttgagcaaggcaagtcaactttgaacatcttgcacctataatttaaatctaagtatttcttttccgcaaatattgcatgaataggatttacataagtaattcggccgcggcttaagagatagcctgccggcccccaaatcctaactgctgcaattaccctccttgaattattgaacacttaaacctcatttgtcagctgttgtgcttcgatgcatgggtcctcaggcacacgcatcggaacaccttccctcaaatttaaaatatccaacgatgggtaaaacttggggttttacaaaagacttggaaaaacccgacacctgggtcggtgcttgcgaactaaatgaatttccaaaatcgcagaccgggggatgtaccgggagtacggtttcccgctcttgcactaaggaccgtttccttggaatttcatccgaacataagacaagtgcgaccacatgggcgtaatgggacgcccctggctgagtaattagctaatcgggggagccatgatgccaagagacatgtggattcaacggggtggtgccggggagaacccccgggtttcctggcacagtatggtctgggacctaacctggtgttggtctgggacccctctcgttggcataagatgaacctgtgtcgactttcgaaatgccttgtcatgaaagcctcaaggtctccagatgtggccgttctgcacaggctggttgatccgggttagtaatgtcgtgtgggtaaagtgtaccccatctgcagaagttaacaaactgttcgaatagccgtgcccacggtcatgggcggatgtgaagtgattcctagcgtagttttgtttgactactgttttgtgaaattgctgttgtgaaatgggatcgatgtttggaaaatctgtggctgatgggatcagctaggctcgggtggccgtttgaaagctgttgccgggtgccaaccttgaatcaattcaaagactgatacattgcacatactcagactggacgagacgcactgtctcatccgtgtcgtttgagaagtactcatttagttgttttaaaaggagtttaaataaaatcaattgcaaaaacaacagccttcccttgaagcctgcattaaacacttaattcccatggcttgctgagtacgaaagtactcacccttgctctctctctctctctctctctatatatatatatatatatatatatatatatatatatatatatatatatatatatatatatatatatatatatggttcctccgccttgaagagaagatgaagtgaagcgaagattagggtttcgtcttggttcctaatcgttgcctgtggtgttgggtgttagttcgttggttccgctgctgctgttgttgttggtgtttcctcgtccgcgtcatcggttgtattctcgggctgtcctgagctgcaacctaagttaaagtaaataagtcctctatttaatttaagaattgcaatgattcatatttgtcaccgtgggtaccagcgctatgtcctgggactggtactgtgatcgcggtttcgtaggaagcggttcgcgccgtttttcctacgacacgctcctatcaggtgtcgttgtacggcggtgcccgattggggtgtgacaatggagg

SEQ ID NO: 39644 - DNA, 2524 bp, Oryza sativa
aaccggttttacggttcaaggatgattttataactcgatggcaagttgagggaccttcggtgtactttttccaagtatggcaggctaaggaaattcttggtccaaccgttcaggtgtgcattttgcagcccatggtcccatcgatgcctcgttaaggcagattagtcccaatagataggttggttggattaagttggatggaatttaataaacgtggaattgttttttataatccctctcaaaactattgagaaaaattaaccgaacaagagagaagagagaagaactctgggtagaaatatgagatatataatatacagagttacatgccaaggtaggggacatcccattttctttcaatttttaaggaaataataattatacaaaattagtgaatataacgcgctagacttacatgacactcatccgtattaaaatataaaggattatatcctttaattttatctcataattaacggattatatattcccgagataatttattcattgcatatatcatcttttgtacttttattccccacccacgatattttctactagaatatttccctaccagcttttgtactaatttattcttcaaccattacattttatacccataagttacttgaagtttgatattttacctcataaatcatttttgttgcaaatgcctacacacctacttagttctgttgcaaactgaataatacgtgggcatttacaacaaattgatacatgagatgaaatatcaaatttcaagtgatttattgggaggatttcgcaatttcccctttatactatgctttgtcctttttccactttctcacttttgaaaaaaaagggagcatactctcttctatcatccggtggagggagtactaatcaaaatacacatttagtaatgcttacctttacttcaatcacagaattttatatgtcaatcacactttcaggttacagacacatttcaataatcacatggatagtacataatgtatgttccaaccggtaaaccttatttccattgttttttcagatggacaaacatgatgtggctatagctatagtccacacaacaacacacacaagcaatcaagcacatcccaggtcccgggacgatgaaattaggaggctacttctgcttctcatgtgcctcccttctctgctgggcaatcgactcgaataggctcccatcgaagcagcggcgaacagcctccttcctgaggaatccttcctcatctttcgcaagcacgtagagcaatatccactcccccttactcgcgatcctgaacgcacacatgcatgtatttacaccagcaattcagcatgcagaggtaggaagcattcagagaacgaacggcaaagaaatcgctaggtaagtatcgttgctgcatatataggagtgttgatcagctgttctcacctcccaagcaagtcgagcgccaccctttggccttcggtcatccgccagatatcgccgaacgtgagcttgtccggcgccgtgcgggcgttcttgctgaagatgctctcgaaattgaccggcataaacctttcgtagtttcaggacaaaaaaggcaatgaaatgtcaccgtgtaagtactggattattacaagtctacaacaactagcagtgtgcaatgggtcgacgatggtttaccttccctcgttgtcgtacgtcgagctatcgctgccgtgcttagccctgtggatgttttttatgtgtatagggaacaggagagatggtatccagctctgcacggtcgatcaaattttcaatgtctagtgcagagaaatgtataccatcttggcatcttcttggtagaaaccccaaaaaaaaagttacttttggacttactggcagagttgggtagcttagaccaacgtttatggctatcgccaaaaagaacgaaacaatcacgttgaagcccaattcccgtagtcctgtgtaatttttacaccttttcatcaaaggttttgtacccctcaacaagtaatgttcggactaatattgtgaaggtgaaacggagataccgccgtgacaacaaaagagacgtatgaatactgtagaatatgattctatcgggctgaatgatcttccgatatatacaaatattttattcggctgaacaataatagccgtttaatttttttttccgcagcaacaatggagctatatgttttgtagtatgtacctccataagtttcccatggataaacgataccgtcgccatccaggtcgaagaaagccacatgctgctgcagcacactcatctgccggtggtcacgcccctcggttccttcaggatggtacacgtccggagcaaccagagctcgggccaaatctgcgatcagaatcgttgttcagccgaattcagaactagaactagatcgacagacaaaactaaagctgtaaccgatctcatcgaggcaaacagatactcacagggcttcggaatctgcacttccaagtccgctcggaccggccgttctctcgtcaccggcgcctccgccgccacggacg

SEQ ID NO: 39645 - DNA, 4642 bp, Oryza sativa
gggcccgcccgtcgtcgcggacctctccaagctccgtcgtgtggctcccaagctcgtcgccgaggtcctcagcactcgcccgccaccgccgccgccgctcgcgttcccgttcttcctgtgggcggcgcggcagaaggttcccggtgttccacgtgcacgcgagagagagaggaggaagggagataagaggggaaagagagggtgacgtggagacctgacatgtgggtcccacgctgactcagccgccacgtagaccaaaaccagggttaaaaccaccaaaaagacctcgggtgtccggttttatgtagttaaaggacccagcatatctggttttgcggttcgaggacgttttcgtgtcactatgacaagttgagggaccttcggtgtactttttcccactgccaaatgtaccaaacccgcacaaaagcggcccaattcctacgtgaaccttttatcagcacaaaccgaatgctgaaacataaagtaaaaaagagtgaattgtactttcaatcatttgcattcttttcactttgaattagctattgttattatttttgtactataggccatctaaacggaattagttatcaacatcctcaagcacattagcatcctcataccgaatattttatctatttacgtacaactcacatctttatccgagaaatgttatatgtggttagataaaagagtttaggtgatccaaaacaccaaaaataaaaagagaaaagcctagtcgaaagtaaaaatataagataaaagtggtcaaatttcgataagaaaaaggtgaccaagacgcaatttacttatataaaaatcatcaaacgttctaagcacaggggaaaaggctctaaaatgtgtcacacaatgaaacaactgattaatttctattggcaacggccactctacatgtaaactgagtacagattattgctagttaaaacccaaataacttgaaaccaaacactgttcttcttcctttcatggaacagagaggccgatgtcgcgccctttggacgacacgtcgggacggtatctcttccacggcttgtagtccttctccccgagcatcttctccacctcctcgaactgcagtcccttggtctccggcacggtgaagaagacgacgacgagcgcgaagaaggagacggcgcagaagaggaagaaggtggccgacgtgcccagcgccttggtgaggctcaggaacgtctgcgtgacgatgaggttggacacccagttggccaccgccgcgatgccgccgcagacgcccctgaaccgcagcgggtagatctccgagttgacgatccatggcacggtgcccatgcccggggagtaggagacgatgtacgcgccgagcgccaccagcgccagccacccgaagttgttggggcacccttccgtgtagaactcccggttccccgcgtggcacgtccgccgcgacgcttcgcccgccgccaggcacgcgccggggaggagctgctcgatcgtccagaaagctcacttctcatatcaatggcaagaacagcaagaacaacatcaagagacaagaatgttagtaccttgtttcctccgtgggcgcagaagccgcaggtggactgggccttgaggcagttcatgcagttccagcgggcgctcgggctgtactccgggcacgtctggttggcgaacacccgcgtctccaggtcgctgaccggcggcgcgtggtgcgcggcgccgaggaacgtgccgccgagcacggcgagccacaggacgatgccgacgaggctgatgatcatcaggcgacggcggccggccctgtccacgaagaacatgctgacgatggacccgatggcgttgaggcccgaggtgatgagggacagcgccatggccgtgttgttcgacgcgaagccggccagctggacgatcgtcgggctgtagtacatgacggtgttgatgccgacgaactgctgggcgacctgcgcgatgacgccggccatgagcccacggcggacgaccttgctgctcagtgccttcgtcagcttgccaaccagactctgctcgccgatggagccctccagttgtttctcatgttcaattgatcggcgcatcgaatcgatctcttcttcaacctcagccgcggggtaaatcttccttaatatggcttcagcctcctctttcctatcctgtgcagaattcagtaatttccagcacaatcttttagcttgacagagtcaaatttgctacaaaatttacttgtgatttgtgcatatgtaacaatgtacttcccttgtacatctacgtttccatgtaacaatgaactaaacacgtatgtacatttttttttctttaagcaaagcatctgtacataaatactgacctgtctgtatagccaccttggtgattcaggtagcatacacatcaatatgaactgaataaaagcaggaagacctgcaatgccaagcatccacctccatgttccctttacctgacagagtcattgagatatgattactgctgcaccttgaaaaagacatggtacagcacgagctttcagtgtacacaggtgagtaaccttagtgaaggccagattaatgaggtatgccatgaactgccctccggtaataagaagtccatttgtgctcacaagtgcacctctgattctagctggagaggcttcagaaatgtacaaaggtgctgtcatggaagccattccaaccccaagaccaacaaagatcctcccaataatgatgacaaacggtgttggggcaagggccatgatcaaggcacctgcgaggaacagggaatcggcgatcaagatggaaggcttccttccaaacttgtcgttcatccagccaccaaatcctgctccaactatggctccagctacagccatactcactatcgtttcctgcatttcagatcagggcaaatcccatcagattttgtcaacacggaatgctgtattctgaagaaaagcagttgtactacggaaagtgaaaagttaaatcaaagtgagaatcaggagaagccaaatgtaccctaagtacagtgctcttttcgaccgcagtaaaatcatctcgaatatacagaagtgctccagatatgacacctagcaaaacagtagattaattaaaaagaatcgaaatttgtcatctgtgttgcatttccaaagtggagctaaatgtttggaaacataaacaacattatgatacttaatagactacagagatacttaaaaagtaaataaatggacaattgaaaaggacataatagcaaaacttgaactttgacaaaattcagtaaattatttttgttgtagcctatgccatgtaacagtacctgtatcatatccgaaaagaagaccaccgatgccggcagagaaaacaagctgaagaatgtaaggctggctccaggtcagccgcagacattccttaaattcagccttatcagctagagttgcacccccttccattgcattcaagggcttttgcgcacccaacgtaggttcagattagattggtcacgcaggaatgaaacataaattgtcctgtattattacacagaattaaaatgctacagaattaaatagaagatttgtcaatgtaggacctataataatactatgaatcgcaacaacgaagaagtgccatagattaagaaacccagcaaactatttattctgttcagtaacagaagtttcataatacgaatgatggttcactgtttcaaacatcatgattgctatacttgtttggatcacatcatataaaactgtgagcggcatcaatcgattataaaatcagggaagatagagatgaatctcgatacctacgatgtaggacagaaaaatctcctcagaatgtgcctttccaaaccttcaggacagaagaagcatggtgtgtttctcgacaggagtccctttcttttataggatggcgcaaccaacatttacaacggaagaacagccttaaaaccacaatccctaaacgtaacgacaatccaaaatcgcgtgtttcatcgcagggaggaacgcggataagtctcaccccgactcgcctaacataaacaacgaaatctcaacgataagatctacagaagaaaccgactcaaccgatctcccgctaaaaaagaatcctttcaccggaaaggagccacaaaccccgagaaccccagataattcccgaccttgcgatccgtgaggacgccgcggcgccacgagtaggaagaacaagaagaagaactggcagtgtgctgagacggaaaacttcacctcaccgagaaacagaaacggggagagaaaccccaggctgccgggagcccgggacgagagccgcgcgagcccagcacagcacacgaaacacactccttccccaccccaccgcgcctccaccacggacgacgagcaaagtggcaggcgcgctgcggcagccgggcgattttactgaggacgctcccctcccttcccgtccacccgcgcgtggcgtggcaattcaatgcgggggcttaggctggcacgcgcacgctcgagtgacgctttgccgattgccagtgtgagtatatccgatagatagagagaccgacgcgcgcggtggccctcgcggaatcgccgaatcgagtcgtggtgataactgtaactgctcgatccctttgactcgccggattc

SEQ ID NO: 39646 - DNA, 2156 bp, Oryza sativa
ggttgatgatataagttatattttcctttaaaaatggtcccagtgtcccacatgtcatagacttgtattagttttacagtatttatttgattggtgttataactatggctaaccatactatttcttcgtatggccccacatcatagacttggatttttagttaactttggctaagtcatggctagcatattctatgtcaggcatgtcttacttaaagtgtagtttggaaaaggtagtaagcaatcaatcatctgctaagagtacgaaaggcggtgctaggacccatatgagacactatcaggttgcgctaaaaaggaataagtatatttgtctccctcatctcctgaccctgaccctagatgaatcgtctttctcaagtctcaatcgtagaactggtataacacctcccacatattcaaaaaccggtgtaaattgactcctcggtggtttcaaaagtgatttcgtcctatgtggcacttatgagacccacatgttagtgaagaaaaataaaaaattaacagtcccacatgccagtcatcttaatctccttttctttttcctcccctctctcggtgacaccggttagcattgttggggtaacagtggcgaggttttggggaagagaacatggagccacacgagcgcgaggcaggggagggacaaacgggcgggaggacacgatcactaccatgacatccctctctactgctgggcttgtctccatggtgtcatcaccaagaggcgttacattaagatgggtggcacgcgggagagaaactcgccggctggctgcaaggcgtgggcttctggggacttggccagctctagtgcgtgcgggaggagaagctcgtcggcgaccacgcacgtggggaggacttgactggctccagcacgcgtgggaggataagctcattgcccagctacacacgtggggaggacctcacggactacacgtgtggttccaatccttcctcctactactctcctgcccctccctcccccactcactcctcagtgctcctctcccttttgtcgaagccattttcgctcaccttcacaaccgccgcctagagagggagagaatgggagagagaggggacataaaagggtgaataaaaagaaaacggatgttaggacaactaatttgtgaagctattattttctctcagtgacatgtggatcttatgagtgtcaggtggaccaaaccgtttataagcaagagagcagatgaaatagaaaaagtagacttattccgtgtaaaaatgtgggatcgtttacagcgagaaaaaaaatgcaccagccgggaatcgaacccgggtctgtaccgtggcagggtactattctaccactagaccactggtgcgcttgatgtccttttttgaagaaaagttttattgaacttatcaataaatcctgaaaaccggggccattactctcatcggaatgatcaacgtacgtttggatgcattcagggcctatacggtttggaggaaattcatgggaattttgaaggaatttaactggtgactgtaaaattttctaaaaatttcatgcgtttcgaaggagcgtatcaacgagatccgccccagattaatgcaacttgggaggtgcagtgagcttccacattgccttcacaccggaacatcatttgcactctaagataggtcatccataagctcgtaattactctcgaaaatctatttcgagagtgtcctatcagcgtgagctaggggatcgaacagagtactaaaatcttcttccgagtgagctacacagcgtccgcagcgaatataaaagatactcacgtgtgactagcaacatgcctgttatgctctccagaccttgcaggcataacttgcatatgtgatggacaacgcacattttcgtcatgtcttgcaatgacagcatatctcattggctgataagcaatcaatcgataatgaccttttatgccagttgatgaataaaacacatggatatacaaaatatcgtgcctaaacccacaaaacagagaattagcaccgaaggcaattagaacaaggctctacaagattgcgcaacctcccgccgataccactgtcgtctaaagatagaaacgcaaccactgttgcaggcgacttccttctgttttcttgagtctaagggcagaatattca

SEQ ID NO: 39647 - DNA, 4430 bp, Oryza sativa
aaacagtaaaaaagcaatatgttgtgaatcctactcaaatattttacctggattactgactgaggcaaattattgatctggctttctgaagcaccagcatgctggtggttattttcatctaatgcaagcagtgcatcataatcatttctgcaaggaaacttcctttagttaaaaaaaatatcaaattttccaatcaaataaaactcgttaatatcagcaaaatggtatcacggtatatacttccctatcattactgtatactagcactattacttttcacaggcatagaagaaagtcacccagcaaaacaagtaaataaagattatcaaagaaatattcaagttggatgacaacttatatgaaccagctatgatattcggtgaaaagcacagcaggtaaagcaatggaagtaacaacaggagaaagtcacttacagatcaatattaggttgaatatgtgcagcagggtatctggaaagagctctctgcaaaaatgttggctagaagctgttaattatctttcggaatcatttcaataaaagaaccaccaactgtaaatgtgatgaaaggctttacttaatctgaagtaatctactacacaacaatgtataaggggcagcctctcaatcatacacacaacccaaccgttaggtaacacaaaaggggatcttgtttcctttgtaaaggacaggaaatgcatgaggggatcaaatactacaaagagatgaaatcaaccagtttgataaaatatgaaatttattgaatctactgaaaagctcaaacagagctaaagtacaaaacgacggttgaaatcagtgtcagttttgagccataaaataaacgctttattggctatagaaggacatataaaaaacctaaatatttgcccttccaaatttcagtgtatgtcacaaataaaaaaaaacatagaacaactttcatagcgtccttaagctatttggcacattttacaataggttaagaactagaatttagtttatactgtaatgcacatgacatggaagcaaagcaagataaatgacagttgactttttaaaccaaaagatttttcctgttcagaagtagtatcaagttttataggcaataatattgttacaggcaagagaaagaaataccactcccaaagttattagggtagcatacctggtaaattattcttctgttgtttgagtcatatcgaaccctattagcatgctgaggaacagttgaacgcaatacccttggacctctctaacaaaaaggaacaaggaaaagagaaaacatgtcaatgtcaacagattagtgtattgttaaacaacacattcaaggaactctgtcataaaacaaagcccatcatttggatcaaccacaagaaaaggctggtttgttatgggcagcatgaactgtcataacttgtgcaaactgaaggattcctgtaatttcattttcggcaactgtgatctcacatagtaaagacaacagcagtgtgtgctatagaaagctaacagatgtgtggatggcatactactgacgaatggagcaacaactatgagacccgaccctcattcacacaggcacgctgtgatatggagaaagtaaagatgaacagcaaggtgctcttactgtagtgctttggaaccgcctcgcagttctagatgtcggctgcgcattatcttcatgttgaagtgacattgctatgatcgcatcaatctgctttattaaaataaaatatcattgtacagctcgcaaaagtattttgagagagagagagagagagtcaggaattacacctcttctgtgggaacaacatgaggagtttcattgtaaagctgctcctgaagttggcgagccaataactcatcagactccaactgttctcttatgttgggatccactgaggtccgattgctgctaccaatcccactcaaactaggccttacttcaggagagcatatgtcatcaatatctactacaggaatatgatgacggtgagtggtatgatttctagcagctgttgagtctgatgatgcaactctaggttgatcaacatcaacagagctagagctttcaccaggatggtaagaacttgcgatgcgcttcctctttctgctactgatccttattgttctattaacaaaactagcagtctgcaatgtttttgctccaccaattgagttattgttgtctcctccctcaattgagttattgctgtctcctgctgcagatgctcgatccagattagactgttcagaagatccagattctcttccacaactattggtcatcttacctgatagtggcatgggtatattactagtattattgtgcgttgttctccaaccttgctcagaacctataccggtgtgatcattgtttgcaacggaagaagaatctcccatggatcttggacaaaccctaacaatagtgaaagtgcaggtaaaggttctagacatgcaataatctaaacatagcaacaaattaatcatgcatttttgtaagtccaacaatggagcaaaactagtttagtcatactgtatgattttaaaggaaggttattttgctgaaaaaaaaagatttgtaaaaagaattagcatctcctgcttacaattttcaaaagttcacaaattgtaaccacatgcacaagaattttgtaaacttaaattcaaccaataaaattactaccctaaaagccagaatttaccttatcgcaaattcacagttcttttaaacaaaaacatttcctccatatcttgtactcatattgatacatcctagatataaatgaaatgaactgacaatgcccataggaaaaaagagacaggacatacctcctcatataagcctctccagactgcttagcacccacgacatcatgggaaatttcttttcctttattcttgttaccttcagaaaaaatactgttcacttgatttgcagccagtggaattaccgtctccccagctctgcctattgccgactttctccctgaccttttttccatgtcagttgcagtgtttccctgccttcttattataggtgaactatcagtaagatctatcacatttcccttcccagaagcatcaacctgagtatctggatagtgtaagagtccacttgtagagcatatttctcgcttttcatcaaccttcagacttcttttggctatgttggagggagaaatacaaccattccgcaccagctttctttggcccacatgcctttgaggaacaatgcttggtgtagagcttgaaattcctgttgtgcccttgtcagtgatctcttcccctttgccctctctaggactcgatactgaacagacattagcacctactacttccttcggcttcttaaaggtgatagtccccattctgtttcgtggttttcccaccgtagtagtaggaagacctgatcctaaacagagaaagtcagcattgcagctattggcatcccgtgcactaatatccccttttctgatttggcaactacggtccctttctccagagcccctgcaatttatattgtttgaaatattcatgctctgatccaaaccagatttttttggcaccttttcattctcaacagatgtctctatcgtccgacctgattttagcaaggatgatcttgcttcaggatcttctgccactggcagcaatcgtgccaactcggcttgtttaaaaatatcgccagcatctaaaggtgcaggcgacacactacttgcattgcctctacttgattgaccctggatggagttatttgtgatcttaaatttaattcttcgcgatggtaatggagttccagctgcttttgcaatacctctcctagcagctgggctagatacagggcatgttgactgctgtattcggtcaggggtgtccggaacctcaaagatgtgatcagggtttatgtcaaccatggtatcccaccgaaactatttcagttacagatagcttgcctcctctcctttacatgtcaatttatgattaaaattctccaacacttcctacaagatacagagatgttatgaaaagagctgccttacaacaagaaccagtaagtaagatttgttttagaaagaacaaataaacttagcaggaaaatttggtctgcagtaaaaaagaaaagaaaaggggaactgtttctgtagtaacatgcagcaggtgcttggcaccagaacccacaagatgatggccaacatggaggtggatgctggaatccttaatctggttggtgaaggaacgaggtcatgaagtgtaagtaacaatgatggtctggaccattttcactggattcacaagctgctcccaaatatattgccaaagaaagaaatgtagaagtaaacaacaaactggactggatcaagtgaatactttcttcaaagagcatgcttccttgaatactcaattctagcttccagatataattattcaagtg

SEQ ID NO: 39648 - DNA, 15164 bp, Oryza sativa
atgtaaatatagtacaatagtagtgtaattaaattctagcttatatgtaactacactgtaaccgatgtgtaactttcatgtaattttgaaaaccgttagatttgctttaagattcgtgcaaatggagaagaagaaaatcacaacgcacaagtaaagggatttggtcccatgatttccgcttcgtgaaaatagcatgttatggtaagatttttaaaagttacatgtaagttacgatgtaaatacactgtatttacacctgtcaattctttatgcgaaaatttgtcgataaatgtatagcaaaattgatatggatagtcatagtgtaattatattataataattacaatataatttatatgtaactttaaaaatctcgcagtaacacgaaatttctaagaagcagacgtctcaggacgaaatgccctcacacatatgcacgatatgattatttccttcactgtttgcatgaatcttgaaacaaatattgtggctagaaattatgtaaaagttacatgcaagtaacattgtaattatatacaacttagatataattacactacaattaaactatatttatatttgataaatttttaggagaaaatttatcagcaaatgtatagcaaagtcaaaataaaaaaatgatctggacgacgtgaacttgctgaaatttacgagctactgtatcaatttaccactaacgttcagtacttcagtctaccatgatatgaacaggagccaggagggccaaacaaatcacaaatgtatgtggaagtggtcaagtaaataagccaacttgcagggtaaggcgtgacagcgtgaggatatgatgaatccgaatcgaaagaacagtcagtgtaaccatagactcaggattgcagtgggctttgcagaaatgcatgaacatggaaagatgggcaataaccggcgagtagcatcttttcacaattatttgcaagcacgcaagcaggtccaaaatccagaagaacttctgcaccttcatgtacatgaaatgaaattggcttcacactctaaatcttacacattcttacaaggtggacaacaaacaaggacttggcacacttgaaaattttcaaacgcttaaatgaagagaaacaagctcatgcagaggatttcttcagtgctctatccagcctgacattgaagggagttgagtgccagtttacccttttgtcctgcagcaacccactgaagcatcagtacatcattcaaaaatctgaagaaacatatgacttgagtgttgaatgcacctctctgtatttgcttgtcgtattggggattccattggttcctgaatctgatcttgaagaacagtgtgcattgtcttgcttggtgctactccagtaacttcccaccgtacccaagatcgcctcttcacggttatggctgggagaccttcgtggagatgatgtagctgatgattgcttaaggtcatcgaccgtcaaagcacccaggacaggcctttcatctcggtttacagttgaaatggaacaaggagatccactttgcaccttgtctactgttgagttatctgaagaaaccaaccaagtagagaggctcgcatccacagaaacttccttcttgatagaattttcaggggttgcacctacctttggcactgaatttacattctccttattcgactttttagctggtgctgcttgggcttttacttccttccactgtgacatattctgaaccggattcagcacaggacggacatactggcctctgtcgcgatgattgtttctctgaattagagggctttgttcctctacagaggtactactgctcttaggtgcagggctgctgacttcattgtcattctgctgatctttgtacatttgcaatgagaaaagagactcatgggactcctgcttgatatcttcagtgtacagttcatccttgtctactaaatcaatcttgcagtctacaaaatcctcctcctcctcatcactatcatcaccgtagttgtcgtcctcaccatactcatcttcttcttcttcgctgtctgagcaattccggtaacggtgattctccgggagcagcacatccttttgcatgtgttttccatcttcattttctaccatactgacaggctctggtggttcctcctcttggtcagccggtgcagtgttttcatatgccgtaacattcatgtcgaacgttactttcttcttgccactgctgcggctctcttgtccgcccacctccctatgcatcaagaaagacggcatgttaacaggcacacaagccgaatcattcatacactaatcatttcgttaacctacctgagttctggatcaggagtgcaaacaactgcttccgccaaaggtggtgagtgtgccaccggggagagtggcggtgttacttgcttctccggcagcaaagagcttgctggcgatgccttctgctcactgcaaacagattaacagtaagaaatacaacatcgaatacaaggtgaaggtacagccatagaaatacggaactaaacgtatatggcatttgggaattaggcaattaacagttataagcaggctgccgagcattaggacatgttcatatccatgtcagtcaatactacggtgctgcttctctgaggcgtttcagcaaacacccgagctgcaattctctccctaccagccattctcacgcattcgcataagcattcgagagcaacagcgaaaattcacaggcacgcaaagacgaccacagtggaggctacacgcacctcagctcctttccgggccttgcgccagtgaccacctcctccgcagcctccaccggcatgggcggcggtgccagcaacacatccttcgcctcctgcaacagtggcggcggttccacctcctccttcgcctccacatccaccgccgtcaacgccttgccgagcagagcaacctgcggggcaaatccgaaacccatcaggaactcacggaatcaccatcacccacccgagcgccctaccacaggggcgagcacccgagaccagaatctcacatggtccggccgcggcggcggggacctcgccggagactgcctccgcggctgccgccggcggcggcggtcgccgaagcaggcgaggaagcagcccatggaggcgaagatgcgggaggacgggagcagccgggtggaaggattcgatggagtggctcgattttgaatttttttccggggatttcgagaaagtattttataaattagttttggtagtggcggatagtgcggattcggtgaggaatctgaccgttgctaaccaagaattgaagaccaagagggccagggtgcggcgcgggcaggtaggtggctgcactgattgctattgtctgatttgctggtttgaattaggaataagtctatttcgccccctcagctattgcgttgatttaaaatgcaccctcaaatttcaaaaccagatttttagacatctctcaacttctaaaaccgttcaatttacccctcaattcaaacctgagtagttttgatatacatgaggctgacgtacatatctagccagtgaaaaaataatagtaattgcatggcccacatgtcattgaccataacattttcctcctctctctccacgcaccaaccttgacgggcctatttctcctctccaggcaccaactgctggtattctctgatagagcagtgactctaacttctccttattggcgcatcgccgctaggggtggaaaaaaagctcgggcttggctcgagcttggttggcttggctctgctcgtaagccaaacgagccaagcccaagaagcctccttttcagctcgttgctgaaataagccgagctgagctagctcgcgagccacttgttttggctcgcgagcctagatcattgttgtcgaggttacgggtctggcataccctctacccttcgatatacgttacgtatcgacgtggcatgcccacgcgtacgcggacatttccttcataatctaaggaaacttttcacgaaatcaacagacggaaagagtccttctcggacaaggactgggttacctacgtatcgtgctaggtctggtgtgttcgagtcctactcggagagcatcagacctatggtataaaagggatcccccggagagggcataggggatcgaatctcagagccaacacaacccacacagtctatgaagccggagcctgcgaggagccaagtcgtcgagagctagtcgaatcaactcgactacaatctcgccggatctgacaagttccatcttttcctttgtaacctgtgttttccgctatataatcccatatcaactggattagggctattacctgttaaggggcctgaaccagtataattcctgtcttttgattgcttgatgtcgtactacgtagatccttgtaccagcgtacccctatacactctatatccggtctacgggtatcacccatcgacagtggcgcgctaggtagggggacttggtactcaaggttctactactatgccatcaagcttcgtctacaacaacgtcaacacccgctccagccaaacactctcgacttcaacaatgctggtatggactcaagtcggcgaaatcgtcttcccggtttacaccacgatgccgatctcaaccggtcctccaatgactgaaaacgagaacgcagtggctacgaaccaagacggttccatgtcgaaaaacccacccattgaaacggagaacggattaccgactacattcaaactcgggaaggattctgatgcggccaagtcttgtccctccgacaaaatacacggaccggcaaagatgactcccgaagctatcaggtcttggtgtcctatctacaaaaccaagaaacatacccttcaagattgctgggtattcatcgatgtccgtgctgaaattcgcgcctgcaaagaacgtggaattcagcgtatttctccaactcgggatatctattgtcctatccacaagacaaagaatcacgatctctcgagctgcaaagttctcctcggcgccatgaagaccccatctcctaagtcatacgtccccgccagggataacggcaaggaacagggagcgactccagcctcagatcgattcgttggggtaatcgatctcgatcctcacgaaccattgttcttacatctcctcgaagactacgggtcatcgacaacaagtgcaccgcgggaggtattagttatcgatgacgttggcacgtcagctcaagccaacgcagaagcggcaaatcaatcgactactccagctcagcacatcagggctattcaaactatactgagggaaactcctttcgatcccgttctgaacgatgacctcgagcattggacagaacgattacgggagtcggtgaccaaccttagcaatgcgttcgaagaggccgctaccgcatcacactaagatcagccaccaatcgccaaccccaatggtgaagatccggagcggagggaatcgcctcgacaggctacccctccacctcgtggcactggtgatcttcgagatcaaattaacggtcgccgagaagcacggcgcacatgggacgatgcaaatcgctctcggcgtcatgtttcttcacggcgccatgatcgaggagaccgcccaaacgaggaccgagaatgcaacgatcatgaacggcgggggccagacaatactggtcatggccgtcgccgcaacgacgacgacgaaggagatcggcgccgagataacagcgagagacaacgacaagattcccgggatccaggtcgtcatcctcgtaatcgtacgccagagccaagcgacccctcgtcatcgtcatcatccgcgtcctcttcatcgtcagacagacatccacgaaggtcatgcgaccgccggcaacccaccgcccccagtgctgggtatagggctttcggtcgttccctacgtgatgtccgatggcctgagagattccgacccgggccattgaaaagtatgatgggagcactgacccagaagaattccttcaagtctactcgacagtgctttatgctgctggagcagatgacaacgcattggcgaactatttaccaactgcgttgaagggttctgcacgttcatggctgatgcatcttcctccctactcaatctcttcgtgggcagatctgtggcaacagttcgtcgccaatttccaaggaacatacaagcgccacgcgatcgaagacgacttacacgcgttaacatagaactctggggaatcattgagggaatacgttcgcgctttaataagtgcagaaacaccatttccgagattaccgacgcttctgtaattcgtgccttcaagtccagtgtcagagatcgctacactacccaggagttggcaataagacgcatcacaactactcgaagattattcgagatcgttgagcggtgtgcccacgtggatgacgcgctaagacgcaagaacgacaagccgaagaccgggggagagaagaaaccagccgcagacgcatttgagtcaaacaagaagaaaaatcgcaagaacgggaaaaggaaagctcaagcggaagtcctcgcagctaagtacgcgaaccctcccaagcgcccaaacccacagggcagcgatacaaagaaatcatggtgccccatacacaaagcggacagacattctctggaggattgccttgttttcaaaaagtcgctcgagaagcacatggcatttgaaaagggcaagcgggtacgtgttgtcgagaagaacgaggagacacctcctcatgaatcggactctgcgtacccgaactccgacctccacatctcacacatcttcgacggctccacaacgtactcctccaagcgagaatacaagaaagtggaacgtgaagtctgttcgacgtggcgggtggctgcacccaagatgaagtggtctgagcagagaatagagttctcggaggaggaccaccccaacacctctgttatcccaggtcgatatccgatcgtggtcgagcccactattcggaacgtcaaggtagcacgagttctcatcgacggtggcagctcaatcccacaaagtgagttgacaccaactgatcaacccttccatggaattactccccaatcatcatccagacctttgggcaagatcacattgcccgtgaccttcggccaagccaacaacttccgaacagagcagatcacctttgatgtcgctgaatttaatacagcttataacgccatcatcgggagaactgcacttgcgaagttcatggccgcatcccactacgcatatcaagtgctcaagatgccgggaccgaagggaacaatcactattcaggggaatgcaaagctggcggtgcagtgcgacaagcggagcctcgacatggtcgagcaaacgcccaccccacctgccatgtctgagccacccaagaaagtgagcaagctaaacaagacgccgaagccagacggcgccatcaaaatcgttccgctctctagtgctaaccccgacaagactgtcaaaatcggggctacactagatgagaaataggaactcgcgctcatcaccttcctccgcgacaatgccgacgtgttcgcttggcagccgtccgacatgccgggggtccccagggaggtgattgagcacaaactaatggtgcgacccgatgccaagccagtaaagcaaagactgcggagatttgcaccagatcgaaaacaagccatacgagaagagctcgacaaacttctcaaagctggcttcatcagagaagtacttcatccagagtggctagccaacccagtcatggtgcggaaggccaacggaaaatggagaatgtgcgtcgacttcacagacctcaacaaggcgtgccccaaggatcactttcctctccctcgaatagaccagttggtggattcaacagccggatgcgagcttttaagcttcctcgacgcttactctggctaccaccaaatcagtatggcgaaagaggacgaggagaaaacaacgttcatcacgccgttcggggtattttgctatgttaagatgcctttcggactaataactaccgggaatactttctagcgcacggtccagggcgcacttagcaaccagcttggcaacaatgtcgaggcttacgtcgatgacatcgttgtcaaaaccaagacgagcgactcattgattgatcacctgcgggaaacgttcgacaacctccgacgatatcgccttatgctcaactcagagaagtgcacattcggagtaccgtcggccaagctactcggattcctcgtttctggcagagggatagaggcaaatcccgagaagatcaaagcaatcgagaacatgaagtcgcccacaagactcaaggaggtgcagaagctaaccggatgcatggcagcattaagcagattcgtcgctaggatgggagaacgaggacagcctttcttcgccttgttgaagaaacaagacaaatttatatggacacaggaagccggagaggcatttattgcactcaagcgctacctatcaaacccccctgtactcgttgctccccaacctaatgaagaattattcctttatattgtcgccacgccatattccgttagcactatcattgtcgtcgagagagagaaagtacaacgaccagtttattactcagcgaagctctccatgatgcaaagacaagatatccacagattcaaaaactgctctacgcagtcatcatgacatcaaggaagctacgccactactttcaagccacagagtcacagttgtctcctccttcccacttggcgaagttgtgagaaacaaagacgttctcggccgcatcgcgaaatgggtagtcgagctaagccagtttgatatccactttgtgccgtgaacagccatcaaatctcaggtactcgccgacttcgtggccgattggaccatgccagataataagccagacaaccaaggcgacaatgagacatggacaatggcgttcgatggcgcactcaacagccaaggagcaggggcaggatttatcttaacatctccctccggagatcaattcaagcatgcaatccacctcaacttcagggcaaccaataacactgcagaatacgaaggactactcgccgggatacgagctgcagccgcacttggggccaagcgactaatcgtcaaagggaactctaagctagtcgcaaaccaggtgtacaaagactacaaatgctccaaccccgagttatccaagtatctctcagaagtcaggaagctagagaggaggttcgatgggatcgaggtccggcacgtctaccgcaaggacaacgtcgagccagacgatctagcacgacgcgcatccagacgagagccgctcgagcccggcacctttctcgacgtcctgacgaagccatcggtgaaggaagtaagcggtgaagttggcccgaacacccccgacatcagctcggaggtcactgaggtagaacgcgccgttgttgacatcgaaactacagacgactggcgcagcccattaatcaaattcatcagcagcgaggagttgcccgaggacgatacagaggctgagaaaataatccgcaaagcaaagatctactgtatggtcggcaacgacttatacaaaaaagcgccaaacaggatatttctcaaatgcgtctctaccgacgatggcagacaacttctcctcgacatacatgaaggcatatgcgggtcacacgccgccggtcggacattggtcagcaaagcctttcaacaagggtttttctggccaaccgcccttaaagatgcatacgacatggtccagcgatgtgaagcctgtcaattccacagcaagcacacaaagctacctgcacaagcgctccagacaatccctctgacttggttgttctcatgctgggggctagacatacttgggccattcccacgaggacacggcggctacagatttctatttgtagcgattgacaagttcaccaagtggatcgaagcagtacccaccggggagatcaaggccgataacgccatcaagttcatcagagggatattttgcagatacggactaccgcaccgcacataaccgacaatgtctctcaattcatcagcgccgatttccaggactactgcatcagcttgggagtcaaaatatgcttcgcctcggtctctcatcctcaaagcaatggacaagtcgaaagggcgaacggcatagtactacaaaggataaaaacccgcgtctacgacagactcatgtcacacgacaaaaaatgggttgaagaactcccatcagtactatgggccgtacgcactacaccgacaacgtccaataaggaaacacccttcttcctcgtgtacggttctgaagccatgctccctggcgagttacggcatcaaagcacacgagtacagaagcattccgacgagagccaggagaatcagcgagagatcgatgtaaaccttctcgagaagcatcgtgagcgagttgccatccaagcagctagctatcaacaggccctccgccgttatcatgagaaacgaatccgagtatgcatactttcgatcggcgactacgtcctcagacaagttcaaacccaagcggggcgaaacaaactctcaccaaaatgggaaggaccgtacgcgatcacacaagtcttgcggccaggcgcattcaaaatggccgacggcgacggtcgcgaactagcaaattcgtggaacattgaccaactacgtaaattctatgtatgagtcaataccgctatacctgtaagcacccttgcagtatcaataaagcctacttcttggtctcatatcacgaccaaagtgctttcacccaatgaccccttaccctaacgacgcctaacgttgaaacccgacaaggcctccgaggaacctaagggatcttcggctggggacgcccagagccgataaggtcttgtcagatccttcagagatgaaagaccatgtaagatctggtcgtgtaagagttctcgccgtgcgtattaaccaagccgtgtaatcggaaaccgagctttccaacttcacggctggggtctaggatcagagcttattcaaccaaaacaggccaagggtccaggagccttgtcacccgaggaaatccctccgacgacaaggctgggggctagggagagtgtacgacccaaacggctaactaaagtcgttaactgagaacacactcttacacacaacacccagagtaagaaaacatttcttaaagataaatttctttattcacaaaatattccttacagtttatacataaatattttgctgcattatatcttcccctaagatatttggtcgcaggatacaagcattaccaagacggccaacgccagtccattgattggaaaactttctcggccaacggcgacatcgacctcgcaaggtggtctatctccgccgggttcctccgagaacgtggaaaaacttcacgtaaaaattcgagatccagccgcgggcggtgatctcgcaggcaagccagcacgtgtcctccggcatatcggctcgctcgacgacactcttgcttcaaggcctcatcgattcgcttgccaatgccatcgagttgggcacaggccccgttgagccacgagatgtacccggccgccaattcctcaggatcaccgcagattacccgaagctcccggcacaccctggccatcgaagtgcagcaactcttcaagtaagacgagaaccacacctcgcggcctcggagcgtttccacagcttgctctttctttacggctagcattgccctcttgagttccgtcacttcaaatttcgtcttccagtataggatacgacgatcttgggtcgcaagggcatcctcgagatctactaaacgtaacgaccgctaagacaacccggaaacccccaaaaacagcatcaaggttgataggctactcacttgaggcagttgtcgtcatctcgacttccacatcaagagttgggtcctcggcgtcatgtgagacgtgcggttcaaactcgagtaccagaattatcgccagtgactcgggttgcccgcgctactggacatcctcgttattagcatctctacaatttacaaaaaaaacttccgagatcaacattgaacaaggatggtaatcacatgcacgaaggcaaccagagttcaagatttacaaatgacaaaaatacaagaggccctactcttcaaaaagggggaggacagactccccccggtcactaacttcttccatcacctccctacgcgtgtcgcttgccgccccctgatccaagatctcacgcagatcgagttcagggcgcgacaaccttacacacgcaaggacgtgacacgccccggtgaagataccgttggacgtctcctccgcgatcctggccgtatgcttggaggggatttcccccatcgccgtcgccagctccacaagagaagaagtcaacgagaactcatcggggttcaccggggtcgtggactcgacgccgcactccctggcgagctggtggaggccggtgtaggtcacccgcagcgaaccacgaatctcggagagattgtctcccagttccgatatgcggtcctcgagccctttgcgttggcgctcgttcccggccaccagctccctcattttcgtgaggtcctcgtgggcctcagccagttcccgcaccaaccgctcggcgcgcgcgtttgccgccgtcgtctccgccctcacctctgagatctcgcggccaatgccgcgagcaccagcttcgagaaggtgccccattttgacttggagctcctcccaggtgagggcggcctctggcagactacgacccccagcaggatcactgacggggccggtcggcgtcgcctcccgactcccgaccacgggaacgacatctgttgatgccgtggcaggggatgcgctggatgttcccccggccttggcccgagcagctttcgcccgcgcctccctgtaaaccgccacgaatcaaaactccactcgagcagaagacgcgagaatctaaaagtttcttcacttacttctcgccgatcgtcacaatgcgctgacgtcgtgcaggcggcggagacgtgtcggaagcctgcgagacaaccgacacagagtgagaacaaaccttcctcgtcatataaccggatgataaggtgaaaattaccgagggagtctccgtcttgcggcggtgtccgagcacagacgagaatttcctcgccttactcggagcttggccaccactagtagtggcagcgtcggacgcctccttgacgaccttctctttcagagatgccgccacctgatgattcgcgagtggaccgacgacatcagtcaaaggaagggcctacgctaaatcatgtcataagctgattttgagcaaaagaaggcagacgcttatcgaattaactcacattgattgcttcgtcgcgctccgccgctcccttttcacaaaggggcgcggggatgtcgctcaccgtggtcgggccgctgatcatcacctgaccaacacgccgctccacggtttccctgctcagacctgtcaagaagaaattagtttttgataggtcagaggggaacgcgagtacaagcatatcgaagtaaatgcgagaaagataccccgaggagaaacccgggtcgcgtcatctggcccggaatagttataggccgggtgggcccgagcctggagcggctggattcgcctaccgacgaagtctgcaacgacttcatatcccgataaaccccgttctcgaagattatcgatgatgtcgataaacgattggagagagggggtcaaggggggcttggcggtctagactggaatcttgtccggttgttcctcgggaacagcgaggaccggatttgaatccttgatctcaaggtaaaaccacatgttccgccatttgctgcgaaaagagggacactggaaggggacataacgcaacttcatgccatcacgaagtcggaacccgacgcaactagatatcctattggattccatccagcgcaactcgtaataaaagcggaacagatcaagaaagggttctaccccaatgtaggcctcgcagagatgcacacagacgctaaggaaagtaatggaattagagtccaagtgcagaagagaaagcccacagaaattcaagaccagtagaaggaattcagagggtggagggagaaatccgcagacaacataatcttcgatcgcaaccatgcgacctaagacgggctgaggatcagtacctcctgcttccctctccgtagttccacggctaggaagggcgccatcctcctggagcttcttcagggtcgcgctggtggaagccgacttgccgagatccatcacagctgcaagatcaccggagatgaacctaaagctgacgaagctagggttctgtacggcgacggagaaggcgaggaatgctaacgggcggtgtgtgtttgacggagtcagcggactccaaaatgcgcacccaaaatccctttaaatagacgcacccccgacggtgcaaattccaagggactgagagaaatcctcgccggaaatttctaggtccgttatgcgcggcagtttttgacttcagttcaaaattcactcgtgactgttgggcttcaaacgacatgttcgattacaagtcatctccgaggtcctcacacctggaatgatagcgttctcgacacccgaagtcgcgaatggtcacacgagttcattttgagcagaagtcgggggctactgtcagggttacgggtctggcataccctctacccttcgatatacattacgtatcgacgtggcatgcccacgcgtacgcggacatttccttcataatctaaggaaacttttcacgaaatcaacagacaggaagagtccttctcggacgaggactgggttacctacgtatcatgctaggtctggtgtgttcgagtcctactcggagagcatcagacctatggtataaaagggaccccccggggagggcattggggatcgaatctcagagccaacacaacccacacagtctacgaagtcggagcctgcgaggagccaagtcgtcgagagctagtcgaatcaactcgactacaatctcgccggatctgacaagttccatcttttcctttgtaacctgtgttttccgctatataatcccatatcaactggattagggctattacctgtcaaggggcctgaaccagtataattcctgtcttttgattgcttgatgtcgtactacgtagatccttgtaccagcgtacccctg

SEQ ID NO: 39649 - DNA, 2746 bp, Oryza sativa
ggtgtccgtgccgcctgcgatgctgggttcccgggtccaatgcggcctaaatctaccggcggtcagcatcctgttcgcgttggtcaccacatatatatacctctcctcttcgtcgtagcagcccaccgcaggttcaccgaccccgcctcatcgctctcccctcatctagttagtctctgttcatctcccatctgcctcgtttgcaagttcaagacctatctactacctccgtcccaaaataagtgcagtcatggatatccgtgcccaacgttcgatcgtccgtcttatttgaaaattttgtgaaaaatttaaaaatatttagtcacacacataaagtactattcatgctttatcatctaataacaataaaaatactaatcataaaaaattttcaaataagacgaacgatcaaacgttgaacgtgaatagtgcaaaactgcacttattttgggacggagggagtagttattaagccgccgagccatcagccattgtggtccaccacccggtaattttgagcatctgggaatgggagtctaggggcataggggaatatgtctgctcatgcgattaattttctgaaaataccgtacattaatgcaataggcatcatatcttacaccaatatggtttgtgaattgggcgaggagtaacgtttatatttttttcagccatcatgttatgattcattgaacgaacttatagctagtattacacagatttaggggaaccacaaaggttgtaccgctgaaggacattaagctaacggccagtagagttcttagctcttcttctggggctatctgcactctcaagcatgaattgctaacctcgattcttggccatgaacgtagtttgactttttgcatctgaaaatcaatgatacatgatttggtagtatttatacctctcatccatagctgcatgtacataactgagtactgtctattgttattgacttgagtatatgatttttctatctgtttttccttccttttagggctcgaaaatacaaactctggttgacgaggcagtaaggatatccagcgttctttaacactgcactcaacattgcattgttgcagtagcatttaaaggtccgttccagaattcagagagcaaggttttgtcagaggtttgaatccatgcttaatagctgccgaccaagtcttctcaatggtcatcatatcatctccacattcatgcatttcccaaccttctaaagcatgcaatattccagcaatgcgccatgcactcatcacccttcttggcagccaattctgttcatacagccagtagtatactcatgtcaatgttggtaaatttaggcatggagaaatagttggtatataacatatgggcccattttgtttagctcaaaatacctcacaggtgtggacattctgcattgtctctgggatcttcattgctgggttactcaagtaagtgcagtccttgcgtgccttcttaagggggaactgtgacgtgggaataaatatagttccctttggtgccctcccttgtgcatcgtctatgctatctcctatccaaatctgttgcaatgggagtataatcatgaatataataagcttgcatgagtttttttttcttggttatctcttttatgaacctctgtccacaaggtatcctagctgttttttttttgagatattaaggatgaaaggaagagatgcatgtaccccctcattaatgatgacggatgttaggggagtgggagggtggtttgggggtaaaattgggtgaaaattaaatgactggtagttgggtgggagaagtagtactctaaggaccccttaggtcaatcctaacccaagacactagacatagtttccataaactccgcctcatcaagaactagtactagacactactatttcaatacaaacaccaatattccatacttaaatttaatgctacttatctcacatgatgtcttgggtgttgtgtagaaactatgtttcatgcaagacataattttcttctctttcctcatttattcacttgacacatcatttttcatcataggtgctagcttatttaatgctatggacatcatcctagtcattgggttgggaatggtcttaaagttgtggacaaattttgaaggagcattaaagtattactaatatacatcacccactaatttactcgtcatttgatgcaatcccaatagtggttatataatatagtgtcacacatatgggaactcgtgtgatagcatgatgcatgaataacttgtttgaattcttttaacaaggtttatagttgagatttttactagcctaccaagctccagtagtgtctatggtaccacagtactatttattcaccaatttatgcttcttgaggaaaactccctccttattttacctgtggtgtttcatcattagagaatttcagatagatagctctactctctggaactcgagacttgagcattccatattctttctcttgattcaggattacctgcacaaaaatatgtggaatagtctggattatagcaagatttataacccaagttttaatacattaagataatttaatataaaaaataatctactaaatgattataaaaatgtatcgaacataacaaagtgggaggctgctagatttacctggacacctctctgacataaagctatggctgttgcacgggtcaccttagaattacttccacagagaaaaacttgctttgtaccaaaaggtatgctattgagcacca

SEQ ID NO: 39650 - DNA, 7527 bp, Oryza sativa
  unsure (1)..(7527): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcttaatgatgatcattggccgtttttaccggctgcttttggcgatgcgcctctcttttttttccacctccttttgattcagtggtctcgaacccagctttggaccgggcggccgggtggtgactggtgagtgcaccgggcggaaatgcgcgtgcaatgttgctgtcactgatggagctagcgaaagggatggtccacgacgcagtcctcggcgtggtggtggtgatgaattggcttcacacataacgctctcatcacgcagaaaagaccaatcttgtgttagatttaattgggtaattaatccatttaaatcaattaaatcaaataaattccaaggctcattatgctaggaattcatgtgaattcattcttctatgggatatcaatgggatgaagagttttgagaattaatccatttgattcaggaattgataacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatttcgaacactggagacaaggagaaggagactcccgtcaacaccaacggaggcaatactgcctcaaactccagcggaggaacattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacatcttggtgacctgtgggcgttaaatttccagattctttgaattttgataacactgtttggggtgtctaatctttaaatcaaatcattttctaaaaaagctaaatcaaatacccagtgtggtgccaggctagctttgaagctgaatatatacagaaacacgtatatctatatgcatgctctaatcttctttcttttcccctttatgacacaagtctgaaattgattcctgccgagcattgcatgatccgtcattggtttgtagcttggcccagcaaagatgaaacaccgccgctgcccgcacgagccggtgatggatgatcagcggatgcaggccggttcatcggagatgggtcgttctgtcgaaaatgtcgggaataagttcactccgactccgggttcaatctaatccatatcttgacccctaaactataaaaaccagtgtaaaatgactctcttggtggtcttaagcgtggtttttgatgaggtggctcaataatgtaacctaatcggctgagtcagtatgtaggacccatatgtcagcatgaagattttcttttttctttccttgtcctctcgtcgttgaacaggctctccttcccgtccagtctcctcgtgtatgacagcccgagccgcgaccgcacgctgcaaaggtcgctagtgctggagtcgagccccatgaactcccccatcacggcggtgagcggtggcccgatgagcggtctgtcgagggatattgtggttgagggatattgtcgctattgtggttgagggatatgatcagattggcatatttaagggagtgaaagtaaacttattctaaaatgtcggcctagacaggagtccgagacagccggcccggcctaccaaataacacgtaagacggcagaattgggccgttggattagggggcctataggccttgcatgcagccctgcacgaagtctttcaccgcgaggcggtagaactaagaaaacggaatacacgcttccttccagtaaataaaataaaacaaaatgaaggaaaataaagaaaaaacataatagaacgtgataaccgttgaggtgtggtgtagtatatgcgctgacgtcacccccaacgtcataccgtccgcttgctcgcaaaaaaaaaatggaagtaattttcagagagagaaaaatgtagtgctacgtattaccactagtcagtcagagttgctgcagtgtaggttagcacaaaatattgcggcgtggtgagctgattaactctgataatccaatcctcttagatccagaaagcgagttcatcacgcattcacgcgacagccgacggcgccagttcgcgaaaagaaaatttttaggtgtcatgtcggatgtttactagatgttgaaaggggttttcgaacactaatgaaaatactaattttataactcacctggaaatcgcgagacgaatcttttgagactaattaatccatcattagcatatgtgggttactgtaacacttatgactaatcattgactaattaggctcaaaagattcgtctcgcgatttctcccttaactgtgtaattagtttttcttttaatctatatttaatgattcatgcatatgttaaagattcggtgtgatatttttgagggaaaaaattgggcaactattcaaacttctaacttttttcatcacatcaaaactttcctacatacagattaggaaagttttgatgtgatagaaaaattgaaagtttgaagaaaaagttgtgaactaaaccaagcatgagtatgaacatttaaaccctgtggaggaaaaaaagaccgcaccttctgcaagtctcaaccactagtatcaggattcaagatcccctatttttgaccaggaaatatcaaagccataaatgaatgggtgatacgttcattcacgctctaatcttgagcctctatctccccccaaaaaaaggtcagctctgactttaagatgcaggaagattaaatgcaatggctccgaccgtacgacggtagcagtagcagcagcagcaggacatcgacatctggtcgacacggaggaaactctggttatgcaagtgagacacgcaggaatcaatgaggatctctatcagataaatcaccctcgttgacacattggacagctagatctgcacggaaatggaaattaacacctgtaatgtccgagaaaaagagtgaattaacatcagaagaaagaacatagtcttgagtgacattgagtgctgggtgctgttgatgttcttccattcgatcaattctgtgattgatcctgtttacttgtacaatacgatgacaaaaatcactttctagaatacaatcgagcattgactagtactttgtaagaacttgtctcctgggaaaataaatcattgatcgagaggggaactttgctaagcatctttcagcatgtcatcagtttttgacagcacaacgtcagaccagctaggatacttgtgcgtacttgtgtagagaaacgctgactttgcatcttatggagtatatactactgatttctgtcccttttaactgaatcttaattagtatttcaacagctcggctcgaaatggaagccattgttcttccaaaaagaaatggaagtcattagttgtccagaaggccgagagcgacatttgattattaattagctcaaccatgattttttttacaaggaatctaatacaattatttggccaaatgaactgtatctgaatcaacagacgtaaacatttgagtatttggcagaagagaggttagctaccatttcctctactcctctttggtgcattgactatgtgacattccctgtgataccttaggtaggtatctgtatccctggttatctcataaactatactatgttccgaagaatctccaccaatcatgcattcagtgcctaatcgatcaattaccttcattctaatgaaacattcaacttcccgcacggtgtcgagcttccaacttggagatttagacagtcttggataattataaatggggagctagcgagcaacagcaaccagacaactcataaatcattttgttacattgcctaaaaataaccctctagtctatcttagaataaacaagaaagcgacaacgcattcaggaatcaagaacatgcgtacaacagaaacccctttgaagtagatgcaatgcaatccgtcatcaaagtgcaccttatcaatttataacgactaagctgcctttaaagcttgtaacatttatcttcagtctgtatagataagatttcagagccaaagcaccacagatatatcttcaggacactctcagaattcagaaagaaacaccatgagtgaggtataaaaacaggtcattctagattaatccatgcctacatgcaacgtgatccatgccactagatcattaaccaaactagattccaagcaaatgcatagctgtttctttccggcgggaatcacccagatcagcatgatccaaaagagattcaggtcaatgcgaagctgttagcccatgggattctgaatttcgtattgccgccaaattaacatgtcaaatgtcactgaaactcataaactaggggggcacacaacggtatgaaaacatgcttggctgcttgcaggaatgtatcacattacaggcatagaatagtagaaaatactttcccttgtagaaatattctccttgttttcttttcctgctcacatggcacactaatctaatcttgtcaggatgaacagctagaacagaaactgatagaagataactctggcgaatgggagtggaggacaacatcaagcggaactcagatatcgctttaatctatccaagaagcaggtagatcagatgctatcgcgttacgtctcacccgatttcttaaaacagaaacccgatttaactaaaccaaagtcagaatatccacgcgtagatgcaacaatcatgtagtgattcttcacataagcataagcaacacgaagagaaatagcagattaatcagcgaacatgcaaagcggaatttggcaacgggagatgcggcaagtggggaagtttcttactctgaatatgtttacctgcagagttcattttttttctctctcaccccaacaagtgcatattagtccatccttgctgatggcgatttaataaggaatccgataggtgacagggagataaacaaatcggacgctgaccttgctgtggcgaactgggtgatcatcgatggcgatgcgagacatcacccaactgcgtcgggtctccacaggagggagttgcttgtgcttggtccgtttggggatcgttaacttaaacacttttacggcgacctcgacacagctaaaccctaaactaattgcgagttagaggcttatctcgatctcttctatgcagatgtttgacaacttgggagtagtttactgctggtttggagtatcttctcaacttgcaatttgattatgtttaaacggggagtgcatgattggtgttcgcatggttttaaatcagattttataaactgatgctcgtcaagagacgacaaggggccagattagggcagcagagtacgtgcttgcttgaattctgaagcatgtacgaaataaatacgatagaaatttcttaagaaattatgtatttttctgaacctccaataagatcgcgtggttgccagtattgcacgtcgactactacatatctgaattcagaacaatccagaagagatgttactgttgatatttctacgtataaaaaaaacatcaaaatgctttgtatattacgaaaacagagcgagttcccttattgaccagagcaaaaaggttgagcctgattaaacaaagtctatgagcttgcaggatgcgtctcttcccaaatttattcacaccaaagtcctcttcgatgacatcgccctatttgaatcttatcgttgacattgctcattttgctctttagttaatctgggcaaatgattggcggtggtacttcgtgatgtggaacagtgaaactgtttgtcaatctgtgcgctcgaggtacaaccaggtcggttcctttgctgttttattaataaaaggagcataaattagcgccaaaactcaagttttaccacaaaaaaacagtcagttttaataaagattaagcaaacccttgaattgcactctgtaaaatgtttgtttcccctcaaaagctgataaggacggacgccgatgtgaaacgaaacctgctatttcaaccatgtacatatataatcaagaatttcctacacgacttccattttttgtgtgttgactagtttctctccttcctggaggtgttaaaagagttccgattctgtcaaaacttccatacagataaatccaacctgtcaaactaccagctgtttaattattccttttcccattttgttatggtacacaaaggcacataaccatttacacggagcagaacagaataggatatgtattaaaaaaacagaatggagaaaaatcctgagtcacaagcacgaaaaatgaaggcgagattaattcgaaaccatacacatcatcatccacatctcgtcgtttgtctcacaggacatgacacagggagcgaaaaccacatcattaatcgcggcctacagctacacatccagattctcccgggatccccgaaacggctcccaccccgcaaccgccgcaagccgacccagccaaaggagatccccctccaccacggaagattcactgcgcggtgggccccgccgccaaaaaccaaaacgacgaaaccattccgcgtcatctctcccgcacggcgagcgagcgagcgagcgacctgacctcctcctcctataaatccggcgccagcgtttctccccaacctcccacgcccaatcctgccgccgtttcagcagctctagtttgaacgagggatcgtagagaggagggtttggtgagggagggaggaagatggcgacgtgcgcggcggacctggcgccgctgctggggc

SEQ ID NO: 39651 - DNA, 6958 bp, Oryza sativa
ggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgtggtcgacgtctgcaacggcctcctcggcgggttcgccgccatcaccgccgggtgcagcgtcgtcgacccgtgggccgcgatcatctgcgggttcgtctcggcgtgggtgctcatcggcctcaacgcgctcgccgcgcgcctcaagttcgacgacccgctcgaggccgcccagctccacggcgggtgcggcgcgtgggggatcctcttcaccgcgctcttcgcgaggcagaagtacgtcgaggagatctacggcgccggccggccgtacggcctgttcatgggcggcggcggcaagctgctcgccgcgcacgtcatccagatcctggtcatcttcgggtgggtcagctgcaccatgggacctctcttctacgggctcaagaagctcggcctgctccgcatctccgccgaggacgagacgtccggcatggacctgacacggcacggcgggttcgcgtacgtctaccacgacgaggacgagcacgacaagtctggggttggtgggttcatgctccggtccgcgcagacccgcgtcgagccggcggcggcggctgcctccaacagcaacaaccaagtgtaaccaatccagaacgaacgacgtcacagcgaaggaagaaatcacgggtttctctccctctccgatctcgatcgtcacgtcataaatttgatccccatatttgattgccagtttctgtttgggccaaatgcttttgccgctctctctggtgttgcaagactgtaaaaacactgtaggatggacgagtgtctttcacttttgctgggcttctcttgtgtacaggcatgcgtacgtgtcttagaatgtgtggtgtgaaggtgggaagaatcagaggttagggtttaattttcttttgcacaatggttactgctattattgttttattttgtggtcgaattttatcgtcataagggtgtggtggaatggtggtcaagataggtggctgtgcagggctcaaagactttgcgtgggtccttttgtcctgcagtgctctacctctctatcaaaactttggcttatttcctggaatctagtggtttgagagtgtttgttttatactcagttctgcattatgtttacgatatatatttttttttaccaaaagcatttcatttaaactctaccgagagtacttgtttatgctgaatcagtacatctacactgagtgatatttagagccttatactaattgaagattaaatagtcaaagtccatgtgcacatttctactcgccagttagtctgaaagaaaagattcctgtgtgcaattgtgcatatcagcatatgccacctggcgataaagtaaacatactatagttgtgaactgtgcgatgacaacgaccaaattaagcagcctgatctttacaacgaccgctgtatagagaacagactatatcaagttttggtccgctgttcttcttttgggattgtgaagcatgaaaatactacagttttgcatttctttttcccgtaaatgtggaatgcatctcgatatgatatggctattttagcaattgatctgtctcctttttttttcccaaaatacaattgatctctcatctgtcgcacacagccacgatatggtatagagttaattttggcatttttggcaatatagcacattactattatccccttaaatattgtgatatctgtttttcaatatatctgctcgttgcactgattagtccgcaaaatgaggtctgcaaattgctcggtacagcttttgactatatatattaggataaacggatgctttctcgtcttgtagttctgaattgcaatatgttttcctctttttttaatcgacgacaatatattatccattcaatcatggtctgtagtaccttcctgcagtacactccctacctgtaaatttcaaacatgtatgcaccacagtacatactcctacatctctctttcaccaatgctgccaaataagacgctaggagattgaaagagattggatagcacaacatgcgcttgcctcacctctctcaccagtcaccactcacgacaatacaggttgatacgcacggctagcactgatccgcaaacaccccgcataattaattagcaaagtagccaatatcatcaggtgagtacgttactaatctgactgcttgaatctgtgacaaagaagaaacgactggttgggggggagagaacatagatcgagacctatagctatcatatcccaccgtaagattcccacactgcgcggctgccgatcaaaaggctgtggaaaaaactaggaataattgaactttcgcagcactgaacgtcaaaaaaactttcgcagcagaagatataaaatgagtgtaccgtatcgttttcacgacagaaagccgatactagtcctctatattttactcctgttatgtatgcccacgatcgaagttccggttaatctctccaagctaatcagtatacggtcttatcaattgcaaattgagatttttttttacgtgaagaaaactaccttagatactccctttacctaagcgcgcacgggtacggaaaaggacacgcgcgcacttccctcgtagaaggagcaggaggatgagcgcggccgcaaagctgggcgcgcaccctttgtgatgtcaccgcctcacgagacgggcccgaggaaatcggaactcgaaaggcacgccacactcgagcgcaccggcgcgccaccgctcgcatcgcgcggacggggggaagcccggaggcggacccgcgcgcgcactcagctcggcggtgaccgagccgcgcccccgctcgcgtctcagtcctcgcctttttttttttcctttcctgacgtctcagaatcaggagacccgagcgggcgcgcgcgcgccgcaccacacgtccacacggctcggatcagcagctagcagcagcagcagcgcgcgctcccctgcgaaacgggggtagtctcgcggtctcggtggatcacgaggatcccgtcgtcaaaccgtcgtctgccgcccgatcgactgcccgcagccaaaggcaacgacacggccgacggcacgcgacgtgagcaaagtacatatactagagtatactagtcggggtgctgcgtgagcgtgatgcgcacatcgatgtgattggtgtgcagccgcgcggagtcgatcgcatacttgcatgcatgcatgtacacgatcattgtttagcgagaagataatgccgcgtatgattttcggagagataataatgtctcgtgatacaggcgtacagcgctctgaggttgtccctacctctcgtcgcgtcagctagcgggggagcaggatcctcccatccatgtaggtacagttgggctgggaagttgtttaatccatcaccaagatctgcccgtacaaaaaacgtttgaaactcgggttaagataatggatgatcgagcatcgaaaagttcccctttttgagcgggcgggagcgacagcttttacgccccgaaagattagtacacgtaatttaatggctacggtggtttctccgttttttaacaaattggtccttttcaaaaacttatttcaaaactaatccttacaaaaaaaaactttaaccaaaaatagaactcagagccatggaccttagcgctaagctcgaatccgaggtggtaggaatttgctaagttgtttggtactgaggttctaatgatttaaattactgcggaggcatttagtttaacaacccaccgatagtatagtggtagtgggcttctactctaaccttatggagcagggttcgatccctcatctctcccattttttttcttttcttctttttcttctctctctctctctctttattttttctttttttttcttcttccgatcccccatctctcccttttttttttctttttcttcttttttcttctctctctcgctctttattttttttctttttttcttttttgtttgtctcgtgatactatcttcaaaagatatgtttaagttgcaatttttttgaattaggaaaaaatattaaagtggtatattatatggcaattgagaacttaaactgaaatttcaaatcaaattcaaaataaaacaaatttacaaacgaaactgtcattttgtaaagaataagagtgagtagtcgagagaaaaaaaacttattttgtaaaacatattaattttaaaagaatgctatggggaagagaaaaggaaaaaacccaaaatacaaaaaaatattaagtattaattttaaaagaatgctatgaggaagagaatgctatgagaaagataaaaggaaaaaacccaaaataattttaaaagaatgctatgaggaagagaaaaggaaaaaacccaaaatacaaaaaagtattaatttaaaagaatgctatgaggaagagaaaaggaaaaaacccaaaataaaaaaaatagaaaaggaaaaacatattaattttgaaagaatgctatgagaaagagaaaaggaaaaaacccaaaatacaacaaagagaaaaggaaaaaacatattaatttaaaagaatgctatgagaaagagaaaaggaaaaaaaacccaaaatacaacaaagagaaaaggaaaaaaccccccaaaaaatattaattttaaaagaatgctatgagaaagagaaaaggaaaaaacccaaaaaaaaaggtgaggtgggataccaggattcgaacctgaaacccaatgcctaaaagcttgagacatcaaccactaggctatcactattttgctacacttagatgcttgcgcctctatttgaatcgtcaggacctcagcgccaagtagcaaattcatgccacctaagattagatgttagtgccaacaatattgacgttgagacgttgtagctcaacgacagggtctatggcgctgagtccacggcctatttttggttaaagtttttttgcagggactagttttgaaataagtttttgaaaaggaccaatttattaaaaatacgggtggtttctttcccgcatccaaccaggatatagaatttgtacgctactcgctgtaggtactacgtactctctcgttctgtgtcacgaaaaggttcagtctaaacaactccaacatcgtgactagaataatagactgaaatcagcggaagaacaggggttggtgaaaccgcgaaacactgatcggtgaacagtggctggaatctgatgttggacactcaaccgatgccctcatggtcaaattctggagtgggacgcacatgccgacgagaccaccggctggaattggaatctgggcgatacgcttgcattgcagcaagggcgcagcatttgttatttcttttttttgcagcttgtacggttgcatcctcacacctgatgtgaccaacgtgtttctgtcccggcatgcttccatcgacggttggtgttgggatcgttgtgtgcccgaagacgcggaggggcaccggttaaactgaaccgacctctctcggtcgtgtacaagtacaacaagtcgcaatgctgctacgtacagtgccacgaacacgaggcaagtgtatggtggcgaagcggccaggtcgagggaaattgcgtaggcgagctgggctgccgccaaaggggaaaacggcaaaagcagtcctgtcttcttgcttgtgagagggtgagggtagctgcatgtgagaagatgatcgcttattcaatactcccccgtttcataatgtaagtcattctattattttccacatttatattgatgttaataaatatagacatatatatctatttagatttattaatattaatataaatgtgagaaatactagaatgacttaaattgtgaaacggagaaaatactagctagggaaaagaaagagactgcatttacaagacttgtgtgagcacgaaacggtgaccattgtcaaaggcgacaacggcctgcctgacttcttatcgttttgttgaaaagaaaaaggaaggggacgtatacggcttgaaagtagagattgcatagtcccaagcatagtgaagtacaggaattggccaggctcgagtacgtgcaagctataacactctctttcttatcgccctttcctgctgtagtattacgctcttatctagttcccaactttttctttaaacttttaacttttttattacatcaaaactttcctacacacataaactttcaacttttttcttcaaactttcaattttagtcaaactttcaattttggcgtggatctaaacacacctacgtataccaaactattctactcctataataactactattcactgcatagtactaaggaatcaagaatttgttcatgataatttcagggtttagggtttagggtaatactcccttcatttcaaaatacaagaatcatccacctttaatccaaatatcaaaaaaataattattatcatcttatagtttggatcatcttaataaatacaatttatgcatccaatataattaaaaatcttaagtatggaagattttaaacataatattttagcgggaaaaaagtgttacttaatagcatgcattcatgcatgccttatattgtaaaacatctaaaaaaagttatgttttatattatagaattgatagagtagcttctttgtactataaaggcaatagcaatgcggcgcatgtatttgtcgaacctcacatgccacatgggctaaggaacggtgatagacacgaggttcacaatgctgtaacctcaagtggggtctaaacaataaagtttttccttttcttttctccacctttcccctctctctccc

SEQ ID NO: 39652 - DNA, 5840 bp, Oryza sativa
gatagtgtgatcgcctatctgatttactagtatataaattagtagaaccaggttttcgattggaaaggtgctgtcaaaagtcaataaccacctaatctaatgcaacctggatattactccatgcttatataatgctcggctgattgattcctgcaattgctagtagctagatcagtagtatcttggtgagttggtatagttttttttttttcaacgctctcaagtctgaagatcccaggcactttctttattgcaattttccatttttaaaaactcgggtgtcgtttttgctcaacagttgacacggatatatcgattgggagatatttgtcagaatttcaagctgctgaaagcaatgacatgctttcgttgtgcgttttgaagcagtcttagcttccttgctacaagcacttctgacatgaaaaggattggtacctggtacatgcaactgcgagtgaacattgagcacaactagtactagccactagccagcgctcccctgacctttatccccaaggcccaaactacttgtcaagtcgccaacccgccgaagtacaatctaacaacagtggtagagcatggcataaatgactgagataagatgcagtccaatctacatggataggataagattgctgaaaatctctctaaaattccaattccctgttcttccgaacccctacgtacagacattctgcgccgcgccattgacaacttgatcaaatcacaaggaaagtgtgatggtccaacataaacggatcaattgcatgcagcatgctggaggcaccagctttggttcaatggaccgcattagatattcccagaagcatcacccatatattatctgttcaggttattagctgcagatgggaattgttatacagtagtgaactgaaaacagatgccccggaataatatggaacgatatgatttcttattctgtactgtccaattgtagccaaaagtaatggacaagggtcaaagatgtttggagcatgagcaaaaggtcatgcgggcatgcatgagcaaccaagataaggtcccaaggaacctcttacaggtttgaacaggaaggacttggtgagaaacttttggcagttttgggtccattttgaactacactactgggcaacaaacacaacatgggccactacgggataagccgaggcgagctgcctgcagttgccaacactacaggaatctgcacggcccattggtgaaaaggcctgtgtggagtggactctggcccgttagctgtggccgcaggctaacagccgactagttgaaacttgaaagtttgacgctgtacatgcttaactctgagtctctgagtattcaacaaatatactatcggcctatcggggtgaagaaactcacaagtcacacccagcatgtccgcatgttgcatgtatttactcgctagaaaataacagcagatgatagatcgatcaccaagtcttgcacagatagcgcacttacaatttttcctacagaaaaatagcagccaagtgcggcatagtacataggagcaccaagctagcaaaacaaaatcaggatgtacgtggcattacagcggcatcaggcgttgattgctggcgaaacaaatggagaacatccatgtccgaagatcagagctgagagagaccactgtggaatcgcatccatgaacagaaccacaccggatcagctaacgcgttgaagagactttcgtcgtcagggatgctcgccgtcgtcctcgaggagctcttcgactgactcgatgatgaggccgaagcaagcggcaaagccggcctcctctagcacgtcataatcatcatcatcatcgcaggccacctcttcgacgtcaatgacggctttgctgccgagccgggccgccgcctcatcctggaggaccttgactctggcgcagaagctggcaatgtcgtcggcaacgacgacgtcctcctccgtctcgacgcggaagccgtgctcatcgcagatcaggaacccggcctcctccgtcgacgcgaaggggaagacggggtcgtacgcgaatccctccggagtcatggaccagaacctggctggctcgtacagggatcccgggtacagcggcgtccacacggctggttcgagcaggccgagcgcctccaccgtcgacgacgtcgccatctccgccgtcgtcctcttcccggctctcaattcgttcgtctcgtgcgcgatagagagagtgtgtgcgtcacgatccgggcacgaggcgcagggctttgctttgacaggttgacgtacgtgctgcgggagcatggcttatatggagccatgttacgacttggagtcggagacggattgcggctgcacgagcggaggctgggggcgtcacgcctgtacgtacgggcaaaaccaaaacggagtcgagtggaagacgagatgggggaggtagaaaatgccaccgcctcgaccacaaaccatagcagatgatcaccgggttagaaaatcgacttggaataattgtggtattttgttatgttttgattggtagcaaaagagagataatatgactatccctgctaccatgtgatatacggaaaaataaaaaataataatggtgtaaaaacttgtctagttgttgtaaaccctggttgaatggaacatccacactagcaaactgattatacgtggcggtgaccataattcatgcatgtgggtcaatctgaactgaatggagaataatccataatgcaaccatcgttctcaaacagatccatacacagaaatttatgatgctagagtaacaaaaagaacaagatgaaaggaaggacgaagctgcttgagcagattaatgattgctggagacatacttcgctgtgccgccaccctcgaggtccagtcgatgttgctgccatagccttcaagatattcacaactatttgatcgtcgaatttgaacttcatttttcgtggacagatagatatatatcacaatactcaacattttcaaattttttcttcataattttcacagctatttgtgtattgaatttggaagaaaaaagatacacgaggggacattccctcaaggtattagaatccactcccccaaatcatatggtttgcaagatgttgcatttagcacccaacacaagtttatacaccgtaggttcaatttgcccaaaacaatatatctgtagctatattaatggattggctgattcgagaataattgcaggttaataagagaagcaatatctagcatcataaatgttgtcttggatcataaaaaagaacagaaatttatgatgctagagtaacaaaaagaacaagatgcataggcggtgaaagtgcatataatgttttctcatcaatgtgcccctaatgttgtcttggatgcatggttaatggcaaacgtttaaattgtcttggatgttttcattgacatactgaaatactactgaatatagaaaatagttcacattggtgtcaaagcaacgttggagattccggtttcataaaagagatcgaattgaatggatactcgtctggtaaaaatttttttatgagtattggaatatcgtactatcaaaatgttgtttattcgggatttaggctcccgtggagactatgcaaacactgagtcacaaagcttcaatattatcaactccacatccacatttccaccgtgacacaccaaggtgtttacccatcatttttggattttgaaataatatattgaagtgcgacttgtagtttgtaatttcgaacatggaaaatgttctaaactccaaactaaatacataatttgctgcgcggatctatatacagcaaataaataatttaagcaaatgcctacaaatagcatgtgaaaatggtacaagaattgtcaagatcaaatctatcagctcaacttcttgatgatgtgacatgcatgtgcttctttatggcagtgattacagagcacttgatgattttctatttatcaattccattttctgaattatttaatcaataaaaaaactgaaaaatcaagggaaaaaaggggcattgggcaacaaacaggccgaaccgttggcatgccgctgccaacagtacagttgtacacttgctctgatgttcaacggcccacgagtggtaggcactaaaaggcccatgtggagtggaatctggcccggtggttgcgcttgtggctgcagattaggaataagttcactttaggtccctctatttgtcgcccaatccgatttccgtccctcgaccgcaaaaccgggtacaacctgtcccccaactttcgaaaaccgggcacaagatccctcggcggttttgaaggtggttttggctgacgtgacgtctacgtggcttgtttgactagttctccgtcccacgtggcattgatgtggcgctgatgtggcaattatatcttcaaaaaataataaaaatcgtgggcccacaatttaaccatagaaaaaataatttaaaaatgatgggtctcacatgtcagctaaaaaaataaatatggtagggcccacatgggccccacatgtcattcccaaatgaccaaatcctatcctcttcttcctcctctctctggctctccccatctctctgctccctcctctcgccgggcggcgtccagcacgacgggcggcgcggcggcggtaggcggcgcgggcgacggacagcgcatggccggcggcgggcgatggcgcgcgtgtcggcgcgcgaggcgcgtggggcaggggcggccatctctctcttgcgcaacagatggattaagttgtgaccacgatcgatcgcttcaaaccaagttgagttcacagcaacgagattcacatactgcaatgcagaaacgcaaacagaacaggcaattcagatggccaaatgcgacagaatggaagagttaaccacaatccagagctagaggattcaaacagcagcaccagaacggcttcactgggttatgttgcgatcgcctaataaccaaactgaaatcacagcagcaaggttcaaatcaccgcaatgcaaacacagacaagcaattcatgagacaattctccactgcttcatcacagatgctcaaatccaaccgaggaactccaagttagttcaaagttcaaaccaattcccttcctccaatccaccgaacttccagaaacacacgcgtacattgaaaccacactcgattaagaacaaggcacgcagaatccgaaccaatttcaaaaggtcaagaacctccgaagttacctaaattccccattttgaacctcaaacccccccccccccttgaaccaaaccaattaattacccattgaaaggaaggccaacggcaaccaagaaaggaggcccccgaaaccttgaccccccgaagcggcccttggaccggcccgacaacggttggttaccccccagaaccgcccccgccggaaaagaaggaattaaccccccccccctccccggtgggcaaggaacttggcttagccgtccgccgcctttttacttccccgccggaaaagaaggaagctcgcacggctctaacttcttcgtttccttttccctttcccatacgcccgtgcccgggagggagtgaggcgagtacgagccgccgccgccgctgctgccgctgtcgcggcggacagggagaagaagctgagggcggaggccgggtcgggggaggaggcgagggcacggagcgtggtgttgagcatgaaggaattgggggcgcaggggagggaggcgaggaggcggagcatggcgtcgggaggggagagcgcggcatagacggcttgtggagcggcggcggaaggatgacgagcgcggtgtagaggcgcttggcaatgccgtaccggcgcgcgcggagggcgtccgggtggt

SEQ ID NO: 39653 - DNA, 7090 bp, Oryza sativa
acgcccgccgccgccgccggagctcgcctgctccgccgcccacccgcgccgtcctctgcctgagaaagagaaagagagagggaaagggaagaagagagagaagggagagggaagaagagaggagtgagactgacatgtggggcccacatggcccacactattttaaaattattttttttgcagccacgttttttattatttttctgagatataattgtcacgtaaacgccacgtcaatgccacgtgggacggagacctagtcaaacaagccacgtatgcgccacgtcagccaaaaccgctgagggaccacgtttgcccggttttcgtaagttgggggacggatcatacccggttttgcagtcaaggacgaaaatcggactggataaaaaataaagagacccaaagtgaacttattcctgcagattatgagcaattctccgttcaaaaaaaaaaaagagagagattatgagcaattctgcaattgagcacgtgggcgtactctcgactcgagcatcgattgtgtgaagaaagaaaccagttaaccagcacgtaattcctcagaaaagaaagcaactgatgatatctcaatcaccaagttttgcatactgcaaaggttaagtgagatagttattccattacatagatagatttgcaacacaacgtactacaaatccaagtgatctgcagcttacatcaatcaagagttaactaatctgagcagaacatcctagattagatactggcgcgaacacaatcttgtgatctgccgcaggagctacaaaattgtcttaaatcctaagagcatctttcccatctttaagggagtaccatgaggtactatgaagtacgagggaccataaggtaacaatctaatctaaccgttgatttagaaggggtatgatcggactaaataaagttaaggcgccgcaaatcaccgcccactcaaccaatagcgataccctgttcccgtctcctaccttctacctcatctccggccgccgtcgcatcatggccgccgcggccacgcgtcacacaagcttcagcctccgtcgcatcgaggccgccgcggctgtgcgtcgcacacgcgtctgccgccgtcgtatcgaggccgccgcggccgccgtcgcatcgaggccgccgagcagccgtcgcatcaaccccgccacggccgccgtggcttcaacgccgccgcatagacgtcgccgcctccacccgctgcatccgccgtcgcaggcgcatcaacatcgccgcctccaccccgtcccatccgccgtcgtagccaccccgaagactccggcatcttttccaccatctggtgtggactctgtcgtaataagaactaaatttgaaatgtgcttcatctggatttgttatttgttggtacattttatggttgaagaagttatgaaggtggtaaattatttggcaggttcactgtgccgtgtacagtggaaggtgttggtagcagaacaaatatgctgtatgatgttgttgtttgtctaagtttgagctgaatttacattgtatgccgtgtgcataagttgtttcaaccattgttgtttgtatcttgtacaactttcataaagtaagtacttgaatcttgttggtctaagtttgatctctgttcaagaagcagcagtgccagcaattttcagttttcagcatcaaaaagcagtaccaagcagcaaatttaaatttgtagcaataattccagcaagaggagcaataaattcaggcaaactgcaattgtgacacagtcaattcagcagcatatatgtgtatttcatctcagcaacaccaacttcagttccgcagatagcatccactagtaacaaataatcagtaagcatgcaccagtaataaatctcgcaagaagcatccatacaaaatgcacacaaacaggggcatcaattatgcaaaccataccactagaattgactgatagacatattacatcggaacacatattacatcggaacttcagtgaacagaaacacacaaacatcagcttgctcgaaaagattggctccaaccaaagcattccatccagttgtgaaggttgctcgcttatccttgaatttcatcagtttcatccgcatccaaccatcgccggcctcccgccgatgcagcgccgccgtcgcatcgaggccgttgccctccgaccctgacgaatcgccaccgccaccgatgcagcacagccgtcgcatccagacagccatgcccgccatcgccgacgaatcgccgccgccgccaatgcagcgcagccgtcgcatccagactgccgcgcccgccgccgttgacgattcgccggggctacccgatctaggccaccatcgggtcgccagtccaacctactcccgccgccatctatcgccgccatgcattctagggtttctttctctcgctgctctagcccgtcgaatacgcggcttctgttctctcgccaaacagagaagtaaccagagaaggaagggatgtgcgtgcgtgatgcggaatagacgcgaaagtacataactaccctcccacccacggtaccacttcaaggcagaggtgtggtaccatgaggtacagatgatttttgaccgtccgatgagacctgatcaacggtcacgatttggtactgcacagcctcaaggacagtaaaaatgctcaaatcctaatgacggcttcagtgtttcgccacgtcgtcttcgtcctctaacatcagtacatcaacccgactagctcgatctccataagactgcactgcacgtgaagcttatagagcacagcaactatgcggcgtccatgaaccgggcctagctcgagctcgtctcgtcgtcgtcctcaaggagctcttcggctaagccgatgatgtggctgaagccttcctctgtcaacgcgtcgtcctcatcgctgcccacctcctcttcggtctcgacgacgtcgtcaccgctgtggcgagacgcgagcgcgcgcgcggccgcctcctctccctggagggcgttcactctggcgcagaagctggcgacgtcctcctccgcctcgacggcagggccggccctgacgggggacgagcagtgcggccgctccgggcccccgtatcgtaggggccccaccccacccccaggccaccccctgccgtggttggcccaacaggccatgcagacgatgagacgctgaggcggaacagaagacgcgagggtttccgattgacgcgcgttagccgccgcccacgtcctcacgctcacgcaaaatcacatcgcgcattcatcccgcagccacagccgcagaccgcatcggcgccgcgttgtcgtccgtcgcccacgccgacgcatcagccatccacggcgggcttcctcttccgcgcgaggcgctgaggcacagccatcaggtgagcagcagcaacacgccaacaccattggtccattgccaatttgccatcgccttatgaaaaattgaaagattgtaactgattctatatgtaatctgttggctgttgccatgtaagtatgtactgatgttcagtagccgtgcattttgctgtcctgtgcaaggtaaattcagttggaccgattgttggatacttggacgaaccgaggaaggcataaaactgcacctagtgtgtatatattttcgatttactagtaaaatgcccgtgcttcgctacgggtaaaaagaacgtttaaatgtaataaatatttcaagaacggatataaaacactgtcccattttgatatactcatattgtcataacgcgctctctatcaactctcacatggcaagcgcatgatattatttacaaaattgagatggtgcttggactgtaatatatcgtgttttgcggatgacggaaagaaaataattacttacttaaaattattgatttttgaattatccgttattgttcgtatattgtctgcattatgcaccacacacaatatccgtggatccacatagttgcctcgtgttgcaatagataaaaactaaattaaatttgtgttgacgtaaaaattaaactatatatcataattatgaaagctaatggcatagccaaattatgaaaatcagtgttattattttttcaatgggagtattgttttccatttataaatcacattgtcaaatatcgaaaaaaataagaagcagattagacgtagagaaaaaaaacagaaattaaaactatggaagcagagtgacagggaagggataagaaagcagcagcagagcagtctcggacctctcggttcttccattctcaatttatctctatacacgatactctgttcttatcctcccatctcactctcttagacactggcagggacatgtaaaaaaaccgctccccatcactttccccacttctcctcctgctcagctgctctcgatgaatccgccgtcttcctttttctgctctttcctcttggttttctctcctctcatctgctgctctccctcctcgaccacccaccgacggcgccactccctctccgccgctccccctccttgtccctccaccgagcccaccggcgatggatccaactcccccgaactcgctggcgatggatcggccttctctgagcttgccgacgacagatccacctcccctgagctcggtccagccgtcgtcggcgttgggtggcgaatcagtcgacgccgatagcagatcgagctccccaacggtggattgagctgccacaacgatgcagttcggtgccgagcggattggggcggctttggcctttaggcggagggagtggtcgaagacggggggaggctgagcgagtcgtggatgccggatccggtgggtttttcttgtctcgtgatgtcctccatgatcactatttggtctgattggtgtttgttttgttggatttctcaggatctggtacagtggacgaatgtccggctcgacgtcccgttggtgcttcttctggtcgtccagtcggctctcaaggcctggctgcggcccgccgagtttgagagctcgcctgccccgtgcctgccagtgactgatgtccttgattcgccgtcagttccagccactgacgcctatggtaattttcatttttaagataatatatcatgttattcatgtgaaatcttgggatcatcttgcattggagcaattctgtttttgaaatgggggaattgcggaacaccagtgtatttccatgctgattaatttggaacatagcatagtgaacagggtgacaggtggttatcttgatcttaaactgtctccaactcttcattgaatgtttctcagatgaattgattcatttaattcattaaagccacaggcatatgctgaccactgcatttcttgtacaatgttgaacaggtacatggagttggctcactgagttgatgaagctttgtggttcatggcagctgatggactcactatggatcaccctattatgacaacagaattctggacatcacatgagtgccttcttcttccctatgagcaagcattacctgaaaacattagagtgaaactccctcacctcatacgtgctgttcatgttgctgtccagatagtaacatgggttaccgacccgatgcatggtaacacaatgaaggctccttgtggcctcaagactcgctcctttgctacttttcagtatttgcttgttcctattacttctcagtagtatgtaactgaataattgtcttatttttgctggacaacctaattgcatatgcactatgctgctatgcagagagaagctgtttatagggtgtttgatggttgattgcggcgtacaatgtctgacaggtacgcggaagtttccgatgcttaatttgaattgttgatattgcaaattaaatcagtaaatctcattctaagtcttttaactcctgttattcattttttattccccgcacaacatacacacacgcacaagttatatctcaccttccagtatatatgttttttaagattgcttttgtattctagtagtttttatactgcataagagtagttttttttttaaaaaaaaacagaacagttagttaatttgatttcattggtttgtagctctacgacttatggaatactgagatgaatataaacctaggtggtacctgtggattgtaatttaaactctacacacatgggtaatcttatatgtcttttcgatgaattaaaaagcttcacaattaagaaaacataatgtatttaaataataaaacaataacgcgaggatctctgcgtgcacaataagtttaggccattaagaatagaatgactgatctacatgatatataatagatttcaaggttctatcacaaagcagaattccatcaagtttatagtgacaaaacactaacttttgaaacattaacaaagttcaggagatcaaaactcaaccaaaaatagcaaaattagaagagacctttaggtgttctatctaaaagaatagcatgcaaagtatatttatctagcaagatattgattaggagattatgtactggtaaaaacaaataattagtttacattatgttaaataattagtttacttgcttgattctcaagtaatttatctctctgaccagaaggtctgcatgatgtgtctgttctagctagaaggccatattggtgtatgagaatctgtcaaatccctatggaatagcgggaactctccttcatgtccaagtctcgcagtcctatcttccgaagccggtaagcattctgcttccattcctacttttccaggcagctttcctagagcctattccttacgtaaaaaatgacctctcgtggtcctactctgtctattcgtttaagccagctgtgcttttcattttcttttatctttccgcgagggcctctgctttcctttctatccctttatttctgggggcattctaaggttttcatgatgatctactctgtggtgctcaattatattactgattgatgtcttacgtttttacagctgtttttgttcgttttattgagctgcaggagattagatcacttcattattttgacactaatatgatattccaacattgaatggtatcttattgtgctaatcattttcctatgttgattcctgtagaagtttattttcaatggcggacatgaactttggga

SEQ ID NO: 39654 - DNA, 5731 bp, Oryza sativa
cccgcatgccactgtttgtctttatttcatattagaattgcatatagtgtagtagttgttcttgctcctactacatttgacctggcagagttgatgcaaagttggatcattctaaaaaaaattaatctggttctaaccttttcatttgtgtgtatgttaagagtgaaaaataattgctgctaatgcttgctatatgtaattgattttgtctgaatttactcaataatttaggtaaaaggtgggaaagtagtgagcaggaagtagaagaataatttacaaattccagtctatgagagcagacgaataattaaatatctagattcaattgtgattgttccaaaagttatgccaaaaaataaatacaattcttaatatgtgcatcattaagggctaaagaattacctgcgtccatcataaacgtagatttagtatcacgttgaaccagaaattgctcactttgaaaaaaataacaaatttgggggcatatattagtgccgagtgagagattgctcagtatccacaccaaattttgggtgcatatgagtcttatttgtgatatgtgatttcagttttttgtataggttgataaaatgtttgtattctacttggacatgtaatttcaatagttggattctgtatgtaattcggtatgtaatttctatcattggactgtatgcaatttttgggccatctaattgttcccgactctatttggcctttgtaatttctgagtcatgtatttgtatcctactaaatttgtgcttcaacccaatcggatggaaaaaaagaaaaccacggtaaaaaaaaaccggacagccgaaaaaaaacagggtagaaaaccgcaaaaaaaaaccggatagaaaaaatcaacgaaaaaatggaccaggaaaaccgtgaaaaaaccagacggcccagaaaaaccggacagaaaaaacgacgaaaaaaaaccgggttagaaaaccacgaaaaaaccggatggcaaaaaaaccgcgtgtgcgttcaggaaaccgccgacggacgaaaaaacctcacgaaagccttacgaatttttttattaggtatagacttgtggtgcacactcaaacgcttgcaaattacgatcaactaattggtaagattttaaatttagatttataatttttagtgtagttcctttttttttcaattattaggccatgtcattgataaagtatgcatcgggtagcgagaaaaatacatttttaaggtaataaatagaatttttttatatcaatattatttatgaatgcaatttaattaaacttttacggcaataactcatatatctactactactactactattatgttagggcctctatgtttagattcgcaccggggccctgaaaactcgggaccggcccgacgcggaatccgcgctcgtcgtagtggaggaggagcccgccgacggcgccgtcctttgtctcgaagcggaagacggggtcgtacacgaatccctccttcgtgatcatggaccggaacctagccggatcgtacaggaaccccgggtacagtggcgtccacactgccgccgccgtcgacgccatctccgtcgtcccggctggctcaaatccgctcgtcgcgtgtcgtcgtcatgggcgggtgaaaccggcaaggcgggagtgcttgcttttgacacaattttgacttttgacgtgcaaggagctttggttgacaggatgacgagcaacgggggcggcgctggctttatggcctgagagacagaatgcgagtcggagacacgatgaatgcacacgcggcttggaatcggagacggagtgctgggcgccaatctgcgaagatcgagtaaccatgacacaattttcaacacacagtcaagtccgtatttcagtcagatgcttggtttggtcaaggttaatcgaaatatctctttgatacaaaggggtggattaggaagagatgaatagagggggacttatctccttgctccttcattccctctactcttcctcttctccctcttcatccccctcccatctcttcttctctcaacggtgatttcacatgactcaaaattttggcttcgcgcgcgctagtaatggtagatactttcattattaataacctattcagatcggtgtcattttaaattatatcctttttagtaaaattgataaatatatgaatacatttagtttgctaccaaatattaatactaatgttcagtgaattttagtaataacacatttatgagtctgtcatagatgttagcaattttccaaaaatttagtactcctattgctaaattttagaaaggtttattttaatactaatatgaacataatactaacctatcaaaataaaagttttttttcgaggaatcaaaataaaagttgaaccaacgtagtacactactggcctgctgggcagatgcccggtagtatttggttaaaaaaagttgaaccaacgtcgtcatataaaatttaactcaaatcgaatagcttccacttcaaaccttaaacacgcattaatggtttcaaaatctgtagtactacagtaatatatctacagcaaataatcatttatgatcaatactcgacagctcatctgtacacaaagcaggagtaattactaattagggaccgagaagtcgaaggaggtggatacctgagggggctctccgcaaaaaaactcacctactcgacccaacccgtcccaaccaaatccgtccattttagatccgacggctcgcagtggagatcgtaacccaagagaatataataaaaaaaagaagcgcatagccatcgcacggcggaaggactagaggagaggatactttcgccgaaacgggcccacactaccgtctcttcccccccctcccttcccttcccttccctcccctttctctctccttcccgatctctctctctctctctctcctcgagctctcgccgcacgctcccaaaagcggcgccgcgccgagctcgagctcgagctcgcggcgggcgacgagctccggcgagcgcgcgcgcgcacgctgaccagcgggggtttccccgtccgagctcgcgcgggcgtcgtctcgtcgggcccccttttcacctttctatcggtcattgaggggtgttctctctccccccaggccaccgcttcgcctggccgctcgggcgctcgccgcggttttcctggcccgccgagtggcgggattgcggccaaccggtaatgtgggctctgatccctacgttctgctgtgaattaggactgattgtgctggctatggtgctgatttgtgtcgtgtttggttcggtttgctcggggttgtgcagcggaatggcgcagagcaactgggaagcggataagatgtaggcgatttctctgtcttttggtgcctggtttctgcggattttttgttgttgtgttaggattaatttccggtgcttgtcgtgcaggcttgatgtgtatatctatgactatttgctgaagcggaatttgcaggcgacggccaagtcgttcatggcggaggggaaggtctccgccgatccagttggtattcatctccgctgcttctgtagccgcctccttttggggttcccctttggtttttgccttgctagcttttgatagcaaatggagtttgtgaccacaggaaaattctggattttaagtagaggggcaggtttccatttttattttatttttttgagatggcaggtttcgagcattagtaggaacgaaaatttgggtttcgatctggaatgggagtcttgtgccatgaaatttgaaatcttcacacaggggttgtttctgatcaaatcagaacagaaaatttggaacgtggaagtatttgggagactttttcttccttcaaaatttaagaagaggtgctcacggttagagcttcgagctaatgcagggtatagctttcgatgtttgggggaaaagtaacttggagaatggagacgcttggtgttcggttcacttgggtgtctagctttcgtggttttcattcagctagtcatgtgctacttccattttttaatatatgacgcatttaacttttgtgattcgtttggctattcatcttttctagaaatatctgtgcatataggcaaacatacaatgcatgatagttgtgtacatccactttggatgtagaggcctggttttttattttctttcttaaaaaaacatacaacgcacgcttaagtacttttgatggcagatctagtggtactcttttcactttaactaagtaactgaataaatattgtaggtaaaatttgaaggaaataatgaatcatgttatatattaaaaatggaggtagtaaataatagtttcaacaactatcttattgagtggatggcgggattgggcggcttgctttggacattcatgcatgcttgtagacaacattggattttgatggtggagtacagatgtattaaaagcagaaaccgcatagatctttttagttgtggctcttttcatatatctatcataatgtaattgacatatatagccagaaatgatctattaatggtatttagctaacttagctattgttcagccatttctttcagcactcgatgaactgaattatgtcaaattgtcagctgtgttcaaataagaatagatgcatacatttagaaaagttgtaaagggttttgagttttggtagtaaaactccagatgtatagtagaacaggatgcttaactttctagaaactactgttttgttctgtgacatgagaaataataattgatacagagtacattatattttgtggccctaaggagccctaacatggataggaatacatgtgcatagtgggaccagaactacagaacaaagtaatactaatccaattggcatatttttcccacatgtagtaggtagttctagactactagtattaaccagtcaacaactgatacagggccaaactagggagctgaactaaacttagaaaataaagagaaaaactttgcttttgcccttttagttccaaatacacgtctcgctaagaccaggcctgttagaaaagggctagcttcatctttcacgcattactcaaaatgataattcattaatttgtcacctttgaaccctccatgatgtttgaccctagttgcttttcccagcttaaatggttcagttctgtcacataaaaaacagcatgcgatttacaaaaatctttaaatcctcatgaaacgtaccatcacctttaattccaaataaacttctcacttactaaaattggcatgtgagaaaagggttaggtagtatgtttttgttttgctaggttcttcagatgtgataactaccacatctgaaccttccaattcaactttggcatgtggatatcttcaaagatgccaaaaaccctaggtgatgataatatatttaatgcaaaacacctagaactaataattcaatatagatttgtgtcactccaagaacttatgcatgctgtttacctgtgacccatttactacattagtttcaattcataggagattcattcaagcatcataattgtaaattcttgtattgcagcaattgatgctcctggagggtttctctttgagtggtggtctgttttttgggatatatttattgcaagaactaacgagaagcattctgagatcgcagcagcatacctagaggtacctttggaattgtaaatttttaatcaccatgcatgtcttttttagcttgtccaatgtaaatttccttttggaaatataggc

SEQ ID NO: 39655 - DNA, 2572 bp, Oryza sativa
  unsure (1)..(2572): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgacaaggcatttccaaagccgatacaggtttaccatatgccgacgagaggggtcccagaccaacaacaggttaggtcccagaccatactgtggcaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcgagagcggaaaaccgtacacccggtacgttccccggtccgcggttttggaaattcatttagttcgtaagcaccgacccaggtgtcgggttttccaagtcttttataaacccaagttttacccaagttgtttttcagattttaagtttgaaggcgtccgtcgatactcgcacagggtgcacgaatatcgtgacgcaactagatggttacaaggggacacgatataacaattagcaaagggaggatcaatgcaacaaattaggtgggtccgccaatctgccttgcagacgggacaacagattaagtgcgatcctatcaatgcataataatttttcaagcaacataattaaattcaaatataggctcaagatgttcaaaggtggcttgccttgctcgagatctggagcttgatcctcgaaatcctcgcactgcgggtcttcgggctccgaaactacacgcgaaacgggacaactcaacaaacagcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatccttttggaaaagaaaagaagagggagggaaaatagacttttctcggacggctagggcgcggcccgagagaaagggcggctcggccgagcttaacgggccggccggcccaagaaggcggcccagagcggcccaagacgcgcgcgcgcgggagggaggagagagagagccggtggaccgggctcaccacgcgtggtcccgggtgggacccgcttgtcagcggctcggctcaccgtgcggagggagcacgcggcgcggcgctagggtgggggagggacgcggtgcacgcgcgcggttcgcggtggacgcggatgcagcgggcccacgcgcagccttacggctcacagtggaacgcgcgcacgggaggggctgaccggggtcggcccgtcccgacctcggctgagctggcgccgacgtggcgcctacgtggctgccacgcgggccggcgggaggtagacgatgacgccggccggaacggacggcggacaacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggcggggagggaagagggaaacggcgacgaggtcacgaggggccgattcccggcggtgagagcatctacgcggccacgggaatccgatgctagcgtcggattgggcggagctacgacgagcgaggctggcgacgagcgggtgctacggagatcgggcggcgacggcggcgagcacacggcgagcgacggcaatggtcggggcggcgccggctagctacggggaggctactcgtgctaccaccgagaactaagggggggatggagcgcggaggaagaacggagggaggcactaccgtgcgggcgggatgcagtgacgagaggccgacggcgggggagtaatctctccggccttgggccggggaagaggaaggagagggcgcgcccggagtccccttccacgtccttgctcgtgccggctcctccgacatgcgcaacgacgaacggcgacggcgaacagagcacgggggcggcggcaatggcgcggaggcgaatgggagaggaaggaaaagggggaggctggggtttaaatgggcggcaatgtcggtttgggaaccgacttagggcggtcaaaggaaaagggctggcgctcggcggtcgcggcccaagcggcgacagggaggagggaggaggatgacgccggcgggagggaaaaaggggaaaagagggagagaaaagggggcttgtccccttgcctcttcgggaaa

SEQ ID NO: 39656 - DNA, 15405 bp, Oryza sativa
cctccgggggagatgggccgagcgagattcggcccatcgaccccggaggaggcaaaatagacttttacggaggaaattgatttggaaggatttgggttcggaattgaactcgacgatggatcggggatttgagatcttgagatggcacggacactagacgacaagcgaagaaacaaatttcgcaaatagggtttttaggagaaaattttcccgctaggcgccacgacggaacgggcgctacacatactttcagtactcataaactacaacgtgcaacatgtgagtaggattaaattagaggaacgattattgatcactgacaagttgtctctaaggttggagctttgaaggtgtccttttggtccgtggatctagaaatttaatagatagaaaaaaaaagacatggtcacaaaaactatagtgcctatagtattccatatctatagtaagtcataccaagcgctattctcttattaagaagaaataggcactatatatattcggatcagtatgtcatacaagtctaatatatacgacggtccctattactccttaaatcaaattgataccgagtttcttaagtattccatatcttctatttatgagaactaatttatgatacctactacaagattatatccattccgttatgtttgtgttttccactattaagaatatattacacattcaattcgaatgcatttttttacagttttaatgtgttactttcaggtttctggatccaatattctttggtgaataccctagagaaatgagagagatcctctcatcaaacttaccaaagtttacaccagaagaaaagaagttgttgcaaaacaaggtggatttcattgggataaatcaatacacagcaatttacgcaaaggattgcatctattctccgtgcgcacttaacacatatgaggggaatgctctcgtctacaccaccggtgtaagaaacggtgcaaaaatcgggaaacctgtaagaactagtacttctctacttttttatgtccctacttgatcttcaatcaactttgtccaatatttgtttggtttctatgtatctcatatttgaatatgtgatatgatcgaccttgcagactgcattttcaacgtattttgttgtcccagaaagcatagagtcggctgtcatgtacgtcaatggtagatataaggacacaacaatctacattacagaaaacggtgagtagtgatatgcattggactcaaccccctgaagatccagttgcaagttcatatggctttatgcgtctattccgtccccatcacttatcatggattcatgggtcatggtatttgctttcaggctactcacaacatagcgataccaacatggaagatttgatcaatgacgttgaaagggtcaactacctgcaaggttacctcaagtatctttcctcggcggtcaggtgatgtattattgctgaactttgtattgcatatgcatgtaaaatacattcgtgtttgctgcaaggtgtatttgtgctttcctgctcacatgaaagatccgcctgttggcacatgctaaactgcaggaagggagcaaatgtaggggggtacttcatgtggtcactcatcgataattttgagtgggtattcggttacaccatcaagtttgggctgtaccatgtggattttgacacgcaggagaggattcccaagatgtctgccaagtggtatagagatttcctcacgggctccaatgtaacagacgatacccaagtgtggtcacgtagagcagattcttgaatattccgatacaagtagctatactacaccggggaactgttttaacagctcgagtggatgtccacccatttattgcatgtcatctaaatggttataaaaaattttgaaaaagtataaacaaaatatatcaatatgtaatatatcactccacaaacatgcaagttaaaattcaacttctacaaattgtaacaaaaataacaaacaagacttaaattaatatatgtatatttacagttaaatttattatttttcttacaacttatagaagtttaatttgaacttacatgtttgtggagtgatatattatatattgatctatcttgtcaatttttttaaaatatttcacatccatttagttgacatacaataaacaggtggacgtctactcgagctattagattccagttctcgacttccagtcaatacatctagcactggatagtagttttatacttgtttagagttgtagacccgcttgtgttgaaatgtaaaattggggatattgtagtgcacactaatacactattgcactactgtacagttacttcagttatgaacttgtgctttaatcaaaactagcatatatattttctctcatataatagcatatagtatgttttctcattatattattcaaatatattaaaatgacaacataattttaaattttgcaataactttacaaaactactaatatgtaatattcatattgtattttatatacgtgttagttattaattattttttatatcaaattttagttatttgtaaattatatatattgactagtttttcaatatttattttttttaattccgaattttctgtaaattgtatttctatatagactctatactcttattccaatattatttatttttatttctgaatttttattatttctaattatatttctatgtggactttaaactaatttttaatttcgaatttcagttacttttaaattgtattcctatattgactttaaactcttcttcccatgtttttcttaatttcgaattttagttatttgtaaattgtatttttatacggactctacactctacttttaattttattatgtttattccaaattttagttagttttaaattcccatatggactctatactctacttctaatactccttattttttaattctgaatttctatttttttcttaattgtatttctatatagactctatactctacttctaatattccttatttttaattccgaatttcagttatttcctaattgtatttctatatggactctatactctacttctaatattccttatttttaattccgaatttcagttatttcctaattgtattttatatggactctatactctacttttaatattccttatttttaattccgaatttcagttattttctaattgtatttctatatggacttatttttaattccaaatttcagttatttctaattgtatttctatatggactctatactctacttctaatattccttattttttaattccgaatttcaactatttctaaattgtatttctatatgtactctagtcccctcttctaatatttcttattttttaattccgaatttcaggtatttctaaattgtatttctatatgaactctgctttttctttttctcctattaatatgagaatttctaggccatgagagcgaacgtggaggttcctttttctattcatttaataatataatagatgctttagttccaccatgtgaatgcatgaagacaagtcggtggcctagactatcttggagcagcaaccgtggtaaaaaaaactgacacttgttactgcgtgtgtgattcataaacccccgattactctgttagcattagcacatggtgtgatttaatttgggcctgtttgatcaatgctaaaatatgcctagtttaaatagtaaatgtggtggtttggttgaagccaaatggttggtaatgccacagtcaactcgacataattcaagaactatttttatcataatataaagtcagctctcaattattatcaattcaaacacattcattttcttcaatgctacctcacaaaacattggtaataccaaaaattaacaagataatattatggtatgatactaaaccaaacaagttcttttttttccaaatgatgtccaaaggatcaaagattaatcgacttgtatccagaaaaacataatcaaggataatagtcaacagaatttaaatctctaatgctaaagaatctatgtttattcctttgataaatttcgtttgttccttaaggaggttgggggtaggaggccccctaacgaccaattgcgcgggctgggccgcaatgggctgccacagtggcatgcagaaaataaaaaggaaaaaagtacaccaaagatccctcaacttgtcattaagtttcaaaatcgtcattgaaccgcaaaaccggatacgacccatccctcaacttacagaaccagtgcaaattaggttacttagcggttttgactccggttttgtccgaggtggtatctgactcagcgtgagacccacgtgggccccacacgtcagcctattcttcctctcttcctctcacctatcttctccacaggcggcggccagcgggcgcatgtgagcggtggagcggcgcgcgggcgggttcgattggtcgtcggtgttggaggcggtgcgggcgagcaacgacacccgcgtcaccgaggccctccgcgactgtcggatgctgctcgacgactgccgcgagatctccagcaacaccatcgccatcatccagcagggcgccgccttcgccgccatgctcgacctccacgccatcgagagccacgccggcggcagcgaggtcgacgtcgaggatgacatctagcagtagcaccacgtggaccgccacctcgaggggtcagtacccgtcccgccgtgggtgtccgacgaggactggaggatgctcaccagcggcgaggaattcgttgtcgggctgacaccgaacgtgacagtggccaacgacggcagcggcgacttcaccaacatctcggcggcgctggacgccctgccggagacgtacaccgggaagtacatcatctacgtgaaggaacgcgtctacgacgagacggtgaattgaacgtcaccagccgaatggccaacatcaccatgtacggcgattgctccaagaaatccatcatcaccggcagcaagaacatcgccgacggcgtcaggatatggaagacagccaccttcggtacgccaccgtacaccgccattgactcatccattcatgcattgacatggacattgacatcggtgttgctggtgcagcggtggacagcgaccggttcacggcgatgaggctggggatacggaacacggcgggggaggagaagcagcagacgttggcgctacgggtgaaggcggacaagagcatctttttcaactgccggatcgaggggaaccaggacacgctgttcgcgcaggcctaccgccagttctaccggagctgcgtcatcctcgtcaagccttcgctcccgggaaaacccaccgtggtgactgcgcacgggcgtcgcgaccggcaacagaccacggggttcgtggtgcaccacagccaggtggtggccgctgcaccgcccgccgccttcgcccgcccgcgcgccgctcgcctgcgcccaccgggcgccgcccgtggagaagataggtgagaggaagaataggctgatgtgtaggggccacgtggatcccacactaagtcagctgccacatcggataaaaccggaatcaaaaccgctaagggatttagtttgcactggttttgttagttggggcatgcgtcgtatcggttttgcggtttaaggacgattttgtaactcgatgacaagttgagggagacatgaaaaaacattcaatttacctccttaagttaaggctttaactagtgatgggcccttctaatgggcgatcgatcgccagcgatcacgctgggcgatcagttcccccccctcccctcccccctctatactcctccctcttctccctccttcctcctccccttcttctcttcctattacagtacaccacacaaatttttttaaaaaaacaaaaagttagaaaaatttatgtatagaaatactatataaaaaaaatttgaattcaaattcaaatttgaatcgggtatataaacttttgttttataaattttgggtctataaactttaggtgtataaacttttagatgtataaaaatactatatatagaaaatatttgaattcaaatttgaatttgaattcaaattgtgtaaacttttgacttataaactttgggtctataaactttaggtgtataaactttagatgtatagaaatattatatatagaaaatatttgaattcaaattcaaatttgaatcagatataattcaaattcaaatttgaaacgggtatgtaaacttttgacttataaactttaggtttataaactttagatgtatagaaatactatatataaaaaaatatttgaattcaaattcaaatttgaatcggatatataaacttttgacttataaacttttggtctctaaactttagatgtgtaaacttgaggtgtataaactttatgtgtataaactttatgtgtataaatttactaaaataaaaaaataatgcggtgccaaaaaaaaaaagaaaccatgtggaggggtggagggagggaggggggagagaatcgatcgctaccctatccccatagcgatcgcccatcagcgttcctgactagtgatcggatcttatttgtacatcttaaacgtataaaacgggatatattgatctcttgactgtgtaaaacaacttcacgtgacagcctaggcatacggcccatatgctggccttgttgacatattgcgactgttagacccccccaacgacgtatggtgctctgcacgggctgggctgcggtgggctgtgatagttccatgcaatgccacgtactcctcgctacctgctgggctacacagcaaaacatcatcggcttccgcccttgcacactcttcggtggggtggtgacgcgcgccagtcggcagatcaccgggccgcgcgcggtaacgtggcaccacatcctgctcctcgccgatcgtccttgtaggctacagcgttcggtgggaggtgacgctgacgcagcgcaatcgccatatcaccgggccgcgcgcggtaacgtcgtaggcgacatcgttctctgtctgtcccgcactcccgccttttgccaaagcggcccgcgacgcgacacagcggagaggtgcaactctgccatcgtcgtcgcttctcaaggtttatcaatatctctctctcggcgcgtatagccgtcgcgcggagggacgagccaaggccacgccgcatccacagatcgagaatcgcgacggggagaggcgaggcaccgtgtgggccgccgggaagacgcacgcacgagatggcggcggcgtggctcgtggtgctcctcaccgtgcaccggctcctccacctctccggcgtctcggccgtcgaccgcagccagttcccgccggacttcctctttgggacctcttcttctgcttaccaggcacgacggcggaatccccactcgaccatgctgcataacaagtctctttctgaactctgcttcttcaggttgaaggcggatatttggagggtaacaaaggtctcagcaactgggatgtcttcactcataagcaaggtaaataaagcatgaaacttcaatgtgtttcctttcgtttgtgcttatttctgttccctttcttccccactatacaattacttttttttttcgagaacatgtggctatgaacttgcgattatatctttgttcactcatcctatatggttttaggtacaattgaggatggaagcaatggcgatacagctaatgaccactatcaccgttacatggtaacatctcaaaagaaccgcaaattgcaagattctttcaggaaaacaaaaggaactgcgaggaattattcacggataattattctgtagaatgaacttaatactacttatagagatattctaatgaatctttctatctgtttaactgcctgatactgaaaaatctctgctccaggaagatattgagttgatgcactccttgggtgtcaactcgtacaggttctccatatcatgggcaaggattctaccaagtgagcttaacgattcagcttatatacaattggaacaaacgatgtattaaaaaaaattcttgtcgctcagagggtcggtttggagatgttaatccggatggtgtagcattctacaacgcccttattgatggtcttgtacagaaaggtatttaaataatattacaaaaatcatatgttacaagctagaacaaaattttgagggagactaaacataagagttgttaactggatatgtaaccaggaatacagccatttgttacaatatgccactatgatatcccacatgaactggacgagcgatatggtggatggttgagtccagaaatccagtatgtattttgatgttccataaacattgattcattttaactggtttcttactgatttcttattattttccaggaaggacttcagttactttgcagaagtatgcttcaagctgtttggtgaccgaataaaattctggacaacatttaatcaaccgaatttgtccataaagttcagttacatggatggattttactctcctggtcgttgttctgaaccatttgggaagtgtgccttagggaattcttcaatagagccatacgtagcaggtcacaatatcatactgtcgcatgcaaatgcagtcagcgtttacagaaacaaatatcaggtacaaggcctacccttcagacaaaaggactacaaagtgattagaaggacaagaacatcaattgttatttccacacagtttattaaatattgaaagcaatatcaatctaatccttttaattaattttttattacatacaaatttcaatattctggtcatgttgctagggaaaacaaggtggtcagattggaattgctttgagcataacctggtatgaaccattccggaataccactatagatctcttggcggttaagagggctctatctttcggtgcttcatggtattatgcattcctttaatatgcaattgtcaacatggtgctaccttgttttctactaatatgttctgatgtccaaaagtgtttgccatgagaagtagtatctgatgtgttttggtgcaagtcattcacataaatagctcattcagatttcatcacaataagaaactcaaaggactaccattatgttgatagttgtacttgaagatttcctctgctatatttttgacaatttaacaagagaataatacaaacattcaattgacatgtactccgtatgtttttgcaccgttgcctgactttttttttctaggtttttagaccctatacttcttggtgattatcccacagagatgcgtgaagtcttgggtcaaagcctacccaagttcacatcaaaacaaaagaacagactgcagagcacaaaattggattttatcggactaaaccattacacgacatgttatgtgaaggattgcatcttctcaccgtgtgaaattgatcctgttaatgcagatgcacgagtatttagtttatacgaaagggatggagtgcccatcggtaaagcggtaaatatatagttatcaaaattctaaattgttttgcagacttggaacttaaagtaaacagcaattactagtagttgcactctgactcaaacagacaggagcgccattctttcatgacgttccacgagggatggaagaagcagtcacatactataaacaaagatacaacaacacaccaacatatatcactgaaaatggtatggctctctttctccctatgttgtttctatgagctagaataatcattagcctgaacttggtaggatatttgcgggtatcatttgagtagaatatcatatacttcctattgaccccatgtgtgcagtagtgcaccaaaaaagtaattaatttttacatatcataaatagctcatataccaaaaaaatgaaaatgtacttttttagtgtttttacagtaatatacatgtctttgaaaaaaatacaaaaatatatgtttgccgtgggatggtaacgtgggactgcgtcatggacacgcgataccgcgtcgatcccacagcttagagcaagtttaatagtatagccaactactagcttcaaatcatctatagccaatataatagccaattcatacaatatttgcttattatactattaatatctggtcctacctgtcatacacacattacgtcttgaagttcgtgctgtagctggctacagatctgtagctcgtgacgcttctctcttccttttatcttttaaaaatatgtttatagctggcttatagcctgctattgtacctgctcttagccatgcggcaccacgcgggcccgcaggccgaccgtgctgcactgcgagatgaccatgtgcgaccgagcctcacgcatgcatgcatatacctcacgcgtgcacatcgtatttcttacctcacgcatgcatcttggccgttgtcgcacggctagcccgcggtaccgcgtggtgccgcccggccagcccacaggaccaacacggtaccgcgcgtaccccgtgcgggattttgtgggctgttgtcccgcgttttgcaccgggccaaacactctgccccgcattgtatattttcaatatttttccatataccctcaaacttaccttcctaagttacttctagttattacttcttgctattcttttttattatgttgtgcacactgcacagtagtgcattatcaatttgtgaatcatttttttaggttactcccaagcaagcaatagcaacatgactgccaaggattttaccaacgacacaggaagaattacctacattcaaggctacctcatttccttagcctcggcaataaggtaagctgaataactctaagcagcctcttgctaagatttggcttcagacattgcagtagtgatgtgttgccatgcctgaaaatcaagttgtgtaccctttcttgtggaacaatttgaaggaaaggagctgatgtacgtggctactttgtatggtctctccttgatgacttcgagtggaattttggatacacgttaaggttcgggctctaccatgtccactacaagacactgaagaggacgccaaaattgtcggtagattggtacaggaagttcctcacgggttcactgctgaggagaaagttcagagatgaatctcagcttcataagtttaactcttattaatccatacatgctgttcttccctttccatattactttatgtaaagtcaatatgtgatgctttagcgtacatatgcttgtacttgcatatgttcgcaattatccatcctagaccatatgcatagagtataatatgtactgaataaaagggacggatttttgtgtgtaattcatctccggaagaacgctttgtgtcatcaaagacctttgccaatagataagctgagtttaaggggttcttcacgggctgtctatgcatttagggtgtgttcggcacccattttcctaacccctctccctcgttttccgcgcgcacgcctttcaaactgctaaatggtgtgttttttgcaaaaagtttctatacaaaagttgcttaaaaatcaaattaatccatttttgaaaaaaaattagctaatactttattaatcacgcgctaataaatcgctccgtttttcatgtaggagggattagttcctatcccctgaaactgaacacagcctagcctagttcatgctgtagttagggatggcaacttgggccatccccgacggacagtgaccacccgtccccgtccctgcccccaccgggattccggggctatgacgggggcacacaccagaggagaggaaacacggtgcagcactgtgcatcaatttgcgaatagagagaagggagacacgaatacaaattgagaaaattttggggatttgggagtagagaattagagataatggatacacaaagtcacatacggattgagaaaataatgctgaaacacgcacacaggtgtggccatttccattttgatgtggtaaataagagtgtaaaattactttggtagattttcttatgtcactctatactaatgttatagctctagtattgtaatttatccattataggtagaatttgaacattctacagttcagtaagcatgcaatctatgaatattgtacagcaatttaatggtagtaataacaattaacaaaagaacaaaaaaaacgattacataaatacctgacctctatcttcagatggtgattttgcttgtatttcatcagtggttgagagcattttggccattttgtctgcaagaacttggaatcatcagtgttaggctacactaacattgaattgacgacctgcattctgggcattagtattcaactgaagcattgccacagaacgaaaattcaggaaatcaaacaaagcttgtatctgagatacaataaaactgctgcattcgaaatccagttagtcatacctgcattctctggaagctgaatggcaacaaataaagttcaaggaatgtctcaacacatctgaaagaacaagtcaaaccaccatatgcaaggtaaggtgacagtccaggcagtgtactattcaaattattttgagttttttttttttggcccaaatcactctgtcttcgacatgtctcctttgatgttttctggatgctgtcaagaaaggtgttatttggagtttacagcaatggtttctgctcttcaagtttgtatgaatctgataactaggatgaaatgttgcatacaattactccctccgtcccattaaaaatcaacctagtatcggatgtgacatatcctagaactatgaatctggacatacaagatgtgtcacacctgatcctagattcgatttttatgacacagagagagtaggacagaaccagatagagaatagacatatcggctttcttataattgtatttgcaaaaaaaaaaaaaaaatctcaaagatccaaagtaaacttataaatctcattatgtgaaaattaaaccatccattcttttaattgaaatgccggatattcactaacgaagaaaagggcatttcagggttacatgccaccggagaatctcttacttggattacaaaaagcatcttcatgcagcactaactcttcatcaccacctatagctattcttcctgtgtgggagtagggggaggaggtgtcgatgtcgcaggtgcaggcgccacaaatgtttttgaaggttcccttaaagtcttcgggctcttctcgtcaacgacctccatagcagctctctcctttgccttttgggctctctgaattacttcctcctgtaatgccattatcccccaaaagaagaactcataagcatgtgccatgcattcagatttacagaagaatggtagggtgattataaagttctttgtatatgctatgcagtgatcaataattattagttgcaaaacctaagcaaacctggtgcattgtggctaaggctgtaaggcgtgaagatacattgtactctactccctccgtttcatattataagttgtttgatatttttcttagtcaaacttctttaagtttaaccaaatttatagaaaaatatactgacattttcgatacaaaacaaacatattatcaaaatatatttaatattaaatttaatgaaactaatttggtacaaaagatgttgatgattttttctataaatttggttaaacctaaagaattgtgactaagaaaaaagtcaaataacttataatcaacctgaagaattgtgactaagaaaaaaagtccaataacttgtaatatgaaacgtacggagtatacagctagctctctagttcccaattccctgattcataggcacaattgcaagcaaccacctgagttagggaaattatatagtttttcaccagctagatcgcatccctttccacagttccagatttacaggctcacgctttgctgcattctcatatgaggagttcccatcaagaggaaggagcgtggtgatgcagtacctggaactcctggacctgcttctgctgctcggcttgccactgccccaccacactgaacacctcgcccaccaccgactccaccttctcggtcagcgcctcggcgaaggccttcccaaggaagaaggcgtcaagcacagccttgctctcatcgtcacctacacggacagcaacagcaacacccaatcccacagttcagaagcgcctctctctttctctcggttgcacctttctgaccacacacaccaaacaggtttacctacctggtttgggccctggattggtcccgccgccgccgccgctactcctggctacgaatctggagaaccttctggcggagcacggggcggcggggaaggaagcgctgcggccgcgggggccgggggcgtggagcgagacccagcaggtcggggaggcagccgctgccgccggtggtgggagcggcgccatgtgtgtgctcggggtctgagccgtagttccgtggaattcctcggcttcgccagcggccgctagcgggtgggaattgctgaaacccctccggcaacccccaccggcggtcggcggacgcgcggcttggattggggacagccgggggaaatggagggattgtttctcggtagttcaggatttttttttttcttttgggtttcccgtccatcgagaaaactcactagtggtgggctccgactggactggcccatcacgcttgaacatttggcccaccgaggccttcacgcctgcccgtttcgtcctcacgctgcgtcgcccggagtaaaattcttggtcaactctctatcgtcaacgtcctcgcatcgcggatggccggccggtcaaagagcgctcgctcgctcgctcacctcactgatctcatccgtgctactcctgtctcgattagaattgccagagtaatcggagctccggttccgatccctgtccatggcgcgctgcggcggcgaaaggatggtggacgagctgcgcgacgtgctggacgacttcgcgttccgggccaagcggctggccgcgccgctgctgcagccgttcggccgcgcctccgaggcggtggcgcttgacggcgcggagatcgacgggctcaggcgcatccgcgcggcgctccgggccgccgaggagcgcgtggtcaccgatgacttcgtcaggctgtggctgcgggagctggaggacctggagcgcatggccgaggacgtgctcgaggagctcgagttcgaggcgctccgcgcgtcccgcctcgagcggttcaagctccagctcctccggtccagcgccggcaagcggaagcgcgagctcagctcgctcttctcctcctccccggatcgcctcaaccgcaagattgggaagatcatggagcgctacaacgatctcgccagggaccgggacgcgctgcggctgcgaagcagtgatgaggagaggcgacgtgagccgagcccactgacgccgaccagctgtttgacgaaatgctcccttcatggaagagagcgggacaagaagcaggtcattaag

SEQ ID NO: 39657 - DNA, 11815 bp, Oryza sativa
caacacatctacaatgatgaggccttgagatccaagtttgacatgaaaatgtgggtctgggtgtgccaagagtttgatgtattgaagctcacaaggaagctcgctgaagaagcaacggagtccccttgcggcttcgctgagatgaatcaactacatcgaatcattgctaaacggctggagggaaagcgattcttgcttgttcttgatgatgtatgggatgagagtctactccgctggacaagcttgctggttcctctaaaatctgctgcacctggtagtagaattgtagtgacgactagaagtgctaaagttgctcgaatgatggcattcaagatacaccaactggggtacctcactgatactacctgctggtctgtgtgccgaaatgctgccttgcaagaccgtgatcctagtattattgatgacggcttgatttctataggtaaatctgttgcagccaagtgcaaaggcttgccattggctgcaaatgcagcaggaagtgttctatccattgcaattgataggaagcactgggagactgttgagcaaagtgacttgtgggctaacaatgaagtgattgatcatacccttcctgctcttctagtgagctacaatagcttacagaagcctttgaaacattgtttctcgtattgctcgctgtttccgaaggagtatgtgtttagaaaagacaagctggtcaggctatggttggcacaaggctttgctgcagcagatggagaaagcgatgctgaagatattgcttgcaggtactttcataacctcgtggagaggttctttcttcagcaatctccatcttatgaccataacgagcaaaggtaatgtcacttattttccaactccaaaaaaccatgaactattaattatgtcacagggatgtgcaattatgcatgagtgaccatcctttggttgattgttgaaggaaagttccacaagaaaatattactgcattgttattttacctttatgctcccaaggataaatatgcaattattcatggcatgcacaaaaattgaactggcatgcaaattaaactcaatgttagcgcactccattttatgtaccattcaaatactcaaacatcactagctacaccacataaatgtctgtactgcttacatgttattttgcaatctaaaatagaaatttggcactgaattcgacatggtgacttggtgaatgtcaaaataatgctgctaaatatattttaattttaatatgggaagttaaaagtaaagcatggaagacttggtttacaaatctaacttgaaatgtttcagtatgcatgctttatgcagaacaataatactagagacaacaagaacttctgaagtaaaaaattgtaattctgcatatgcacaaccaaacttgatgaatggatatagaattggtgcagatgtgccgtgttaccaaagatattcaggaaatacagcatgttaagattgctataaatttattatttttaataaaaacttatgtttcatttttctgtggtgcttttattagtattctccttgtaataggtgagtctatacatttttttcttgaaatttccgaattgaatgctttttatggacaatgtcacataagtgccactattatgtagtggagtttaaaccttaatattgctgctattatttccttagtggctgaagagtagcactgcaagagctcacactttgatagccttccatattttccatgtcttaatcccagtggtttgatgaatatttgtattgatggctattgattattagatgaaaagctcctatggttataactagatggatggccttaaacaactactaatgttggtcatataaacattcatttctggttaaaccttttcaggcttcatgttagttaggtataactcattttaatcatattcttgcttcatgggtttatgctgttttaagatccttcagaaacttccataacactgattatactaacaggtatgtcatgcatgatctctaccatgagcttgctgagtacgtagcagccgatgagtactctagaatagagagatttacattgagcaacgtaaatggagaagctcgccatctatccttgactccaagcgagactcattctcatgaaataggagaatttcatgcatccaataacaaatatatgaatgaatcccaataccctggcctgcgaactttgctggttgtccagagaaccaaacatgacgatggaagaaaaacttcgagcatacaaaaaccaagtgttctgttcaaagcttttgtatgtttaagggctctggatttgagtaatactgacatggagggcctgccaaactctattggggaactgatacaccttaggtacctcagtcttgagaacaccaaaatcaagtgcctgccagagtcaataagttctctattcaagttgcacacgatgaacctcaagtgttgcaactatcttagtgagctgccacaagggataaaattccttgctaacttaaggcatcttgaactaccacgcatagataactggaatgtgtacatgccatgtggaatttctgaattaactaatctccaaacaatgcacacgatcaagttcacaagtgattcaggaagttgtgggattgctgacttggttaacttggacaatcttagaggtgagctgtgcatatcaggcatagagaacgtaagcaaagaacaaattgctacagaagctatcatgaagaacaaaggtgaattgcgtaagttggtactccagtggtcacacaatgactccatgtttgctaatgacgcatcatctgtgttggacagccttcaaccccaccctgctctggaggaactcattatcatgggcttttttggtgtcaaatttcctgtatggatggggagccagtgctcgtttaaattgtccttcctagagctgaaagattgtcggaattgtaaagaattgccatctcttggtctattaccctgtctgaaacatcttttcatcaactcactcaccagcatcaagcacgtgagacggatgttatctagcggtgatcatactagctctggtgattttcagtccaggattgcttttcctacattggagacactgaaattcacagacatggaatcttgggagcattgggatgaaactgaggctacagacttcccttgtctccgacaccttaccattttgaattgtagcaaactaacggggttgcccaagcttctggcattggtagatctgcgaataaaaaattgtgagtgtctactcgacttgccaagtttcccatccctccagtgcattaaaatggagggtttctgccgtgtcaaccatttgttgcaactccctctattctctcagcttgagatgctagaacttcggtgtcacaaaaaactcgtatcgctgagaaaactccagcatatttccccatttcacagtttgagattgagaaaagaactagtacaaaaggtatcaggttgtgaagtgttgccattccagaatccctctgttcaagatagtcaggtatttgttctttctcaagtagaaatcaaacatgattgctatcaaatgttgcatactctaaagcattgcatgctttgtggttttctgtgcatttcagaaaacttggacatttttaaggtgtgccgggcaaatccttgaatgtaatgttgttgcttgtactgatcttaccttcggccagacgaatgtccactcttctgaaggtagcttacatttttctttcttgttctttattgccttccaccattttcgaaacttgtgtgctgatggcacccaatcatgttcaaattcgatccatctaaagaatattgctctgatcgacttgtatgtttaatatgtttcagaggaaatcggcaatggtgtaatattccacataggacaggatgaagctgttgagcttgtatcctgcaaaccggtttgggtccaaataggccagccagaggaggttgagattatttgcatagactagctattatgaagtcagcttgatggtcaaatcttcttgtgctaaacctggatactgcttgtaaagtcaatacataatagtttacagtgtgatcctacgttgcaacttgtggtacaagattcttgaatgatgttgttaaacatatagtagatgctgattggatgactcataagcctttgaagctggagtcatgagtaaatgttatcaatgaaactcggtcagatggtgacatggtggtgtggaggctgttttctagtacatttcctatgaaatatatttacgttgttctgaggaataatgcatatatgtactggaaaaaatatacacggcaacactctatactcaaaattctcacttcgatcgatggaggataatatttgactattcgaaatctgtagtgatcaatcccagcaaacatcgcccaaaggaatgtaatatatagcccgtttcaaaccaagattgacggataaacttacacaaacccataataatagatataaaaaaaaactcgggtacttttatcatgattagatgcatgacaataggacatatataaaactgacgcagaaaccacatgtttacccttacagctgctccctgcagctatttataacaacaacttagatatgtcttcctaaatgtaggaagagcactggagacggttcgcctgcatctccaagagcttaatttgtttaaacatcagaatgctcaggccaacttatctgctgaccctgcgccgcgcggtttatcatgcccaggccagtctcgagctggaggagcacgcgctcgtcggcgagcagctccggcgtgaagagatccttccacgactgataccacacggcggccttccccgggatgggcctcacttccgtcacaaacgggtacaccgcgtacctccatttggcaaagaactccgactccagaaccggcaccatgtacctcgccggaactaggagcgcccacctcatcaccagagggaatgtgttgctcccaccccatgtcctcgtcggcgagatcgtcggatcccgaaggctcctgctcaccaccggcacgacgtgccgctgcacagtcacaaactcgtcccacgtctccgggtcgaacacgcccttccactgcgacactttgccgtaggcgcatcgcgtgacgtcccgccccttcatccacctcccgagctcccccgctatgtcgaggtataccccgtgtaggcggtcgacgccgaggtgagggatccacgggctcacccagacgctggctggatccacgggctcacccagacgctggctggctctgtccaccacgtcggcgaccagctccggcatgaccaccttctccaggatgatgaaggccagcgccgatggcgggagggtgtctttccacgtctccaagaaccggagcatcggctcggggttgctgagacgttccacggcgactcactcacgctcggcgggacgacgtacgttgtcgatgagcatcgcgtacgccgacatgcccgccgacggcgcatcctcctcctcttgcagtatgttcctcagcgactgcaccaacgccagcgcccaagctggcctctgcaggatgtcccagcgtccgtcctgtgggcgcagcagcgggcggagccacggcgccgtgaggtgagccgccgtttgcgcgagctggaacgtcccgtacgcctcggggaacttctccttcaacccctcgaactcgcagatgaggccgcccagcgtgagcgtcctcgacgaggtctccccccggatcaccgccatggcgctgacgatctcctcctccgccgggaccggcccgcggtcctccccgtcgtggctcgacagcaccaggcgccgggccgtgctggcgctgccgctcgcacgaagcgtcttctgcgcccgcttggcagcgtaggcggcgctctcttcgcgcagcgtggcgagtgtcctctcgatgtcgagggcctcccaccctgcaccgccgccgacctaccgtgcgatccctcgacggcgccgagggcggcgttcctaggccgggaggtcatctcgatgggatcgatgcgcctaggcgcctagctgagagactacgggaggaaaagggcattctctaccgttggataatgccccttatatagggaggcggcggcgcgaggagagccaagcctaagtggggaggcgcgccggcgccaccgtggcagcgcggaaaccctagcggctagcggctcaggttaatggggcggcgcaagcgccacagctgtggctgtgtggcaaactggcaaccctaacaagcagctgatttggaaagaaacaccgaaacaggaagccattcaaaagcgtacaggataacccaggctggcgaggcgcgggaagaaggataaggcgcgcgaggaagagggaatatagacgttggcgacgggaaactgtttaaacacgggtgaacgtccacccgagagattagaatccacctcccgttggcgacgtactgtttaaaatctttccaaatttcttcggttctccaccctggacggtttcacattttgaggttccaaaaaggaaccattagaaaagatatcaaatgccgtcgcgattgattttcattagaaaccaaaattaaacaactatgttattaaatattatatgctctatctacaagtacaacttgcgtgctttcctgattgctgctacgtactatttcagaattttacaattagtttctggcaaaacgtctcccaaaaattatttcatatgtattttcaaatcaaaagcaagtcaaaatgacattcatagacatagtatagacataacaagcaaagaggcaaaaaaaaaactgaacttaagcttcatatcacgattacatgatagtagatgcctagatggcatacatgaattgacctcggtaaacacaatatctaacacatacaagcttcttactagcaggggctcagcatctcgaactcgtataggcctcagcagtttatgttactaatgctccggcacgcttatctccaatccctgcgtcgcgcggttgatcatgtcgaggccggcctcgacatgcacgaccacgcgcttctccgcgagcagttccggcgtgaaaagccctttccacacttcataccaagccatcgcctcatccaaccggggcctctcgcccattaggtaccgatagttggcgtacatccatttcttgaagaacccttgtatcaaaagtggcaccatgtacttcaccggcacgatggatgcccacctcattacaagagggaagaagttgttgttttgtagccaagtcattcttatcgagatctcgaggtcatggagagccttcctcagatgaggcagcacgtgccgctcaatgtgttcatcccagctcgctggatcgaacacctttttccatggcaacgcaagcttgtagtcgtactcagagatcccaccgcacagccaatctctgagccgcctgcttataatgtacactattcgtaggcgggcgtggctgagatgaggaatccacatgcccacacagacgctcagcttactcggcctcgtcagcctaaacacgtccgtcgcggctaccagcgtcggcaagatgacctcatctaggatggaatccatggtggcttgcggaaggaggcccttccatctattgacgaaccgtagcatcggctccggctcctcagcgctccaccaccacgcatccaagggcggtgccatcacgaggtcgtggatcaggcgagggtacgccgccgatgcgtccgcccccagcttgtccttgagcgcttctaccatgacaagtgtacggttcagcaacggctgcgtgcctccatactcacctgcgttgtactaccagctcagctgcgagtggagcagcggcgccgcgaagctgatcgccttgtacggcatacagtttgtcctgtaatcctccaggaacttcgccttcactcccgcgaactcgtggatcaggccgcccaacgtgagcttccctgactcgttcagctcccggaccatcttcaaggcacgcttgatcgccgtgtacctggaggccatcccctcccagtcgtcggcggcggtggcgtgtttcggtgggcgttgcctgcgcatgttataggctcgaaccttctcgtggcgccgctcccacgcccgcgcggcggcataggcttcacgctctctctgcagcgtgtccatggcgcgaacctcctcgacgtcgacaacggcttccggctctgcttcgccggtgccccgctcgagcttgggctctacaggcggccccgtgtcataatccgagtcgctatcgtacgacgactcgaatttgccaacgcctcctttcccatactttttggtcgggttgatgggatcgataatcccgtggccgtacttgccaaggccggtgccctcctcgtagttcatctgagccatcaaccttgccactatctggttggttgccatgctcccgggctgcggcggcaatgggggatagtaggaattgcagtaagcgggaggggaaaacaacgattgacaatggtgatccgtgtcgccggagctcacgcgcacaaagtggatggtgggcacgtctttgcttgcagccgccgcaatttcctgcacgccactagtcttggtgttggaggagttaggaggagtgcgatcagatgtttccaactcttggcctgcattagtctcgccgtgggaaagactaccaccttggtttctcccctcgtcaccgacggaggccattgaaataaccgaggccaagatcagcattgggtgaagtgtgcgcctccctgttaaggccggcctgtgttatataaggggaagtagcggttctgttctgattcggtatacagggaagtaggggctgcgcgatcctgttctttctcttccgaatcggaaagagacgcgtatcgggattcgggactctgttctcttccgaatcggaaagagacgcatatcgcggctgcccgtgccacgtccgcacctgtccactaatctgttagtctttgttcgctatctatggaaattaatccaaaggaaaatcaacccacgtggggtttgggttgttcccccacctgacacccaatccctccttgtgaatccccctatcgtccacttgcgcgggtggttagtgggattagcagggattatccctgggtttggatagaaggggattagaagggatcactaccattcaaaaataattcagaaatgataagaaaaaaattgatcgtgaaaacagaaaaaaaaatcaatgtgcaaaataactctaaaaagcccaaaaatagaaaaaagtagatttaccatagacgaattctgaaaaatagtccagaatattaaaaaaattcataattttggatagattaaattctacaagcagtaaaacatccaaaataatcatatgttttccatagatatgctagtcacagacaagagattgatttgtcatttacattgtctactagtatagcaatagattagaaattaagcgcatatatcgtcttccatgttcggccctgcatatactgatctgttgaaacagtacaattagagactcctaaatctgcagttctgctaattgaattaccattatactacgaataacagttctgcaggcaaaccccaaaagaactgacgaaactaaaactagtttatcatcaagcccttgaaaacaaacttttccttgtctctgaatttttcccaaaaataaagagagtttggcaactaccaccatcagcttccaaatccatcaaaagtcctgtctcttaatcttaaaaacctgaaaaacaaacaggaaacattatggacacctgaatagtcatatgaaaatttgtttggaaaatgacaattattctgtgttaatttggaaaaactaaaataagaagtgagttatcatctacaattctgggaaaaaaatatttttaagacaaggaagaaggtcaggcatgattaagcctagtacatatactcacaattttcagtttttaagcactcaaccatacttgctatagaaaacaaggactatttggacatataaagtacttaccctgataaacatcatctctacttgtctttgtctgaacgtaccagaaaaccagcgtctcatttttcatattgttcttccctgaaaggttaatctttgaatataagcacagaacttgcaatgccaacagttgcaatatcaacacaaatgagttatatgtcgatttgtccacagttctgcactacatatagtaataattgagctagtcaatgatattcatgtttttgtcatatctgtgagaccatgggcagtggcagcactgctgaatgtggtaaattcatcagatatatcatataattattaattatattcgtgatagagcaggtagctccttggaaaaagaaaagtatgcataatacctgttatatttgtgtttcttggagtatcaaccaataatgtaggacctgtccagcaaagaggaaatcggtcaacttcaaatatctataactacctgacaaattttcactcaagtttcatttgcaatttcctttggaatgtattacattacagagagtgcatttctaaagaattgttgaataggcatttcacacttttcacagctattatctcacaaaatttcttcagctaaactgttaattttgttgatcgaatcatatcaggtgaaccttcaatgttggaacaaagccaacgaaaaaattgatctttgcaagcagcaggacaagaagctgtgctctgcacctctgcatgagagaagcaactggaacaatgacaggctaatactagcacctaacactgaaatggagctgtctaattcacttgatcctgccaactgtcagtatacaaagggagatcgtgcaaaatcagaaagactggtttagcttctactcgctcatctaaggctttggaaacaaccgtgttgctctcctcgtcaccggaggagaagggcatagaaatttaccaggctaactagcactagaggatagatgagatcaatacgggttgtgtgcgtcctccccgtcgaggccgacactcttatataagtccgctgtagcgattgtcttctattcatattcgacgaggggacggtgttccgattcggtaagggattcggcgagggaagtagtggtgttccgattcggtaaagggtctgcagccgtcggattgccaatctacgatgtggtggaccttgttgtaatatgctggagtttagggtcttttttgcaaaaaaaacgctcaattcctatctccgccttctctcccaccctgccatggctgccgccgcctcctcttcatactctgctggtgcctctcctctccatatgcaccgctttggcacgcctccctccatgtccctagtgagagcactgcaaaccatcttcatctgaaatgttagtaacattgttcacagaatttacatacatatgttatagtttataaaatcagataagagatatgtgaattttgtgaataatgttactatcactttatcggatgaagaaaagaccaaaataaaagttatagatcttgatgatttatacaactttgttgttgatggctttttcagttgaaattatttagtatttgaaaatattgtttgaagttgtcatatttttaaattaaaattcaaattgttcaaaaaaatgttatatagaaaaataaccaaaataaaagttatagatattgatgagttatacaattttattgttgatggctttttaagttgaaatcatttagtatttgaaaatgttgtttgaagttgttatattttcaaattcaaattcaaattgttcaaaaaaatgttatatagaaaaataaccaaaataaaagttatagatattgatgagttatacaattttgttgttgatggctttttagggctgcaggaat

SEQ ID NO: 39658 - DNA, 8452 bp, Oryza sativa
caggctagctaggttggtgttagtttagatctgcgtaatactgccggatctgaacttgtttaccataataagacgtcaaatgaaaatattttgattgctgatatttccggtcttctcatggcattgtcttttgctcggcagcctgaagttgctcaacgcgcctaccatgctgccatgttaccacacttcctgcaggttatttacaaatacctgaactgatatgaattgtattttgatctacgcatctggtcttgtgactaatttgttgaatcctttcagcaagtgtgctactacacggaccatggacggttacagctgcgcgatttgcaaatcagcttatcgttctcaaggtgacatcatgccagactgaaatgttacaagcatcagaccaatgctttgattctttatctgaccttaacatggcttgcagacctaaggcctgcctctcacctcgaggcaatagtgaacatccacaggagcctaagctctacagtcagcagcatggtcactcagcaggaggctcaagctgatattcctggtacatactctgccagttatttgccccctaaattcacagaatatctacatcggaaacaaaatacttcgcactgatagttgtataaggtcgaatgctgattacgctggtaaaatatttcttctgttcagttgcaaagacatcatttcaaggaactccagaatcgggaaacagaaatggagcagagaaatctgatcaggtgaaatcatacaccccggttgcttctaaactggcatataaccagtcaactgggcttgcatatggaaatgtgcacggcgtgaaagaaagaaatcctgcattggagactagaggtggggctgatgtgactgctatgccacaattcttgtgcagaagggaccctgccgatctcaatcttctgatggccctagggatctggattgcgacagcaatgaccttgaaggagagctggtaatattctatctaagcaactccattgctaaaaaaaccttgtctttgggcattcattaattgaattcggatgtctgaatcttggagctgaactagttcaagtctaatgaatgttctgaaaattttcctttgcatgtgctaacttatttttaaatctcacgcatgatgcatgtatcattctgatagataacaagcagatcatctcctcaaagtgtcttgaaaagagaaccaaatacagcgaatgatgataatagagaattaaaaaggcaaaagtccactgatcaggatgatagtaagtcttcttttcaaactgctctcctttctgattagttagaattgcaaggtcactaatgcatatgcaatcgttgatacaggacaaccagctgttgctggtgcttggaaatgtgaattttgtcactcttccaaaaccactgaggtaagtcaaatggcaaaacctgaacattgtctttttcactattcaggacatgccttggattgcttttctatttcaagaatctaatataaagttggaattaacagagtactggccctctgtcccattatctgcatggtgagccattagaggataaccaagcatggaaaccaaacgttttacatgttcatgagaagtgcattgaatggtatgctccatccagcttatgagcttatttttcctaaatgaatacataattttatttgagttgtaaaccgataaaattaagtttgtatttttatatgcttttttagactgaagcatgtttatctagctagaatatcacctataattccttatactttttaatattgaagttactgataccaatgtagggcccctcaagcgttctttactggtgacattgcaaataacttggagcctgagttggcccgtgcttctaagatcaaatgcagtgtttgtggactaaaaggtgcagcccttggctgccttgtcaagagctgccgcaagagctttcatgttccatgtgcccatgggatatcaggctgccgatgggatgatgtaaatatttctttaaccttgcactgtccattctttttacagtctgaatgcatgtctttatttgtggcacaaaattatgtgaataagtgaattcatctcatcaaatgtactgtgttttaggagaactttgttatgctgtgtccttctcattcctcgaagaagttgccatgtgagagatcaaagtcaaaaaataagaagaccagcttgcagcggtttgttctctagtcctgttcattgtaactgcattttgctataccttcatggctgcacatatccttaagttgaaccttttccctttcttgatttgccagatcatcttccgatacaatgcttgatgacctgaactcaccatctacaatccatatggatggactttggactgcttcaccttttctcactagtgaatgggttatatgtggatctgctctctctagtcaggagaaggtgattaataggtatctcttatctaattacaattttaacaggctattgcatgattaggttgtttcaaaaatgtaaactttctttgtttggaacttgacaggaaatcttggaccagtttgagcaccaaactggcatcactgtaactaacggttggaggtcgaatgtgactcatgtgattgctaatacggatgaatgtggggcatgtgccaggacactcaaggttctcatggccatactagctgggaaatgggttctgaatataaactgtaagttcaatgcctctgaaaattaagacctgggtttacctggggataatggtttctgctcttgtgcttttctaacacatccttgtcatcttttagaaattagacaatagctgatggattttgtcacttcttacatgtagttctcttttcatacgcttaaaataagttgagcatgcttaccacatgaatatttttatgcttgcatttacaatggttgctccattgtaaataccctcttctgctaggaagtttctctgattcatgttattgtgtaatatttagggctgaaagcttgtatggaggctaaagaaccagtcccagaagagccttatgagatcagttctgatgttcatggctcctttgatggccctcgcatgggaagactacgagcaatgcaaaatgtgtgtataaattcactgagtaaataagtcaaagtacaagttcaatcttcatggagtattgatcccatgtgtttcttgttttctaggcaccacatctgtttgcaggattgaccttttacttcagtggccatttcatgcccaattacaaggttcaccttgaagatttgatcactgcagctgggggatcaatcttggacaaggctgatctctctagcacatccttgataatttacagcatggagccaccacaaggaagtgatcctgatacccttaatgaggtcatcagaaagaggaaggctgaggctgaagaattggcggcaacgattggctccagggctgttcctcatacatgtgttctggattctattgcatcatgcacagtgcaattgaccatgtgatgctgtatcttaggttaggagttaggatgttactgatatgttcttgagtgaaaatatcttctagatgttgtaagttgtaacgtgagcaagcaatttaattcaaataatattgatatgtctctttccattttcttgtcggtgtcgtcatttcatatgtttcacctaccggctaccgccgggcgcagttggtctaatatttattttgcaaaaaaggtgagccttgcaggcagggttactcccaaatctgcttgagttgattggggaaacacctacttgccgttctttttctttttaccaaaaaaacaaaaaaaaacttcttggcggatttgaatcacatcagtgcttcggtgctactagtattcaagagttcctctgttcagctatggagtttaattattcactgctacagggatgatgggcaaaggcgtcaaatgattgtggagtgcatttgaaacaaagcaaggaattgaaatggctgagctcagctggttgcttcagatgtttaccaacaacagtagaggtccccttcaggctttcaagtctcaccagtcagacggtcaccggtgtccccttgctgctgttggtgtcccatgattttgttcttttcaccagaccctcgtcctcgtgcagtgatgtagaagcacttctgcatcttctcttctcccaccactaggcccctctataataaggagccagcaattgatgctatgcggtaacagtgctagctccatggcgttcttcagcagcggatcgcgggcgctggtggaaatcctgacgggattgcagaggtgcgttgctgttggttaatctttccttctctttctttgccagtgaaagcggaaatcttttttcgataattgaattcaatccagtctctacattgaggtgaaagcagaaaagttgtctgtgtgcaaaggttggctgcctgagttgtgccgctcctacatacatacatggattggttgacgcaatgtgatcagaaaactatgtttctcttgatctttgcagtgttgaacgacctatgcctgttgatcataccttgtttgagtttggatcaatccgttaccatttacaggtaattttgctccaaacacctttgatgcattatcttgcaatttgaaacaaataatgtagggcatggaaaatgatcatataatacgcatcaagtatcaaccaaacagaacatctcggcacttacaatttgcataattgttcaggcttctattacagattcagagaacatatacttgtcaatatcaacaccatctctttcttatgaggcttcgccatccagcggcttgcctgaaatcacattacaggagacaaggaaaatgtatcacaagtttgcagagatcatcgagcctgcaaaagaaggatacactttgacactgagactgaacttctctggccttactcgaccgaaaggtatgagcatcctcagtcctcacaccctgtttcagttgctgtatttggtgatagaaatattagccaaggcaactgcaggtctgcagcaaacaaggattcgatgtaagaacgattgctctttatgcagatcgcaccaaggcgatcaaccagatatcgttgctgcaatccgtcatccttagctcgcagctcaaggacatgctggcgagcctcggctcgtccggcacgatgaagctcgtgtacaaccaaagggaccctttcttcgtcagcaaaacggtactatcctaagctacgcagattaacaaaagcttcacaggtagagcaaagcatcagcacggctcgctgacgatgcggttcttggcctgcctgcagccggtgaagataagcgccatattccccatgcgtttcagggacgacacggacctggccatcgcgtcgtcgttcttccaggttgggccggcgccttctgtacgtacttttttgagttttctggttagctccgagacctgaagaaaaaaaacgacaggagctacaggacctcgggagcacgtcgtccttctccagggcgccgcggtgcagctggtcgccgatcccgccacccgagctgcgcggggagtacgtgcaccacctcaccaccaacggtggcttcgtgtccttcggtacgtagcagtagcacatatcgcacgcggcatccgcgtccgctcgctcgcttgccccgcaccgcaccaaccacgcatattctccgtttcgcccccacgcggccacgccacggcaccgtgccgacgcgcgcgttttgtgtgcgcccgcaccgcgcgatcgcgagaggccggcctccgttccgcggcgtcggtggcgactaccgacgcggccctcgcgaaacgaaacccgcgcgagcgggtgcgcggggcaaagtagccgatccggacggacgaggccgcggtgcccgcggcttgggccggcgcttcttgggttgggttgggttgggtacacttcgactttggacttttggagggttgacgcgtgcgggtttggaatttgcagacatcctggcgcggcacgtgaaggggaggagggcggctaggacggcgtggatcctgctcaatttccagtcctacgtgaaataccatatcaaggtaggatgcggcatcgcacgctggttttgtgtgctactacatgattatatcggcgttttaaatttactgggaatggtgtggttttactgacggcgagaaagttcgtgtgcgcagtgcacccgaagctacatccagagcaggatgagaaagcgtctggagatcatgacagaggtaacaactccataccatttaaaagaaacattgggtatcgaaggagtggcaattgctttaaaccgggctcgctgtgcttcaggtgatcgatgacgcgaagttcagaggaaacgatgagagcagcaagaagctgcaaggtattagtacctggatactgcaagctctcgatactggctcactggctgaccgatcttatgctcgcgaactctgatgtcgcagtgaggaagagaagcaagagaagatcaatcaaattcgcgagagccaaaaagctccaaaagggtttcaaagctgtcatcgacaagatcaagcggctgcggctgaggatcagagtgaaaggcctggaccggttcaggaggcactgccagtgcttcccagtgctcaaactgaccatggcacagaggaaggagcagaagtaccagaagctggagtgaatcctaatcaactttacgactaatcacttttttttttcacagcacaggcacaagcgtggtgatacatgcatgctgactcttatcctttttccatactgatcaagtatacaaatctggtgagtgatgaacatccattcagatggagggcactaccatagaaaaaggctaacaggaggacagacagtacacggttatttaaaaaccgttacatatatctaaaaaatatcatagacgactatattaggaattgtctatgataaaaagcatctagtgtgttttttttcttttgaaaagcacgaatgtgttttttgttattttcacttgtggccaatcgtgcattggattgtggaaaacatgcattttcacttgacgtacgtcaggcagtgacaatacctgttcgcaactgtggttgcctctacatgattattatgtaccttcagttccaagtgtactccctccgtcccataaaaaatcaatctttcgttgtattaaaatgtgtcacatccagtactaaaatatgtcacacagcaacattttcttaattattgtgtgctctgttaaaaatgaaaaggtactgagcaacatgaagcgtggatttcattaggcttctggagtgaaatatgccagcttaaatacatttaaaccttcctctcaaaattttagcataggcacctatataactctaggcagttgtgaatcataacaaaaggcatactctaatcaatgattcctaaatattgtggaaactttatctatccactggattttccgtagagagagaagaaaaaaaaacacccatctggacatcagtaactcatcacgtagaaactgaaaggtcctcacgagaattgagaagtaatcactaacagtttcctattcttattttttcaggcaaattccttcgaaataaactagtatttatgcataaatctcgatatatgattatccagatttactataaaagtttatttattttaagatggaggaagtatgcacttagtacaagcaggatgcaaagcttcttcatgtttacctaaccatcttcttagggcatgttctaaagtgtgtgtttgaagacggctgattagctgcaatgcaaaatgagaaatatgctacggctgattagctgccatgcaaaatgagaaacatgtagcatatgataattaagtattaattatcaaaacttaaaaaataaatttattttttaaaaacaacttctatataaaagttttcgcgcaaaacatattgcttagcaatttaaaaagcgtgttaacaaaaattgtgacacaatttagaacgggcccttacaagtaattgattgctccgattctaagccttcgttcacacagtattggagtagttctggctcaatcctaaaataaaccagcctcgtactaggatgtaggatgtgtctggtttattttgagatggaaggagtacatctaaggccgtgtttagttcaccccaactacccccgatttccaactttccatcacatcacatcacatctaaaactttcctacacacataaacttacaactttttttccaaacttccaactttccccaaactttcaactttctgtaggaactaaacacagcctaaactgtaaatttctttctgaactttgatttgactgcctgggggtttggattgcaagaattgcagataacatcacacccttgtttttattttttgtcttccatatcgcctcttttagtactatttcccttgcattcaacaagaggatctatcaagaagtactctacgatgcatcgaaataggaagcattcacctctcagaaggg

SEQ ID NO: 39659 - DNA, 2139 bp, Oryza sativa
aaatgctaccgaagagcttaccagttagcacggtcgggtgagggagctgcttgcttacctttgggtgagagaggaaagacactgcccatcaccatggcgacgcgaccaggccctttgaccgaatggccatggcaatggatggggggctacaaggtatgccaagaatttgccagcatgtcctactccttccatacaggatgtcttgttcgagaaatatattaaaccaactccaatccatttaccaattaacatgctattagaggattgcacaaaccatcatcgtttagttttcgatttttcatgaatatattgatggatgaattagtcgtcgtcgttcttgtttctttagtacccttagtagttcctataccggtcatatttcttgggttatttacaagcggtattcaagtaatgcgtgatcataataatgtctagttgaaggagatcaagagaattaatcaatattagttgaaatattatcaaggaaaaactaatcattaccagaatgatggcttgaacatgaatttgagccacacggggttctgaaacaatggaaggtctccatgcattgtcaattagggattgcagcaaatttgatttccatagggtcaacaattggaccatgctcaagcatatcctaacaagttattggaaccgcatacgttgcatagatatagatcagaagctgtctttctcgtgttcgtgcatttttggcccgcagattattttcaaattgtgtagttacctcacttagccatgatatgatttcttgttagtccaacaatatattccatctccacacccagaaaaaaaatgcttcaagaaaacgatggaagtaaaccatggtgccaatcattcgcccaaaatatatggcaggtttctttgcttgcatgatctgatcaatactgacagtaccatcgtccaacatgtgcccaatctcctctgttgacgtctcagattctttggctcaataagttgcacaatcgccaaatgacataagtaccagccgtctaaatatggcagtagctgtacatttcaagcagtttcatgattcaactgaactgacactgtaaactgcaaatccacggtgataaacttgatgacgatcaactgaaaaacctttcaaagacaagatgtcattccaacataatttgttcccaccacccagtacttgaccgaatgctttctgtccatgcacagtacctggtcctggctcctgtggccatgcacacggcacacaggttggccaccaaggggtggggagactttgacccagcgtacactttcatgttgccaactctgctgctgaggatgatccacaaccagatctggatcagtttgtctcgataccagactgctcgcaggaagcacctcattgttgatcgcagtctcgacttcgagcaggtggaccgagtattatacttggcatgggcacgggcaggtatgcgatgcccaagtaatccttgcgttggtgggaaatatctccactgcaggcaaatctactcgtgttaattgaaatgatgattgatccttgctattatgtgcagggatgatcagatcatcttgaacggacttctgttctacctgggctacgcaatcatcccgaactttcgcctaatgccagtgtggagaaccaatggagccctcatcactatcttgcttcacatgggacctgtcgagttcctctactactggtttcacagggcactgcaccaccattttctctactcgcgttaccactcgcaccaccacgcatccatcgtcactgagcccataacctgtaagtaacgacactaaaaacaacaagaatcaacacaatgatatatccaacttattctctaaggtggtgtttgggaagaagggactaaactttatagtccctctcacaaaagtataagtccctcctatagggattaaaatttttgtactttagtccctccttcccaaacaccacctaaatctacaactagatgcacaaacaacgatgcctcaagaacatagttattatccaagagctttaaataggaataaataatggcaacatgaaatggcgaacatggaactgatcttcttgtttattgattgtttcagaaaaagcgcggtaaggttttagaacatttttacagggctgcaggaatt

SEQ ID NO: 39660 - DNA, 3011 bp, Oryza sativa
cactccctctcccccaccatagcgatagtacacacatttgtcagcttcgttcacaataaagccagtagatgtaagtgttgtgtcaaacttctcatgccattgcttaggtgctttcttaaggccatataaggatttcaacagtttacacaccattccctcctgaccttttagtacatatccgtctggttgattcatatatatctcctcttctagctctccatttaggaaagttgtcttaacatccatctgatggacgagaagaccatgagaggctgccaaagcaagtagtactcgaatcgtggtcaagcgggcaactggtgagtaggtgtcgaaaaaatcatcgccttctttttgggtataatccttggccacaagccttgccttatacttttcaattgtaccatcaggcctaagctttttcttgaaaacccatttgcatcctacaggcttgcacccatatggacgctcaacgacttcccaagtaccattagacataattgagtccatctcactacgtaccgcttccttccaatagtcagcgtcaggagatgaatatgcctcttctatggttcttggagtgtcatccacgaggtatacaatgtagtcatctccaaaagactttgcagtcctttgtctcttactctttcgagttgctacaatgttatcctcctcaggattttcctcaggcgtttgatcattgtgttttatcggtgcaaagtgctcatggggtaaaacaggttcttgactagacgtgctaggtgtatttttcatgggaaattcattctcaaaaaatgtggcatctctgtactcagtaattgtaccaacacgcatgtcgggtactccagagtttactattaaggacctatagcccacactgtggatagcataaccaaggaacacacagtctacggtctttggtccaagtttacgctttttggctataggtacatttaccttggccaagcagccccatgtgcgtaggtatgagagatttaatttcttcctttcccattcttcgaatggtgttacttccttatgcttcactggaattttattcaggacatgacaagcagtaaaaattgcctcaccccaccattccttggaaagtcccgcagtgtctaacatggcattcaccatctcagttagagtgcggttctttctttcggctaccccatttgattggggtgaatagggaggtgttctctcatgaataattccaaactcttcgcaaaaggacgtaaactcattggaaaaatactctccacccctatcagacctcaaccgtttgattttcctttcaagttggttttctacctcagctttatagatcttaaagtaatgcaatgcctcatcctttgttttcaatagttacacatagcaatatctagtgcaatcatctatcagtgtcatgaaatatttctttcccccattagtcaacacgccgttcatttcgcacagatcggaatgaactagttctagtggtgccaaatttctcgcctcagatgccttgtgaggcttgcgaggttgtttcgattgaacacaagtatggcacttggaacctttgaccaaagtgaattttggaattaaactcatgttagccaaccgcgtcatacaaccgaaattcacatgacaaagtcgcgaatgccacacattggactcatcgttctcgctaatatggttcacaacattattattattattacacatgtcatccaaagaaaaacggaacagacctccgctatcataaccttttccaataaaagttccatatttagatacgacacatttattggattcaaacacaagtctaaaaccatctctacacagtagagagccgctaactagattcttctttattgaagggacatgctgcacgttcttcagctgcacggtctttcccgaagtaaacttcagatcgaccgtaccaacaccatgaacaaccgcaagcgactcgtttcccatcaacaaggaggaacctctcccgacctgataagaagaaaacagggaaatatcagcacacacatgaatattagtaccagtatcaacccaccaatcaggtgaatgaaaaacagagagaactgtaggtaaaaaattaccgtaccccgatgttcctccgctctcgctaataaccatgttggcagacttcttgtccttgcgatcaggacaattcttcgcccaatgcccaggcttaccgcacacaaagcagtcgcccttggcctttcccttgcctttcttcttaaaattggttgtagcctttggtttgacatcaggcttgactttcttgttgttgttgttgttgtgggatgcgtgagggttcttctgttgcaccaaattggtgctagaacctccctcgatatttttgccccggttgtcctttgctctcgccttctcctcaacacccaaagagccaatgagatcagtaacactgaactcttgcctcttgtgttttagagaagtagcaaagtccaaccaagaaggtggcaatttggcaataatgccacccgccacaaacttgtccggcaactcacagttgttgttctcaagtttctttgccagcatctaaatctcatgagcctgttccactacagaacggtcatcgaccatcttgtagtcatataacatctccatgacatacagctcgctgccggcgtcggaaactccgaacttggcctcaagtgcatcccacatgtccttccctgaaggcatgtgcatgtacacgtccactatattgtcagcgagtacactgatcaatgctccacggaacaggcaatccgaagcctcgaacttagcctcctcctcaagagagagaggcggttcacttcgtttgccccgtgaaacatagaagcattgcatcgctgtcaaccacagtagtgcacgtgctttccatctcttataattagaaccatcaaaagcatgtggtttcagtgttgcagcaaagccaactaccgaaaatgacctatcaggtttttggattgttggaactttggtcataattcggcatattttaatcc

SEQ ID NO: 39661 - DNA, 990 bp, Oryza sativa
ttttttggatgcttaatttgggatactaatatttacaaattttaccatgttggttttaatttttctaatgcattgcacaatatgatgggattcactaaccaagctaaaatttatttgattgttgcagagctgttgtcagtcagttggttacaggatatcttcccagtgtcattcttcactttctttcctcttatgtgccctctataatgaagctgttttcaacaatgcaaggattcatctctgttagtgggattgagagaagtgcttgcaacaaaatgcttcggtttacaatatggagtgtgttctttgcaaatgttcttactggctcagtacttggtcaactcgagatattccttgatccgaaggaaatccctaaaaggcttgcagttgttgtaccagcacaggtacagcttgcatttattgttgcctttaaaactgcttagtgagtgaaaaagctctttgttttgtagatattactgtgggcatttcaatgtaaaatctgctttcttaaacaactgtctcttgtgtagtattgtattgatctcttcctcaaccgtgcattgctaaactgtcctttgtttatgctttgctctacaggcctctttctttattacatatgttgtgacatcttggacaagtatagcatcagaacttactcaaactgctgcccttttattccatttgtggggtagctgtgcaaaatgctgcaagagggatgagtccaaacctccatcaatgcattaccatagtgaaattcctcgggttctcctgtttggacttcttgggctcacatacttcattgtatccccacttatcctcccatttgtactggtttacttctgccttggctacttcatatatcgtaatcaggtgagagtgttgcagttcatttatcagtactttataattttctgttcttctactcatggagtctttatgctgtaatatacctggttggaatttggaaggacatattagtacctaaacctg

SEQ ID NO: 39662 - DNA, 723 bp, Oryza sativa
aagatgaacaaacacaagcctgacattctttttttctgaagtaaacttttcaaaaccaaatttctgaagaaaccacatcttcactgtcttcccagtgatgatgtcatgggcattgggccgtaggccaatgcctatagatagcccataccaattaagttagagataatattgttagttagttagagataatataagattaagtccttacttaaagatcaagttggtaccatctatataagaatgggattgtgtctattatgaattaagcaatgaatatcaattagtctaatctctccctcccaaacaatgttcttctccctagcctaaatctacatcccttctctaggagctgatgctgcccggctattctcccgacgatgtttatctcgtcatggcctcgggtcatgacagatgattccttcagtggactctgaacactgaaacagtacagcactacactacagctcatcagaaaaaacattggaccggataggaatgtcataggatccagttcccaaacatttgttcaagatggcctccagctatcactcatatcagtggatgcatggcgtcatctgcaagaacagtaggtagagccatccttttccatggtagagtgtagactactatagtagtagcacttgctacattggatactgctacaactctagtgctatccagttgcacaagaatctgttcttcctcctactaccaccaaattcc

SEQ ID NO: 39663 - DNA, 5104 bp, Oryza sativa
  unsure (1)..(5104): unsure at all n locations
atacaactaacaatattaccattcaaaagctaacatcatttgctttagcatgcaggagtgtgggggcaaattgagtccataagccacaaaaagaaacaattcattccatgatattcattagaagttctggcttacatcaacttctgtagaatacaaccaccatctcatactaaataaagagagatgtgaaggaaggacagggaaaaaaacaaccagagacccatcatgataaccctaaacaaagagcaacagcaattcagaactcttaatctttcacctaaagttagttttgaccggagactatcaccaaccaaaagcacactggactgctaaaatcagaataaaatcactctcaattgccagagaagaaacccttcttcctcgctgggctccgataaattagtatcgctataagagaaagaacagcaccaccaccatgatcccttaccatgtggttgggtgcaggatgagaaacacccctcctggttcttccacaaggcaccgacaaaaaaaaacgccagaagttactaacaactacctactaccatatatctgaataagataggtaagggttcttcacaataggcctcctcagggatatggaagaccatgtgaattccttaagcttcctatttacaggacatttggaatttgcaaagctccaaatcatcctcccttggctctttcttgctaccctacaaccatcaaaatgagtcagtagcactggcactgcaagaagcaactatgaacagacagcaaatcacttgaaatctcgctgcagtgctccgctccacgcgacgttgtcgtctgccttctccaacgcggccaccttagcactatggcattggagaagaccaaccttgctcttctcgccatgaggaagctcgacggtctcgctgatggatccagacttgatgtcggtgggcgggatgaagcaatcgatggagaggccagggacattgaacgcgacctcctcgatgctccatgcctcctccatgcgagtcttggtgtggctcatggcaacctctccgaaacggaagagggtcacagcggagcgaccagcgtgcgcaaccattataccctccaccgggcggtagtcctcaatgaacgaattgatggtggtctcccagtaaactgcgtcccctccggtggtggactgaatcctggtgaggtgagaatcctcaagatgcacaaggaggccagtcttctggctgaaatacccaaagagaacatgccggatgatctccgcaagcccctcgctgcgcgcccttagcgtctcagggtccgcgcacagcttcaggatgaagcaatcctccccattcaccttcctctcgccaatgcaccgcgcaccggcaaacatgctcgccgcggtcagaggatccaagccctgaagatacaatatgaaccaacaacaatttcagttagactaccaccttcttccaccatatacacacaatggcacatttcagacgacatcaaactacaagacatggcaggctccccggtgtgctacctggagtgcgcggcggagagggcggacggggcccttggcggaatgcgcgccgagccacggcgtgtggcgccacacgagcttgccattgcagccggcgtgcaccttgctcccgccgacggcgagctcaatgtaccacatctccggggccatctgccacagcacgaaccggccggactccgtggcgcgcgccgccatgcggttcctcaccacgcggccgccggtctcgaactccgtcgccaccatcctcaccttgcccatggcgtacgagttcctcaccgatgacagcagcttctgccccccggaggcagccagatactgctgcagaatgtactgcgccgacgaggtctcctgcaagaacacatcgtaatggtaaaacttacagctacaacaaaatactttttacaactacatcaaagagttgctgatttcttttttctttcagtaaatgggtaactgaaagtgaaatggtagaacactacatgaggaataaaccgtttgtacagtggatatgagaaaatgtatcacatccaaacatcacatcaagaaccagttcttcttctttctttttcttttttttttcatattgtttcttcctaacgaaccagcaggtttttctagaagaagaaataattgaataggtggcgactttagaaattaattaatccaagaactcaaaatccacaaaaaaaaattcaccgaaattttcactcgagaggatttcacccaagagcacttacaatgggggtgtccttgatgctgaggtgggggagcggctcgccggcggcgacgtgcaccggcgcgagcggcgcgcccatgacgccgagcagcagcctcaggtcgttccgcctcgccgcgccgccgccaccacccgccgcgaccaccgccgcgccggccgtcgacggcgcgcgcgacagctggccgcgcacccaccgcccccacccttccctcctcgccgccgccgccgacgacgacgatctcccgccgtctcccgactccggatccgggccctccatgagcggcgccagcatctcccccccaccaccacctcccgcgtaccgcagcgccgcggccacctctgccgcggcggccgcctgcgaccggcggcgagcgcgcgccggcgagaggccgcgggcgacctcctcccggagcgcggagaagaagccctgcttcttgtccatgggagggacctgtttgtaaatacgagaaaacaaaggggccctcgcgcgcgtgaagaaccgtgagggggggaggacctgaatgtaaatgtaagagaagccgagggggctacgcgggaaatggcagtggagcgaggagtgtgtgaagcgaggagactgcggtgggcttatacggttgccagtgtgctgcagtgattctggtcacctcccatggtgaactcaccccccttttataacattggnggnnntannccanncccatttnaannccnnannccnntanantttttggtattttacctagcactgtaatttttctttttcaccttcttctactcttggggtgaaaagagtcgatgtcgattaatcggaatgacggaatttatgcggtcggggaacgagtaatgttgacgatatcaacggtacataatgggttgctcactgaacctgtattaatagtcgtactgaattgtcttattttacgaccctagcttagattagatagggtattgtttggagtggttgtggtttctagtttgactttgattgaatgcgcggaaggattctggagggggttaaatcttgaattatgagaattttaattagacatgcaaccgtacaagaaatgtagggtttgcttaagcttcagaacacgcttcttcgattggataataagacacacaactcaatcaatgttttgtcatgtcattctgttctactatataaattatattttggataaaaccaaaaggatgacagtgtatatatgacattagtatacatattaaaatgaagaatccaacctactcttaaaagaaaaactaaacctattaatctttatgttgagacacatttttttataacgatcctcataatcaaccatactattttaacacctaacgtctgtagacagtgttctaatggcggttagaattttccaaattatgaattgtaaaacgaaaagtaacatctaattagcttctggttgtgttttattgtcctaactgtgttatgtataaaatcaaaacaatgacatgtagatatgatgttgctttacataatactagaatagaacctaacctattaaaagcaaaactaaacctattaacctttatgctgagacacatttttcaaatcaatccttacataaaaaaactatatatataaatattttttattattttaacaccaactactgtagatagtgatgtaagggcagcttagaattttccaatatatgaattgtaaaacaaaaggtaaataaaagaaaatgacaaaggtgatggagccaaagcctacccatcaccctagtgaggtgagcatagcacactagccagacctgccaccgtgggccccacactggggctcgccgtcccatgacggcgccgttagcgaagcttctgatgccgggcggacggaaaagccaccaattaacgccgttagcttagcggcagcacgtgacacgcacgcagggctcacctggaccggacagggtctcttttgctccctgtttccagcttccacttgtgaaatccgtacttagattagattagattagattcaaagcactttaattagctttcataagtgcctctaattagctttgcttagctttgatcactcaaagctaaaaagaggccacaccctggtcttctttaccccttctaccaattatggtgtttcatgaagcagatttacagatttatatagtgtgaagatgctgttcgggttctctttgcaaattatcgagaaaaaagaaatcaccaaattaggctgtccatgaagaggcaaagtcaagttaaacaagaatctaaccgtacctaacactctcaaggtggtgttaatatatgcgacataattaacaatgaataacgtgcttacgtatagaaaatcataggtgtgcttcttagaagctaggatttcactcccgaccgttggaggacagcaagaatatttttttagttgcttcgaaatgtgcacaaatatgtataaatagatttttaaccattacgaggctgacacgtgggttcaggttaacgggggctgggtagaactaaactgatgaactcaccaaccagctgaactctaataattttgacggattttgtccgtaccctctagcgcgaaaatattgtgtagatttagtatatttgatgctactcgtggtgtctagcgtggggttaattatgtatttagctattgtttggtggttaattatttcatgagtcattacttagccaatgaaactatctccatcaaggagggggacttggcgtgcgtgcaagctaggttgattaataattagtagtacttggtttggttggtgatgctaattgatcatcaatgcacgctcaagggcatgatcataagagagtgtgttagtagggtcacatgataattaagcagagcatgcaca

SEQ ID NO: 39664 - DNA, 13835 bp, Oryza sativa
agcatcactgtgcacgatctctaaatttcgatcggctaattaattgtttttttaatgcagtaaggttgacccctcgaaattattaagttggatgctgtctgagaaataattaaagtattgggcagtgtttttctcgtgtgttttatttacttctagaactgaagacaataagagcaagtttaatagtatagccagctactagctccaattcatatatagccaatctaatagcttattcatacaatagttatgtactacactattaatacctggtcccacctgtcatacacacattgtgtcttggagtccgtgctacagctggctacaaatctgtagcccgctgctcttctctctccttatttatcttcttaaaatatattctccttatttatcttcttaaaatatatttgtagttggcttatagcctactattgtacctgctctaagtgagtacgttatataagaaattagccgagtcgtgccatatgcagcaggatatacctatatataataccttagagagaagagttaattatatcatgtttattgctgaaaatgatgctgggttaattaattaattgatgagatatggggttactgtaacaagaatatatacgagagcaaactaacaataatactccatctaagcatacgttttatccaaatatcatactagtagtattatttatcgttctatcatataattactttccatatcaattccaaataattgatatagactagctattcgagggggtcaaacagcacgtactacccactctgcagacacactttagagatggccttccatcttaacatggactgcagatacacaaaaaaaatgatacatactcttaactggatagcacaagaacatataaaaccgagcaattgggatccattcataactgcaattgggatccattcataactgatggacgacgctggcaaactgcaccataggacacctaggaaaggaattcgcaccctactactcctaacgtcttgggagatcgatatggaattaaggagaggtaccaaagggtgttctagcataaagagctcttgactttagttctcgctgcaaaaatcaaggaggctaaaacctggaccctagcatgagcggaacgcctagcgcagatcttaccttcgtttcctttttttccttgtaaagttccgtttttagcagttttttctcatgtcatattcaatgaaattggtgcactttaggtactcaagaaaaatatttaaatactctgatgtcaattaatgtttactctgctgcattaatttatgtcttcctcaattcccttttggcttcttaagccactagttaaatactcgtgtttcgctatagattaaaataaattatacatgtgtgttaatattaattgcttgaaataaatcgtatgtaggaggactattttgtagtattaataaagcagttggtaatacaatgctctatacattagagttaattgctagggtgacaaccattatcttcttttgaaatgatatatagatattgatttaatatcctatttatatagttcacttcgtaagttaagatgccaattttgtgaaaagaaactgactggacaccattcgcccatatgacaataaattaagggttaaatcgcgatgaaaaccacccatccattgaaactacaaaatcatataacgccatctgatgggtatgttttagtaatgtccacccatacaattgtgtgggcactccaacaattgcgtgaattcacaagaaaattggcatcaagtgtcaattaataaccatccatttggcatagttgtatgtagcacctatgatatatcataatcatcctagcttgcttaattgattagctttctttcatccccagctgtactctctctctctctctctctctctctctctctctctctctatatatatatatatatatatatatatatatatatatatatatatatatatatatatatatatatatatatagacacacgcacacacacacacactcctacatatagattttgatcactgtcacaccattgattaccaacaatgacactgagcatatatttagcagcagcagtgatgctcaagtgtagtgttgggagggaggccactttcagctagctaagctaatcttccagttggagagccggccggctagctagctggcacaaacaatggttaatctcttaattaattaccatgacagctagctccattaacctcagtgcacacgcgaattaattaatgtgtgtgtgacctccaaaaatatttggtatattaataacaacaaaaagttgtataccaaacttaatagtatatatatatggcttcatgaatgctgattggaccatgcatggctggccctgcattttattgttaacatatataaactcctaactattgtgggcacatgcgtgcaagcaagctaaaccaccacacatttataattaagctaaccgttaggaattataatttcgcaaaaataacatggaatagtgctggcttttccagatttccatggccatggaattataatttcccttaatttccagttataaatgtcccttcatatacgaggaatattaatttggtcttggacgaagcccggtctaattaaataaacatttaatttgggatatatatatatatatatatatatatatatatatatatatatatatatatatatatatatatatatatatatatagtaaatttgtttggtgctccatggtgcccgggcaccattgttgaaattgagtatatatccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatgtatgttgcgcagcaaactgcatcactgcaacaaatttaatctgatcaggttgttgaaaagcaggtatatatacatatccatcactaattaatccacatgtataaattatactacctaaattaaaatttcaagttacatgtgtacggggtgcaatttttattagcaaattattaatgaaactttgcaggtggggtcacgtacaagctagaatgacggcatatgacgatgcatgtcactgttcaagaaaaggaacagcttaattaattaattgaacttgtaccctaattgctacaaaatccaaccaccattatcggccttggtacggggttacggacgcttaggttttaaggtgcctgctggctgtactgttaactaactctgtacagcatgcacaactcagggttaatttacaaactttacaacttattttctccgttccataaaaaatcaatctagtaatgtatgtaacacatcataattcaataaattagaacatgtttttgtccagatttattatactagattctttttttataggatgaggattacaaattaaggggccacacacccagctacagtagtcctcatgagatctgcctcacctaatgcagagatggccaatgtcctcctagcctagtagcttagttttctgctgaattttatgagggcaattaaggttttaactagacatggatgatctcttcgggttatactgtacttctttgatttcaccatcaatgttcgttactgcaatgtatccctctccccaaatactgtactttaaatgttacgcttataaacatttataagttgtctagcaggaattaaaaactacttttcaaatatgtttcataatataaggcgtgcgtgcatgcatgcatacaattaattactccttccatccctaaatataagggattgtgggcgtatgcgacatatctcttcctgtccagattcgttgtactagaatgtgccgcatctgaccaaaatcccttatatttagggacagagggagtagtatctttatctcccctaaattattgttttctaaatcatacattctcaagatctctaattctattggatgcatgtattgtattagtttaggttattcaaatcatgatgtgataataattgtttcttagtctttaggttatggtcttataggtggttatgcctaatattttaggaatggagggagtattgaataaaaagactattgtgtctctcattaaataaggacctccattcctaaatacttataaatattactttctaccctatttagtggatccaaaataaaattaaagggatgactcatcttcttcctcctttagcccctcctattctccctccctttctcccttcattctatcattttatcaatatcgatctaacacccacgccagatcccctgcgagtagaataaaagatattgcgcacctctcattaaataaggctagatggtttgggaaacagagagagtggttggtgatagaaatacactagctagtagtagtactcatctaaaaatgcttttcatatttacgtacaaaatttaaatcctacaaatgtatatttggaaactgatgcaacaaaaaattgtgacttgtgagtatatatgaactatagggccgtaaaattgtagctttatattacacaatcctttaattgggacagtattatactactccagaaaaaataacttaaatgattaactaaacgtgacacgtttaaaattaccagaaaaaataattatcagatctgacacatgcagttagcaccacaacagtaggagtattaatttggttagattaactcaattagttaatgcgtgcgtgatccttacttaaatgcggttgctcccctggttggtcaaagagtctgcagcagcagcacatacagctagcaatggtcggtgcagaaaagtaaaatctggtttatagtcaatcaatttgcacggttaattaatcatctactactagcatctctgaacattttagtcagaaacagcgaggcaaatgtacatgtactacgtgcaagctagctagggtggcagaaggactgaaaaaataattttaacagcaacacattctcttttctttgggggtccaaccataatataacgtgtgtgtgtgttttcagttaaatattgctttccaatccaatggtccagatctgtcgttctatgatgtctattggaggctttactcattacacacatgtatatatttaagttcactgaattttgctattgatcaagtcaaaatattacatatcctgcatccaaaaaagctagcccaagtgcggatttagggctcggtgagacaccgaatggttacccgggctcgcagggcccaaacattgaatatatatatatatatatatatatatatatatatatatatatatatatatatatatatatatatatatatatatgggggcaccatggtgcccgggcaacatggtatcaaatacacaaaatcattcaaatttttcaaaattttcaaattctgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaaatttcatactcatttgaattaggtatatactcaatttcaacaatggtgcccgggcaccatggagcaccaaacaaatttactatatatatatatatatatatatatatatatattcaatgtttggaaataatcatgagagatgaaattagataaagttctcatgagatttactagaactcaggcccgggctatggtctaaattgctcaggacctggatctgttcgtgttaaaagttacttctttcactttttttttcatatatgacgctgctgagtttttgacaaacttttgactatttgtcttattcaatttttttataaataatcatgttaaagaacatttgataataaatcaagtcacgataaaataactaataattacataattttttttgataaggtgagtgatcacacgtatcttaaaaaaatttatggtgttatacattggaaacgaatgaagtaattctttttgaaaggagacacacaccaacatgctccctcatgcatatataggggcctcagccctcatgcatggtcggctgcatgcactctgcaaaagtacttttatgtatatatataaccaagattatattgttcatacacgggaggtttgttaattcgttagcatatggacactacatgcaggaggaccatggaaaatcgtctctctatctgtctcactctaccaaccgtccggctaggggcggattcaacgtgggtgcaggaggactcaagtcaagtcccccgcactcaccggatctatggatacccccttcaattttttcgtcatggttgataagatagaagatgctaaaaatctcttaatagcattttaatatagtttaatactgagatgatgtgtttataccggtgtactctggtatgttgagggacgtactctagtatgttgagtccctcaaactttttatttctggatccgcgcccctgcgtcggctgaatatatagttaaaaaatgtgttgggcttcttgaataagattgctacacgtactaccctcgagattaataggaccatatcacatgcattgcaaagcagatcaatgtaatgtaatgtacgtcgttgcaaatatgtatagccgacgaaattaattattagatcgatcatgatctgtatgcatgtacatgtgtacatgtctgcacatatatgttcatgcaggacagggacaaatcaagctagctagctagctatcgacacgatcgaaccactcaattggtagcacgtagtagtattaatttacgtgtgtcatgtgatgtatgcatgcatgcatgcatgaatgattgtgattttatacctatgaacgatttgtcgtatgtatgtatgtacttacgaatatgtaagttttgtttttaatcttaaaattctaagcacttagtatcttaaaatgcaaggtatttacttgtcggtcagcggacgaaataattatcctcggcggttttcatgctatatttggtggtttttaaccaccaaggacattctgttttcttttcttgtagagggaagttatcccacgtataaagaacaatctctacataaactttaatagaaaaaatataagagtattagagttattgggattcgtgtattaaagataatctattatatacatcacctcttaataatttatggatagatgatataaataaaattcaagtatacaacactactccataacagatttttccttacaactaaaatcaatttttcgcagacggctggatggcccgcgtgcacccaggtgtttacgaaaatcacatttcccatgcggccggcgcaaccgcatgcgaaaatctcatttttcacatgcggtcacctatacctaggtcgctcccgccgccatcgttctcagcgtccttcacgccagatccgttgtcgccgactccctgccattctagcccagtgtcggtcactcctgcccatcgtcggttgtcgaccctcccgccgctccagctacgttaccatccgcgtgcacgagagggatagggaaaggacgagtgagagagagagagagaggagggaggagaggataagagaggataggtggaggaattaatggagaggaattggtttttatacttagttcacaatgatttttgcaaactgaatctctataaggagggcaggaagcatatatgaaaatctgattttcgcaattctcatatgtggccgtttgaagaccctgggatagcgatttttataggcaaaaaaaacagttatggtttgcttacaatctaaagggcatctcgttcagaaaaatcaataaaaacttgctctcagtttacccatagctgctactccacaggcattaccaagctaactaaaatcgtgtcggtctgaaaatcaattaatcaatgagcttggacacaatgaattaattaaccagcggccactggagaccggtccactctacgtacctatcgatggctttcttggtccatccgtagactcgattgatcctagggtacaaattaatgtcaatcgtttgcttctctctccccaataaattaccaccggaaaattggtataattaccaatcgattcaatgggggttaatccggccaattaatccatactcgggggatacgtgagcgaggtagatatatagcatgcatttcttgatgaacgacaagaccggtggcttaattaatctgtactatagctgtgggtaaagtactgtggttgaaaattaatgacgcgatgtattgctaatggagtactccctccattccaaaatataagacacaaccattcttaacctaaaaatcaagaaacaattattattatctcttggtttggatcaccctaataaatataatgcatgcatctaataaaattagaaatattgagggtggaggatttaaaaaagtaataatttaatggagaagatgtcctaattaattgtatgcatgcatacatgccttatattatggaatataaaaaaagtagttgtgtcttatattatggaacggagggagtactatctatccccgaaagttactaatgccatatttgaaaagtttgaaattataagaaacaacttatgcgtatatagctggatggtaaaagtctctaaaaatgttgggtttctcgatcggtctcttgtttattttatagatattaaaattacgaattcttaaacctaagtgagaatccaatttctgtgaagctagaaactctagaataaactgcaaccgttatatatagtagatgattccccacgctttactgtgagaattaccaagcaattctcaatattatttttacaatcaagttagcagtaaaaagaaaaaaaataaaacatcagtgtttatcagtcaaatgatactcgtgctttagtgtgaaacatattgataagtatatgttaaatattttaaaagtgatagatatatttgttaaaatattgtgcaaaaatgatacgaggggtgatgattagatatgcttgtattttcatttgtagaattaaataaattgtagatcatgttttatatatgcttgcacgaggttaactatataattatagctagtgggtgatgatgtggtatggttgtatgcatgtttagctttaaattttatagaaaggataagctatatgaaacagagcctaattaaattactgttacgtactctgttgaacggttgtcaaaatattgttgatgactgggggagtactggtgtactagtgtactactacttcatgtgccctatgtctaccaccccatcccatagcctaattaatccctttgacaattaaatatactaaattaggaaccaataaatcacccatacaattaggtattgatataattatactatgtttgctgttaattagagtagatatatagcatccaagaatatatgtagtcaaacattaaaaatcttaaatcattaacagatcctataactccatttcaatttacatgggtattctagcatttaatttttttttcacaatacttgtcatgctcattttctaaagtatttttagaggtgactttcactgtctacctttagagcaaaggataataatgtgctataaatctactataaccttatttcgaggagagatgtaataaaaaataaagggtgttagctctcatacaagagttagcttaacacatgctctaagactacaaatacatcaaagtgagtgaaagaggtaggagaagaaaaattgaaaccaaccttatatatagctaatctattatactatatatgttagctttaagatgaacgaatagttgacaatgagctctactattagaaacttgctcttatcagtgaggcataatatagtactaatactttagagaagaactttttatgcttgctttataaaaatcgattgcgatgtaattaatgagggtaagggtaatttgccacacttacttatttggtgtgattttgctagaagcctagaatgacaaatagtaaaccatgaaaagaaggaaatataaaaatacttttactatgtgaaaatgtcactattagatttgctattaaagatactttcatattacttactccatcggtcccaaaatataagtatttttagcatagtgacaagtcaaacatttttaactttgactattaatagcaaataaataaaaaagatcaatcaggtaaaattgacattagtagatttatcgttagataaactatcacaatatgcaactctttttatttaaaacatcttacttttatagatattaatgatcaaattagcatctcagagaacgtgttagactttaaaaatgcttatattttgatacggaggaagtatattctcaataatatttataaatatacagtttgaaaaaaatatcgataaaacatgtgtattggagactattatgcatgcactgataagagcaagtctaaaactattagtttatcttaaaaccaacgtcaaaattaaaacacaagtaaggtagcagcttaaaacgccaatagtatgcatctgaacagtgacctcagtgacatttttcagatgtgcccctgccccctatatttgagacaagaaaccgtgtacctcgacagattagaaccccaccctcatgggctcaggactcctataggccagcttagtttcgatgatctattggcttcaccactgcatccactcacaaaccattacatttgccgtgcaaaattagcaagaaaattaagcatgcatgtgcagtagtaccctggactctgttcttgtggttgtacattcatacatatattatcagtactggctttagctatagggtgtacctccaacaaataatagtacatgaaatcaatcaatcaattaattcatgcatgcatatttagatcgatcaacagtgttcatgtactagctagctagagtacttcctatacaactgatcatatgctgctatgtcaagctttagatcgatcgatctctattgttactaattaattacttcctcattacaaaaaagttacacctattatttttgtcgctaagatcaaagagaaattaactcaggttgcatgtaacgaaaattaaggaatgtatatgcacacatgcaactaatactccctccgtccagaaaggaggacgttctaggttagttaggaaaaattagtgttatgtgaaaatgaccattttgccctcaatttataggattggggctaatcatttgaatgcttagtaagtattaagatgactcatcggattctgatcaaacatttaatttacctctatttaaatcttatatgtatagagactacaaatagaaacaacttatttagaaaaacttaaatatgaaataagtctaactaatcatgtggatggatggaatataattattaaagaatatcaatcgatcgatctctcttgttattagctagttaattatatataataattgtaggagctagctgatcgatcatcagagggagctaatagcattgaaaaatatctaagctactgtgtgcagtacatgtatccagtatcgtacctaagatatctatttcggtacgtactgttggtaattttaatatcatgcatgattcgcagaagtgtaagtacatacgtacagcttagcttagctgttccagttattattattattattattattattattattattattattattattattattattattattattattattattattattattatacggaatacgcgcacacatacaacacggttacaacacggtcacaccacggttgttgtgtctcctcttaaagagacggagactagcgacacatctctagtctcactaaattcctaaattcctagaaagctcactcatatgtgcacaaaattttggcacatgttctaacttttctatttatttggctccctttttttataatggaatttatcccgatctttgctcaaaatattatggccaaataatatagagctagattgcaggatgaatgtttgcgacttacataactacggcttgattggaaaaataaaactaaatagtatgctccctcaatgacagatatttccatctaaggttggcaggagtatgcttccaagttatagttatatgtagtgcttgtctttctcaaatcagaaaagcagaatatctccaaaatcataggttgatctttgtcaatcgaatgtcgctccgtttggtattacaatatgttgtatggcaaatcttgtttggtgcaatgcaaacggtaatactataattaatatatagagagaatgatacgtcttgataacatattttgcctaactacaatttctgcaaaacagattgcaacaatcatgcatgactttattttacatcaacttaaaaaaaaaggcacaacacactataattaacaaggtatggtaaccacatattgccagagataattaattagcttttggtaaaattcatataaaacttttttaaaaacaacaataactacatcccgttatgcttttctttatatataaaaaaaacatgttatgcatcctcaaattgttggctagctagcttttcctccatcatggatgatgaaacgacactttggatgcatgttacatggtacacatgcttggagtggaagcaagccaagttaaagaaagaaaaaaaaagggagatctcatctctatatgatcatcaatctagtactacgacctgtatgcaaataaaaatagtactagcagcacatctctccaacaagatcatgtccctgaaaaatgcagaaaaggatgatatcgagcatatgatatgcatcgcatggtgacatgactatagctttggacaactttggtcgatcgatatcgacatagatgagctttttacatgatcacgttttttcatcgatcatgcatcaggttgcatcatctcatcttaaaaaaaaaaaaggagatttggagggagattgacatccctccaaatactattttaagaagagatatgagcgtgttggggattgaaaacgagatgtcgggattaaagccactacacttgacgtgcatctcgcatcatctcatctcgatgtgatcagtcgtactaagtacttgcatagttgcatgcaagctctcactgtaagcaaacaaatctagtgattgtgtactgatgtacttttgcaaggttaacttgcaaacttgccgggttaatttatggcagggagtagtgtggtcggttctgtttgctaggagtatatgtgtagtgccgtgcgtgcatatatgatgaatgcaggggtaatttatttgcagacgcgtgtactatgcacgacaacatcatcgataataatacagaggcgtcactaggacgtgtaaggatgtgtttgagaggggggatgagaagatatacaaaattaggtgaaacacgtactaacgtatgataattgatattaaatattttatatttgaaaaatagtttaatatgttttttaagcaaactttttgttaaattttctttaaaaaatacttcgtttatcagttcgga

SEQ ID NO: 39665 - DNA, 2874 bp, Oryza sativa
ttgtctagcatctttaatggtggaaaaaaaagctcaagctcgtgagctcagctcgggcttggcgtgagcttggttggcttggctcggctcgtaagccaaacgagccaagcctaagtctcctttttagcttaaatgagccgagcccaaactggctcacgagctgcttgttttggcttgcgagcctataccgtcgtgtgtttatattgattattttactttttatggagttattatttgtcaacttgaaatttatcattaagattttgaagaattaaatatataaacttatttaaattttacatgttgatgatttattcctgcttttttttaataattacaaaatatatatgaatatgtatatcaaccggaaggcttgcaagctggctcgagccaggaaacgagccgagctgagctctagttttagcttgtttctctaactaagacgagtcaaaccaagcctaatttattgcgagccactgcaagccgagcctcgtttccacccctaagcatcgtcacttgctgccatgtgtgccgtatgccatgtcctttctctttttcttttttccatcgcaccattcgtaaactggaccctccaattcctcgatgtgtgctcatggcccaggactctttggaatccaagcaggaaattaattaagcccaatagttacatcaccgagcagaaacccagcccaagtaactgggccgaatccagcccaaacgtcacgctctgggattctggcccagattacagcccaggcttgtagcttacctggagctcatattttctctcaaaaaaggaaaaaagaaactagagttcatatggttggaattctatgatatgctaccgcttgccaaattattgctcggtcgaattttaataattattttatttccttttatacaaagatgttatagtatatgttctcgcaaaaaaaaatatatgttagagtacatgattaattagggccgaaaatgatctaattgttataataaaatatagttaattagtttttatcttatacttaggccgtgtttagttccacagccaatttttttaagtgtacggacacacattttaagtattaaacatagactaataacaaaacaaactacagattctgcctgtaaactgcgagacagacatactgcgcccatgtatgacaataatcaacttaaaaacagacaaacaatgtttcttaaaacattttcatttccattatcgaaagaaaccactaatggccctacatcgaaccaactgaggagatcgttttcaaaaaaaaaaaaggaaatgacattattggttatgtttaagcattcaacaattgatgcgcaagattcattaattggttcggactaaattttttactataaggagggaaactatgcagtggaaactaaaaatttattactgtaggataagaaaattgatgtttgatgtttgtccacgtcataataaataaaacttttacaatatcattatatgtgtggaacttttgatagtagtcattactcatcaaagcggttcattagaaatccaacgcttgaacatggcgagacttctctctggttcaaactctggtactgtgtggctaccaccctgcgattaaattgaataacatatgatgatatttgaaatatctataatgcattatatacaatttattgatcgatttggaaatacaaattttggagcggctttcaaattaaattagtaagacaagatatctccaaaccccctggagcaccacaagtgctatatgcgacatgaccattaatttggaatacattttgagatgccatcgatcagatgttgcaaaccttaaggaatagcagtatatatgaaccaaatcaaaaggtaattaaatagatatattagatggattgttacgtacctttacagtagcgaaagtcatgttgttcatatacgttatggtgaacctgcaatagttatatatatttccaaatattaagtgcaggatcatacattaactgaaggcactggccaaactcaatataattaaggcatgaacaaactatatagtgctatatccatgtaatataatgaatcttaattaccctgctgactggccatcgacgtgccaagccctccagtcatctacaacagagaagttgagtgatctcacccaggcttgtgtgcccaaaaatggtatcattgcatcatggtcaccactgtttacataaacattatatgaaaatacgaaaggttaatcaattagaaaactgaacattcaaccacactataaattaacagtagaatcaccctaaccatatgaaaggtacacaggtaaactagagcaggcatatttatctgattttggcaaagaaccaccttgacgaattttttttttggcacgcggggtataattttctttttctttttagaagggggtcagggtagagagggatgcaggggagtgccaaaaggataagataattaggcagagcttattttttaaaaaacatattgaaagtacaaccaatcttttttttgaatttatagttcgtttcaaaaggatgatttgctttctaagatattattaatttgtttccattttctgatcaactatcctttgtgtttggcacattaatttgtacctttttggccatatattgtaacaaaactttcataaatagtttttgattgatcggtaataattaatgcaacaacacactttcatatatatgtatacaaaattaaaatgtgtattaaaaagtacgcaatactacctgtataccaaggcacggtaaccttttgttgtaacattgtgatgaaactttatgttgcttttgatgtccatcgagtaaggcagatctccattgtggcaccttaaccactcatcgacacttccctaa

SEQ ID NO: 39666 - DNA, 13016 bp, Oryza sativa
tgccatatgtctgttgctggaagaaattaggaattaatggatattcatatacaacttttggtggcagtggcacataactatactaaatggaaatgaagtgatatacaagtgtttatgtatgttcggagaacaagggcgcatgcaatgttagagcagtcccaataccagactgcatcacctagtcactggtattaatattaggcttagctcacccaatgcacaatgtttaaaatggtccaaataatgtaatttcatcctctcatttttttttcttcttcaaatagctctttcttttcaattgatgcttagactctattctctgctctattagttcatacgaggcaaagcttttgccctcttttcaaaaatgcttaattatactctatatccacgacccaacgagcttggctctcgtgaaagacctacatcatgcccctctctctctctctctctctctctcattgacatacccttttctttatccttatatccccatgcatggccttttagcctcagattatgattcataaattacaagggatgtttgataagttaacaataatgcactctatataacaattatctagccacttgtagtgatatgaatgaagccaatacataaggctgacttacaatacattctcttggaggaaatggtggaatctttcgtttttcctggatcgatccatctatatcactatcgtaaatacaatagttgtacaagatatgtccgccagaactttcgccaagcagctgcagatcgagtaagtaacatcaatttactaagggctatatatatttcaaaatatttttggcatatgcattatatatagaaagaaatattggaacatacttcgttaaacctatccaaagcttgacggcaaatagcattcttggggttgctataatcctctccttggcagtgctccattatcgtcttaattaagatcaatcacatgtaggcacattgagacagcagtcagcataggttcagttaatttctagtgaggtcatctttgattaattagtgtgaggcttattagcgagattaattggaatagcgtgttaaagaattatttgattacctcgtacaactgatctgaaatgatcccaactccatgagcatacggcactctcgaatcgaagtcaatgctttcacctgtaaccggattacctactagatagccctgcttgttatcacaaaatacaaattgatgaccatatatacaaaaataaaatttatcacgaaggatcacactatataactacatactacctttatgatgaaatcatgtttgatatgtgtgatgaataataggcaaaatgggttattgtttagactaatgtggatcaagatagtgatcagaacttgtttccgaaagatgtttctttttatttgatgtgcatgtgaagctaggaagcgaattataagcaatcataatgagttacaagggaacgggagactaggatgcggtttcccgagatcagagtcggtcaagagatgtcattagatggccatgctctagcttgttgtatgaagatagaagacatggaacgggtgtgtgttctacgcaattggctccgtgctattctgacatggtggagttggatcggttagtgggtcggtagtttagtttgtgatgagtatgagcttatgagttcatatgggttaattgggccaagttcttttggttatcggattgtcttataaaacttataaggagacaaagagatatgacgggaaacagaagagaataaattcgttttttttaaatgtatatggccttgttgaactttagaaatggtatttgacctattcatcttattaaaagatacgtattatttattttgttgtgacttacgttgacattaagagtacttaaaacataatgtgtatttttttactaaattttatattaagaccatggtgaaatgatacatctaaaagtccatataacaaataacatcttatgctttaaatgaagggagtagtaattaaaaaaatgacatgacttaggatgcgtcgcaagccagcatacagtacagaacagtgcacacggaaaacggaacggtccattagcacgtaattaattaagtattagctttttttaagaaaaatagatcaatatgattttttaagcaacttttatatagaaacttttagcaaaaaatcgcaccgtttagcaatttgaaaagcgtgcgcgcggaaaacgagagggggaagttgggagcaggctctcccgaacacagccttagttatattgccattagcatatatagaaaaaaaaacctacatatgatatgcgggatttctatatattgatgtttattaggaggtggtgatgcttgaatcttaggtggtgtttggatctagggacttaactttagtctctgtatttagacactaatttagagtattaaatatagactacttacaaaactaattacataaatgaaagctaatttgcgagacaaattttttaagcctaattaatctataattagagaatgtttactgtagcatcacataggctaatcatgtattaattaggctcaatagattcgtctcgcgaattagtccaagattatggatgggttttattaatagtctacgtttaatatttataattagtatccaaatatccaatgtgatagctcatctaaacagggtcttaggctaactagtcctctaacttaggatataatagtataagtaagactctgggtctttctcatattgccactagcaaattaactatcgacaacaacggcacatatatactccctccatcctaaaatatttgacgccgttgatttttttaaaaatatttgaccgttcgtcttattaaaaaaatttaagtaataattaattattttcctatcatttgatttattgttaaatatacttttatgtatatatatagttttacacatttcacaaaagtttctgaataagataaacgatcaaacatgtttaaaaaaatcaacggcgtcaaacatttaggaaaggaggagggagtatattagaacataagaagtggataataatgtacctaaataaatagtattgtggtgaccatatagtattggtgtacgtaccttgagatcaacaattggcctcaccccagcttcgatatctgaatacgtacacaccacatgatcgtgtcagaaaaaatgtaagcgcgcagattaattaagcttaatttgcacactaaactaacaaaaatctcctagttgcacgtaattaatggtgcaattaagtaaataattaaccttcagagatcttctgcgcgagaaatgggacgatcttccctgcgtaggagtcacctccaatgtagaaaggatttgcgagatactccggatgatcactaatccactatatattaatcacaccaattaagcaggttaatcatctcaactcgattgactaaatcaaaattaattactattcccaccatttcatcgtagtccaagtcaatttaactttttttttcaaacttatttagatttgactaaattatagaaaaaaattaataacatatagaacaccaaattagtttcattaaatataacactggataaatatttttataatatatttgtttttattaaaaatactactattctctttataagtttagttaaatttaaataagtttttcctaacaaaattaaataagtttgaattgaaaaaaatcaaagagacgtctaccagaagactactactacctccgatctaataaaaattacattatatttatagagaattgaggacaaattcgtagaattaataaatgaccacaataaccttatttaattaaaaggaattttgagacaacaagttagagaagtgattggaaggaatggagattagaaggaaatatattttgatgtaatcaatttgctgggttccacattagtagaaatataatttttgaataaagatttaaatgtagaaatacaatttttatgtgacagatgtagtagtactaatatatatgatatatatgatatcacatgttgtgtatagtatacgtatagattaattaattaccttcgcgaggaagtgcttgagctgcagcgaggcggagacgtcgccgacgaggtagccgtcggggtggcgggagaagctccagccggcgccgaccggcgagtcgacgaagaggacgctcgccgccttggtccagccgtgggggtggtacctcagccgcgggagctcgccggcgtcgtaggggcggtggtgctccaaggccagcctcaccgggccgacctcgaagaagacgccgctgagcacgctgcagcgggcgccgccggtgagccagaggaggagcgggtcgcggcgcgggtcgccggactcggactcgacgaagtagtagaagagctccgcgccgtgctcctcctcgtcgacggcgacgtagcccgtctcgaggcggaacgggagctcgccgtcgtagcccgggagcgtggtgacgacgtggtgatggctcgccgtggcggcggcggcggcggcggcggaggtgggggtggagtgatcgagagggcaggttgggagagcggagaggatggagaggaggaggtggtggagacggaggcgcggggacatggcggtggatgccggcatgtcgccggtactgtgctccggtggacggtggtcactgtgtgattagtctgattatccatggaaatggaagtaaaatatgtagtggtcgtcggcttaggttttaggtaatgtaaaaaataggactgctactgccgtcaacattaaaatcatgtcaattctgaaccattccatcgtgttgagatttacgcacaataaactcccccgtcctccatattttttttctgaggggactacggatcggtagtccgatccaaatgtgtaaaaatcgggcgcgtcacacatgcgtgcaaaatgactttaaactaattttctcttaaattacttatccaaatcttgatttgattgcaccattaaatttgttgcaattaaatcttcaaaacaagaccacacattgatatattccggcgaaattttttttagcttattattgaattttttaaatgttgcacgatgttccaccaaatatatcgaaaatgtttcaatcatttaaatcaagcgttgtttcaccttatataaaaacaatgtttcagcaaatagcgaaagaatatttcaattccctacagcattagatctatacatagtgaaacattgtgagtacactaggtgaaacatttttggtggaataaaaaatgaaacgaattctctaatagagggtttccaaaatatgtgggtgatttgttgcaaaagaatgtttcgttcattgcaacattagatctatacatagtgaaacattgtgagtacactaggtaaaacatttttttgcaacaaaaaataaaacgaattcccttaatagagggtttctaaaatatgtggatgatttgttgcaacatcgtgcgtggtggggacacgtggcagtgtggcagggaaaacgtggtggggcccctaggggcgtgcgcacgcgcgtcagggcggcggccaatttttgctgcgccctcccgagtgctcgataacgagcattctcgttttttttttcttccctcgtttatgccaccaggccaccaccattgccccagtggtgtcacggcaagccccaccagacctcccccgcccctcctccttctcaagctagcggcgccgagatgtccaggcacaccgtctttgatccatatttccgacggctccccatcgccacccccacctcctcgctccgcctcctcccacaaccatccctctaatttaaagaactacctcccctcacctcatcccacccacctcccttcccttgcccgtccctaccctgaaccctaaaacctaacttgccgaaccattgtcaatagccaaagtttgactggggtcattggatgtagagtaggagacctagcatgaagcaaaccctacaatgtcataattgcaaaaaaaaaaaaggttaattggatccatgccattattattttcacggttttgaaaaataccactactatttaactatttgaaatcatgccattacaatttaataggtatttgagatgcgccactatataccctttcattgcacttagaaaatatttttgacaaaattgtccatatcttcctcctgcaccccgaagagcatctccaacagaatctcaatttggctcttcaagttaaaatttggccaacgtagagaaaaaacaagctccaatagactctctatctggatggtcaaattgctccaccgctggccgaatgtagccagcctcctccactggccaaaggtgggtcccaccaccactcctaaccccatccttcctctctctgccgtccacccactagcgcatcggccgggggcgaactggagggcacgccgaccataagcgcgctgccgacgtctgggccaccacccgtcgcggtgtcgtcatctaggccaccgtccgccacgactgtcatcttcgtcgctgccgcaccacggtcatggacgagccgttgccgccgcgcggacgtcgagcgagagcgcgtcctcgacgtcctcatcgacctctgacgaggaaggatagggagcaccttcgggcggtggcggcggcgacagcgagggctgaggaggcggagggggtggcgaggaaggacagagagcacctccgggcggcggtgcttggaggaggtggtggtggtggtggcggcggcgagggccgaggcggaggcggagacggacgagggcataggggaggggccggggacaggaagaggtggcgagcggagtggcccgatgagcggagcatcgcagcggcggtgggggcacaagccttggcaccatgggcggcggccacgctgcccctcctccgccgccacgggggactacctcaccgccgtgctctcacccatgctcgtgtagattctcgggaaaaggggagaaaatgaggaagaaagagatgaggctgacatacgggtcccactgccatacactcaaaatagagaggatgaatggagagactattggagtaaataacaaatttgacatgttaattaaatcgagaattaaccaaatagatatttggagagtcagatttagagagactgttggagatgctctcctctcccattcatcttttcccatcgatggagctagacccggatgacgcaggaacatttcttcgtcccgatctcctccgtcgggcatcaacttggcgtaggagacgttagccccaagcggcaatcaaggcgaggaggacgctcaccgtgggctcggccgacagagatggtttcccgggtattggtagtgaggccggaccaaaaccatcagcggaggtggtagccacgccaccaaatgaggaagccttcctcccacaactgacgaggctggaaaccatctcccaccacaccaccttcgcacctcctcttggcccgtttggttggggagagtttttaggagggattggaagtttagagggatgaggctattaaatattttgtttggttaggagacatggaaattttggtgggatggggatggggaattaaggaatgaactccctccttttcaatacctgggtagggggtcctttacttcgcctaaacaaatctcagccatccgttttcattaataacctaatctctaactaaactccctatcaatttccaccacctctactaaacaaggtactgggatgaaaaatcaaattctcatcttaatctcaccatcaattccctcgtgtaaacacccaatcccattccctcaagttgccaaacaagccgtctattctttcaatcaatctcttcacagttccgctgcacgccaactgtttgtgaaaatgctcaccaaagcaaggatccctcaattcccaggtgttgttgcacaatgcccgtcaactcctccagcgctgctgctgcatgctccccgtggccgagcttgacgatgcaggcaccagctctgcttttgtgcctgggcctttgtgagcctctgtctccgcgtaccttttcgtgccaccgggcctctcaaccggagaagcatcaggaacaagatcaggcctgtttaggggagcttaatattctgaaaagcattagtagccagcttctaagaatttaaaaaaattgggtttggcttctagtttattttctgaattctatagcttatcaggatctgaaaaaaaaaactggactgtttgagggagtttctgattctgagagaagctgcagcagctaaaagctcccccaaacaggcccttagagagagatggtaggagtggaaagagaaggggaagaaggaacacggcatgggcagtttggtccaaaagaaatttttagtgcggtgataggaaatttagtggcacatattaaataacccattaaattgtagtggcatgatttcaaatagttaaatattagtggtattttttaaaatcaccaaaataataatggcacgatccaattaacccaaaaaatttaacgccaaatttctatggaatatgattaatttagcggtttcttttttttttagttaaatttagcagtttcgataaaacagtagatctaatcctggttagcctcgcaccattactgagacgggaggttgccgtcgccaacgtaagccgttgttagcgaagggaacgacgctgatgagtatgttccattgtacggacaatgcgggttcttttagcaaattaccagtcgccactcccatcaatgatagcgaccacaatgacgaactgaaattcctatttggcgcacacgcgtcagtacaccatgtcgagcacacatttcgggccaccagaccacgtgtcgtgttaccctttttgagtgatttttggctcacctggcccactagtccacgtgtcgtgtttcctttttttcgacccaacgtggccatgtgttttcattcctttttttttcattttccaacattttaatgctcttggttttaaaacctaaactttcaactcaaatttaaaaactttcaaaccaaattttaatacttcaactcaaattttaaaaacttttgactccaatttcaaaactttaactcaaaattcaaaacttttgaatcaaatacaaaaactttcaactcaaatttataaattttcaaatcagatttactttcaactcaatttttaaaactttatctcaaaaatttttaaaaagtctacccaatattaaaaaattaagttaaattatgaagttttcaagtcaaatttgaaattttcaatttaaattttgaaacttttaatttcaaatttaaaactttcaacttaaattttaaaactttttgattccactatttatttattatttgtttgtaactaatcacgctaaactagtcgcacttaggcgctaaccgccctgcttagcgaggggggcgcggcccggggacgcgtttgtacatttccaggtcgcggcccaccagatatccgcgagagttcaagacgatgggtactttggtccagatggaagcgtgggccggcccatctgtaattattgggcccatttgcattagttgcaaggtacgtcaggcccactgttattgttgggctctgatgcttgtaaaacagacgcctgtctgttcatctccgaccgaccgacagcaaattaaaatcaatacaaaatcagcttgatttgggattatcgcatttcagacaagtatatgcatcacaaattcacgatgtgaagatagaaatgttctccacgtccaaagaaaagcaaccaaaaaaaacagaagaaaagagagcaagtttgccaacgacattgatcatcatttcattaatctctctttgtatttcctttgcttcaggacgacacagtcagggtgttacaacaaatgaaatgaagattacatcagttgcacttcttctcaaacagctaacccttttggaagtcactgtacagtgagtatctcctccaatccccaagtccatatttctctatacgtttgagatgttatgatggtgtttaaaacggccaaattttggttatctttgtcatgaaaaactcttgcgtatagttgtgatgatctgatttggcagctcggtaccccgcaggatgagatacaatacaaaagaagcataagcaagtactgccacgcagagaattgagccagataataggcctcttatttctgaagagaagaaatccagcaagagatagccattgatcgtgatcaatagtgtcgccactgtccaggtcacagcctgcataaatttgacacaactgagtgagaacagaacatcatcggctttacacctcaacaatggcaaatcaaagcaagaatgtcactagagcagtaatacgccatcatttaactaataagtcaaatagttcgtaggcatgctggtttgaagatataaaatgttcaatgcagatcctaaaagaacccagacagatacaggtgggaatctgggatatgtcctacagcattgctgatttagtatctatcatgttcaatgcaaatcctaaatgcagggatggctttttctcaaggctttgcagtggcagtggcatcttgcagcgaagtgtgcaatcatgagcagacagaaacacaagtaggatctataatttccgtaatagaacaccaaattaattgactaccacaattatttatggctggattatgctgtcaatggaagatatagccatctcatgaaatgaaggatgcagaatgcttgaagaacaggacaggcattatatcacagatcaatgacgacttacttgagtatttcgacctattttaaatacccccataactttctccttggaaaccaaagttatcagcggaatcagggcaaaagggatctgaattgattgaagcacatttagccactcgtttagaacatccagcgaatccgatttatcgaagaagagtgcgacaattatcgttggcacaatcgcaaagcttcgggtgatgagtgacctgatccattttttcaacttcaagttcaaaaatccacccattataaactgtccagcatatgttcccgttatggtactactctgccccgcagctaatagtccaattccccaaatgtagaggatagggaaaaaccctccaccaaacttctcctgtagatactgtccagcattttcaaggccaatattaccagcttcttttgtgccataaaatcctttcgcaaaaacagttgttacaaagagatttatcatgaaggacacagccaaggcgatggttgactctattgaatagtatctcaacgcttcacggacttggtgttccttgtttgggtctatttttctcgactgaacaagcgctgaatggagaaacacattgtgtggcatgataacacatccaacaaccccaactgcttgtcttattgtcctggagctcaattttgggaccaaaatacctgcagacaaaattatgcgtaatcaatgggtcaagagtgtgggacaattttgtagtgtcaaaagctgccgatcggtaggatctttacctatgaacaggttcttcatgtttggcttggtatcagtaaacatccatgcaaaggagacagccatagtcgcaattagaatcgcaaatacagcttctaatttcctcaccccgtagttttcaagagacaaaaaaatgaaactgaaaaaaaaaaaagaaacatctcgtaagtgacggtccaaacaaagatagttccacaattttcatgactttgaatactaattttgaaacagacctaacttagcaccgtgcaaagcacaaggcagaaatcctcacagaaactagcaagtgattaatattctaatccaattagtagtttttagtgctagtgaacatgtgagcacttgtacagacttctgaatcatatcattaatcaaagcaagggtctagaacgagatatataaaataactcttgatggacaacaacagaacatgtcctacttttatcagaaccaaaagtcccgtcaaagaattgcataagcacaagcagtgagtacggagttaaattaaaatacagtctatagctgtcagcagcatcaatccatcatgaaaaggtcagcacagtaacttggtactttatattccttcaggacaaacccaaaactatcataagcctctcctgacaaaattaagttaaattgaccaaaaacatcacatcattgagtaatcagcagcttggaattgtgaaaatgaaaaattcggaggtacaggttccgtgattatccatatttggaacttgggcattaatttttcatttctcatgaattcgcagccaaaacagatctgagactgtgttcatgtaaaatgaattggggcgaaagctaaaattcctcaagcattcaaccatcctacgttatagggtaccatgaatatgaagtctatcaatatacagtacagttatctccaacacagtgatcgtacgccgccaattttaagagaagtgaacaatcctcgaaattatgaaattaataaaggaagtactgtggtttacagcgaaatgagaagaactgaaccaacgcccaaaaaagtgaagctacaaattaaacgaaaacaacgaatcagcagcctataacagtcacagcaaaacctcccccaaatccagctcatgatctaacatcacacccaaactctttagtagcaagtagcaacaacacatttctttttttttctcaaatatactaagtatcaagaacttaaagcagcagcatttttttttcttttggaagcatctcaagttaagttggtgatagggaaaaagaaaagcaaacttctaatcttttggaactatggtgtgtgatctagacctcgtcaatcacaatcaccaaagccatgcgaaagatccaaaccaatcaggaatcgaaaccgacccaacaaaaaagaaaaaaaattcacaagactgaccaatccaaggcggtgatgacgacgccggcccagagagggaggaagccgcggctgaggatcttgatggcgatggcgctgccgatcacctcctggatgtcggccccgaccatggcgacctcggccatgagccacagcgcgcggcgcgcccag

SEQ ID NO: 39667 - DNA, 20909 bp, Oryza sativa
  unsure (1)..(20909): unsure at all n locations
gtggggcacgtgacgtgccacacaccgcctcgtcttcccggggatggggcttgtgtttgtgtgatgagtgtgacgcgcaaacagtctcttgtctcttttacgggccttttataagggatggtgggtaccaccactcaaccggaaaaacctcctctcacttgtactactgccgtacagagacggcaacgggacccaatcactgattccccacggtgaattcatatttagggatggggatggttgatatctatcatttatgggaaatttaatgattcaaaactcatcaccatcgggacccattcccatcttccatggtgacatgtattcattggagttagggaccaattctaaaatttatccgtcatttgacccatagaattgaagcccaatgaacaagtatatatatatcttctaaccctagtcaaccctccccaaatcccaatccccatctattctccttctgcacgactccactaggcaacaccacctccactccacagcaccgcacactcgcccgcctcatcttcttgggtaggggtgggcattcggtctgaccgaaattttcgatctcgatctttggtctttgaaaagtgaaaacagaatttcaacgcaaaaaatgttagaaccgacaaattcggtctcgatcttttcggtcttggtctcggtctgaccgaaattcagcattattttcatatgtgcaaagaaataatggaaattttcaacacaaaaatcacaaaaaagaaaatccgtaagcaagtatgagtaaagactcttattagattgcatgcctagaagaagtagggatgtgaaagttatagtttaatcctattgaacttagtggactgtaggttacatttaggcattttctgttaattcggtatattcggttaaccaaagagactaaccgaattgaccgaacaaaattcggtctttcactgcctagtaccgaattgatgaccgaatttctcgtctcggtctcagtcttttcggttcgatctttttctgtccacccgtattcgtggggataggcttttgtgagtgtgacgtgcaaacagtctctcgtctcttttacggccttttatatgggatggtgggtaccactcaacgtatctagagtacacatcaagccactcaaaataagagaaaactaagtgcccgtttgacacatttttagctctcaactccaacttccctatagttagagatgtgtttcaatttttgagcggaggtagcagagttgctccacaaaatcatactacgagggttgagctgggtttttcccgctccactccaccctaaaagacctactatcctttatttttttttcatgtgtttacgcgatatgtcattgaactaccccttctcctctcgttctatctctcttccccacaattcatcctcccttgaccagctagggctagcggttcggcagcgactagccttagctgagcgatgacaacgtcggcaagaccacagaacaccaactaggtgtttgacgaaatagcgatacaggatatggtggcgtggaactgaccaatctagtaaaccactttcatgcccaccttcagctcctataggagctagctcctattggagttggactttagagttgggagttgaagtttggagccctaccaaacgggaccctaagttagggcatgtttagcacaactccaactctagtgctctacctctcgtggagctgaagcatagccaaacggtttcagttccacttaaaatgagagcggaactgggtagagcaccctcacaaaatgaactagagaggtggagttgggtttagacagctccataactccactctatactcagctcctggagttaaatttaggagttggagctctaccaaacaggcccttagaggagttggtttcctattcgactccttgtccgtttcataggggtagtactcctccgatattcaggaaacttctaagaattctagttttttctagaatcataagcttctctaaataatctagtttttttctatgttttacgtcttaagaaaatgtagctgtagaatctagaaaataaactataagatagaaaacccaacttttatagatttttagaagttggctagcaaccacctgcttctcaaatcaaaagctccccaaacatgctcctcagctgaaaaccatggaaaattgtaccatgctataaaacttttatacatgcgttcttaatattaaagcgaatatataaacaaactaccataggaaaaccttaaaatcatctctagtaaaatttaaattcagagttacgtctgataagtgttgatgcaaaaaacacacactggtctaggagatctgcttagctccaatgcaggtccaaaggttgatgagatacgggcgtaccagtcagtttgatcatgcaactgataagataggtaaacaacagataaaacagccaatcacctgacaagccgatggagtaattccaaccgatagccgatattagccgatgccgatttcagccgatgccgatagggttttgagcaatcggttatatgtccaatgtagataatgatataatgacaatcggctggtaataaaatataacaataatataatccaataaaaaccaatcgactaataataataatattaatatgataggataagtactgatccgatggttaaagcatacatcggctaaaagttcgatgtcataaaatccaatcgatttagataaacagtgaaacctttgttgcaatcggctaaatccaacttgtttgtaatctttgtaagctgatgcaatgtccagataacttatcggctagcaccccgataaaacactagcatgaacctatcagcttagtaagatttatattatcaacaacaatctagtaggtcggacctaaccgatgcagcacgagattatatatgataatatagtactcgatgagccgatagatccgtctaatgtgatggatataataaatctatttataatagaattgtgattgtagagatatattggctaagacagaagatcagacttaaccgagacagtcccaactaaaccgatgcgtctctaaacacaatgcaattagagatagaattgagatatcatgtaggcaaatatatcaaccaaaccagagcgatctaagatatcgaagcgatgcagccttgaacaacaccaatgtagctgatagatatactagggccgacggaacgtaggacttaccccttcgccagagatcgaactgaaccgatgcagccccgcgtcaggtgccaaattccgccggttaataagtaaaacatcagaaaagaaggtggcgatgcgctgagagtagtattgattgagagatactccctccgtccctaaatgtttgacgccgttgacttttttaaatatgtttgaccgttcgtcttattcaaaaacttttgcgaaatatatatacataanaattatatttaacaatgaatcaaatgataggaaaagaattaataattacttatttttttgaataagacgaacgatcaaacatgtttaaaaaagtcaacggcgtcaaacatttagggacggagggagtaaattacaatgaccccgggtgtatatatttatacccatgggtagatactagaccttgtgggacaaaaaaaaagaaactttactaaagataacaggaaaacataaagtccttatcggacactaaacacacttttctaaagataaaaggaaactaacaaactattcctaactaatagataaactgtcatgtcgcatcctcgttaaactcggtcgcttatggataaccttcctttagtagattaatttccttaaccgaatatagcagaaatccgactattggcgacttgataacttccatcggccgattttaggactctgaaaccgatactgactctaagtcgatgattactccggacttaccaaattttatcgttaacaataagctaacaagaattaaaaaaacaatgcatatgtagattgttttctcggtccttaattttcagctttatgaccatgttctttttagaattttttccctgcattcttgccactggttatttgctccatgcttctaaatatatgatttctaaaataaccttttttctattgcattgactaaaccgctcattccaagctatttgtgaagatgatttttttaaaatgttatttttatcgtggtaatcaaatacaattcacgttaatggtccggagaaaatgataactcaaacatggtggatttacatggtttgatgaattttctttttgttaattctgactttctgagttattttgacggacaagtcaacgatttaaggcaaagttgtacggagtggtagcgaaatcgatggcgataataatgaaaatgactactgatgtactgctaagcaagaaaatgggatgtatggaaaaaaaattgtattggatggagttggactaacatagagtttcaccacttgtgctggagcttttgtggatgctttgtaaaagaaaaaagtatggaatgatatctattgcccttttatattagttatccatcgcttttgataaaacatatggcaaaagatcatattaattagatgggagagggggagcttggaataaagccacaaagattaagattcgtactaggatatctcatggacatatacgcatttacaattcaatttgtcgttacatgatatttagtcttaattaatgaatatctaaaattgtccccctcgccccaacatgacagtcttacacggtggtttagggtccgtttgaaaatgtgatgaatgacacatgaaattaaggttaattatggagattattctctggaacgaacggatcgatggattaaacattagaaatttcaaaaaaatgattcatatttgataaaaaatagttctcagagaaatcatattgtctagaaacttggaaagtgtgtgctggtgataattttgtgatcatagctagtaactatagaagaacgggccataagctaagccatatcacttaaataagctagtatatatatcacttaaataataaacttatataagctacatcacttatataagttcggttcaagtctcttataaatttaagctagatcacttaaataataaactaaagggataaccatacgcgataaaaactgactggttgtagtttcaaaattctaaaaacaaatgtgccatttggtgcgtgtggtattttgtaatccgtatgactcctattaattattgaacgtaaagttaaaaataagattcttatatccaaattaaaaactcattaataagacctttatctttgaggaataggtaaaagatagtattaagcaaatatctatctagattcgttatacggatgtgtcacatccaaccaaaattccttatatatagaaacggagggagtaatttgtttattattttaatttaacatgaagaacttgtataaataattcattgtggatttagtttagttatttttactcaagctgaattgagttatgatttaatttgtaatgcatatagctgtacttcaattaagaaaaaaaggagtatttgtaaagagcatcgcactttacttgtaatagaaatattttagttttctttcaatcatgggcttgatggcccattcgccagccggttttctaaagaccaactacggacataactctaatccaaaaaagtctctcattttgtttcggccatcaatcgatcagtccagagagatccatcagcctttctttccctacttctctggtggtctcatctcttgatagtttttgttttttctctgtgcttgtgcttactctcagtctctcactgctctttccacaattttgccacgtgtcgtgcaaataaaggagagtagaagagtcaatcagctggccagaaatcagccagcttaagattgattgataagaacaagtaaacaacttactccctccgttccgaaaataatctcctcctaggacaatatatgtggacaccctctatatccatatacatcggtcccctctaggttggttctttttgggatggagggagtataaactgatagatttaattgggtaattgatccatttaaatcaattaattcaaataaattccaaggctcattatgctaggaattcatgtgtattcattcttttatgggatatcaatgggatgaagagttttgagaattaatccatttgattagggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctctattcctctttctattccatgactcttactcttcatcttccattcctcttataaaatgagaatggatttgatctcccgcgagaatagtgagacacactttcatccattttccaacgctgttgctgctacggtaatcccatcccgacgagtgtgtgcacacgcgttgggagagtaggcctccgaaactacgcgctgctgcgacgtttgcacggacgggcgggctatcaggtttttggggagcgcaacgcgcgactactcactgttcgtcaacatctacttcatcttcaccaatatgtcgaacactggagacaacggcaacactggatacaaggagaaggaggctcccgtcaacaccaacggaggcaatactgcctcaaactccagcggaggaccattcttggggtataaccttcttacattatttcaattagaagttttactgttaatgttcatcgcaatgtcaacattgtgttattatgtgattgttgatgcttattctacattaagcatgctcatgttgattacattcaccactatcactggatcaaatcccattgtaaatatcatatttattattttgttattttggattaaaatatgccgaattatgaccaaagttccaacataaactaccccttccatctaaaaaagaccaatcctacatatgaacttggacgcacatgtgtgtttaggctcgtagatagaaattcattttttttacagagtagtaagtatctgaataaaaaaagcatggtgtatcatgtaaatccatcgacatcaccacaccatggacactggacaaggtttctttgttggagataacctaatgattcccttgtccaatgtttgaacaaccaagcatccatcttatccctgttcacgttgattgtacctctggaattggggatggacggttgaggtgaaccggaggagcacagtgagcatcctgtgcctgccaaaaggccaaaaacaatactgtacaatcaaaatgaccaaagagatgatacttgatggacacttggacggtgctcaattaacaaaagaaaaacaacagacacatgccattttagaatataattgagctttgcatgaaaattatagatatatgatttatatatctatgtcggtcttgattacgtatatataaatatttttttactgtatctcacgatattcgaccaatcttaaaggttaccgcatttaaaaaagatacatcaagagtgtaaaaccatccagctttgcagcaagaataaaatactctatcactacattataggaaaattacctatttattataccgtgcgtctttttatcggtcacgtagcagaaaaaggccgaagcaagcatcactcgattcttaaactaagtgcatggattgaaaagtttgagtataattttcctttagcagagaaaggatttatggacaaaggtagccactgaccattctaacttaggcacgacaaaccttgaaaaccatgttctataatccatgattactcagcaaaatttgaccaaatttaacactggaaattcaactaaaataccacaaagctaaaacgtgctgaaccggtacactaataaattaatatatatattttccttctttggaccaaaacgagtttgtgatgatatttcctttttcttatggggagatcgcagccaagattacgtgcagctgaacaagtccaggtacacttaaacgccgccaccttctagtcgtatttttttttcagaattcaattcatacttatcagctaaaatttaaaatttcaatattaaatttagagttgattttaaagtttttttatcgaagtttatttttcaatctttgcttttagatttctaaagatacatatataaaaaaagttttattcacaaattattttcgtttgtaaatatgggtctgtttggggagcttctagctgcagcagtttcttacataatcataagctcctcatatagttcaacttttggtccagattataaaaagatgtagttattagaatccaaaaaatgaactggaagtcaaaagctgataaacccagcttttttaaattatcagaagctggctttcaatcagctgtttctcagaatcttaagctctccaaacaaattcaaagaataaacgaaacaatattgccgtaaaacgaacccaaacaaatctttgccaaaatatcaacgggcgggcgtacgacgtcacacgtgcacccacgcgccgtggggcccacatggaagtgagagagacagagacagcgtgggtccagctaagcgcagtcacgcgcatcgcctcctcacccctgccagcgaggcgcccaccaccaacccacatacccaacccccgcgaggggggaaaggaaggagaaagcctcccgcccccctcgccgccggcgaacgcgacggcgggcgcgtcaccacatgccgatatcctccggcatactcgcgccgacgcggggggcctcctcgtcgtcgtccgcggtggggaggaagctcctcctcctcggggctcgtcatcctccctcgtccgtggcggtggcgggtcgtggcgtctggcgaagggggcttgccggggtcggggtggcggcggcggcggcgtcgtcgtcttcgcccgacgagcttcacgcgcgcgggaggcccctccgcggcggcgcctacgaggaggtgagcgagcgagcacagccgagggggttaaactccatgttcctcctccatgttatacgaaacagaagaatcgaggcgaaagtatgaaacgatagctttcagccttttgcaaatactcgattgagcagcagtaggtggtatgtatgatttgcgttagttggtgtgggatttggattggagcgaagtgatgggggattggaaggatttgaaccgtatatagatctgttcatttagagatgtaaatgttcctaaagtcggcaacacaaaagtaaacgatactagcgtcgatgcgcaaagctgcaactttatctttctcattggatagtttgtcatgctgggtactaatcttggcacacagtttgtcttaacccttgagcagtataaagcttcctaaaagtgcatccgagtgctaatatggttaacttttttgagtatgcatacacattatttagcctctcatagttggatggcagtgatggagaagtaattcagcatgcttgagcaacaacaaaagttagaatgtctctcctcacaagtgtgaggatgttatttagctttcaccaacaaagaatatatgcttgtcatccccctactgtcaaacttatctagatgagagcattagcatcttttggtcctatttgaatttctgtattgtcacttttcattatcgtgatgctcctgtgtttgcttgtagagatctgccctttggaacttgataaaagacatagaacctttggatctaagcataatccaaaaagatgttccttctgaaactgtggatgcaatgaagaggactgtttcaggcatgttgggccttcttccatccggatcagttccatgtggtcatagagtccctttggaatcctttcttcaagctgttggcatcttcaataatgacagggtatgcttttctgtccgaaacttagctttcatgttcatccactgtattgattattgttgattctagttggtcaaaagaagtcagatttaagcatgatcaccttttgaaatgtgcacaggaaagtagcaaatgacttagcgtgtagttttaggtcaatgcattaagataaataattatgtagcgtggccagctattggtggccagctgtagcatagctcttgtctatcatctatatgcatgaaatacaaatgctatttccctatgctgagttcgtcaggacaatcgcagcactttcgttcatgtatgtggtatgtcaaagcatgtcttgagggtgtgaattgtgaactccaaaccttttcctacagcatttctgccaatgagattttagtgtacagtgtctagtagttttggttttcctcgagcatatagtccaagtgtacacccttgtctggtctacctggaaattgttacccatacaatctaccactattgcttcagcactcacatagtcacatcccatttttctttggaactagctattcttccacccctgttaattgctcttaaagggtgcattccttttcataatttcacgaaggagatgacagatataagttgcttggtatcagcttggtgttcattcaaattaaacttgattcctcaaaatttcagattgaattgctaaccttcttcctcacaaaaaagtaagaagaaataaatattaacctttttgatggcatcaaattccttttcacccataattgttggtatggtgaaatagaatgctttcacttaacttagaagaaaggccagaccatttacatatttttttattttatttttctcattggcatttagcataaacacttgatggggtgatttgcatgtgccaaggaaaattaatttctaatgtcactttgcctttgttccaggtatactttattcaatgctcagtacagactctcccttgaaagaacgctggagttttctgaagaagaaactgaatgcaagaaaagagatagctgtgaagaaattcacagtgttggaaggccttctatgtttctcagcttaccagaagatgtaggcttgacaatcgaatcagaaatggcagatgaaaaattatgtggaaatatggatggactaggtagcttaagtattgaagcaaaaaaactcattctcggtatgcaatctcgcttggattccatggaaaaggtaataaccatctcttacagtcttacctgattggatgatcatagatgattggtagtgatggccatatgtatattgactgccctgcatatatctgccaatcttgtcatacctattatgcacagtgaaaatttcatggctcgttaatttcacacttttttctgtatcaagaatctctgcttagtgcaagcttggctagtgtaatattagaggtcaacttcaccttccctttgaactgtaggttaatcccattggtattctttaacatctttgcaggtttaagctttcacttgaaaactaccaattcagaatttgattgtattcttatattatttttaaccttgcaggagctacatgaacttaagaagaaaaattcttcccaacaaatgcagcaatttgctggagaagagaaaaacgagctgctgtattacttgagatcgctgtcacctgagaaggttgttctgtttctggccttttgagttccgcaactaatatatttcctcttgttggatgccatgtgaacaaaaacagcaaatagcaatcaaagcaagatgaagtttcccagtttcctggggcacctttttgtttcaatttgagctaataaccattttgaacaggttgttgaactctcggagtcttcctgccctggtgtggaagaagctgtttactccgtggtacatggtctgctagcaactctctcccccaaaatgcatacgaatcgctctccgacctcagagaacatggcgggtggagctgtaaattttgggatggaggaggacgatgaattcactgagctcgtggaggacgtgtccctcccatttcagcccctgatatctattcctcgcgaccgtcttgcccgtctattattctggtaataatagcagttccttacctgtgctgcctaccgatacttgacaacgttctgaccttgtgattccgcgatggctgttcaggtgcatgatgctgggccattacatccgaggtcaggagtgccggcttgagctgatgcacctcctggcagtctccagtgatgcacattcatgatctcccctagtctggtagcaacagcaaatgctctgcaaagcttctgtcagctgaacgaactacttctgcatgacaaagacggaaacaggaaactctcaagcatcatgcgaatcgatccaatttggatgctgcaacattagtatggggatacataggagagggagaagaggagcaaacccatggatggccaaggtagaggtcaggtcatggtccctgcagtagctcgaaccaggttgggttgctcagtagcgtcagatttccatataggattaaccatttcatcatggttaaatgtgcttttcaccttcttgttagtttgtgttgtgctatgtgtacaaatcctggagttagtatacagtatttcctcaccgatgtactggtattttggttgtagcaacgttggtgttgcatcctgtatatataacattatactagtagtatgtatgtaaaactcttatatttccttgtgtaaaaagatctcttaatttttccattctatttccttttgtaaaagaatctctttttttttcctttgtaaaagttgagttcgtctacctcagaaaaaaaatgttggattcttctgggctgtgtgggttggaattcctggggaatttaactatttgtcacttttaggttcgtcacttatccaaatgctcctcatttgtgcttaaaaatttgccactgaaaagaggtaattttttaactatttgccacttttgtctacgtgatgtgtccgcgtgaaaagtaacgtgggccccacctgtgagccactcccctctccttctacctacgaccgccgtatatgtatcgaagtctaaaagtacttatattttaggacggagtatgtcaaagttccaaaatacttaatacttatattttaggacggagggagtaaaagtgataaatatttaagaaattaccactctcaagtagaaaattattaaacgtggacctaagagagtcatttggataagtaaaatcttaaaagtgacaaatagttaaattccatggaattcccaatgcctaatacagtagtacagtactacagtaataacctgcaaaatcatttactactagctctgtaaaaaaaggttttggcgccgagtcatgggtaatttgagttttaaaccctacctcatcgagccccagatcccgcccgcgatccccagattcccccaaaaatccaaaatccaaaaccccaaaaaaaagcgaaacacgattccacgaaaccctcgtccccctcctcgtgagatcggattcgattcatctcgtaggcgcgtctcccctcctttcgaattctccatttcgcgctcttctctcccattcccccaatctacttaacctcctcctcctcctcgagctccgaatcccaaaaccctagccccacccgccgccgcacgccggaggaggaggagatggctgacaaggagaactccaccccggcctccgcggcgcggctcacccgctcgtctgcggcggctggggcgcaggccaagcgttcggccgccgcgggcgtcgccgacggtggcgcgccgccggcgaagaggaagcgcgtcgcgctcagcgacctcccgaccctctccaacgccgtcgtcgtcgccccccgccagccgcaccaccccgtcgtcatcaagccgtcgtccaagcagcccgagcccgccgcggaggcggcggcgcccagcggcggcggcggcggctcccccgtgtcatccgcgtcgacgtcgacggcgtcgccctcctccggttgggacccgcagtacgcctccgacatctacacctacctccgatccatggaggtacgcgcttcgatctgcattcgaatggattaggtttggtttggtttgggatctgacgacgatggtgggtgggcgcaggtggaggcgcggaggcagtcggcggcggactacatcgaggcggtgcaggtggacgtgacggcgaacatgcgggccatcctcgtggactggctggtggaggtcgccgacgagtacaagctcgtcgccgacacgctctacctcgccgtctcctacctcgaccgctacctctccgcccacccgctcaggcgcaacaggctgcagctcctcggcgtcggcgccatgctcatcgctgcgtaagccgccgccgccgccattttcttcctctagtctcctcacattgcatcagagattgggggattgagtttggttgttggatggtggtggtggtggttgcaggaagtacgaggagattagccctcctcatgtggaggatttctgctacatcactgataatacgtacactaggcaggaggttgtcaagatggagagcgacatactcaagcttctcgagttcgagatgggcaatcctaccatcaagacattcctcaggtgggcatactgacccccccaaatgatcataatcctctgcaaatgcttgctcccaatctgaattcgtggctgaatgactcattttgtgcatttcccctttgttccacttaaatttcaggcggttcacgagatcttgccaggaagacaaaaaggtaagcatcaatccgtgtgattcatcatattagtcatttaattcttgctcttttgcttctgtgggtgcataaattggtgtatctgacggattcttgtatactcgttgcagcgctccagcttgttattggagttcatggggagttatcttgctgagcttagtctacttgactacggctgtctccggttcttgccatcggtggttgctgcctcagtggtgtttgttgctaaactgaacattgatccgtacaccaatccttgggtaagaactaaaaactattcccctgtataaagtgctgctgtggatctatacctgaaggctaaaaactgtactgcatgtggttctagagcaagaagatgcagaagttgacaggatacaaggtgtctgaactgaaggattgcatcttggccattcatgacttgcagctcagaaaaaaatgttcaaacttaactgcaattcgcgacaagtacaagcaacacaaggtttgtgcacgtcctgcatcatgtagtcttaatcagattattgtcataattgtagcgttggtctaattctgcaattatttggaacagttcaagtgtgtctcaacattgcttccccctgttgatatccctgcgtcatacctccaagatttaacagagtagctgtttttggtctgcaactttgcgatgttaacagtctgagcttgtctcgagctcccggagataaaggaagaattacagttgcagggcagcttctcagctaagttagagtgctctaagcatttagatgctgaatggttttaaagcctgagccttagggggagatttcagagtctatttaggagccactgaatcgctagcaggctaacaggcattctcctgtttttgtaaaattgtagttctgtattataacttacaacatggtgtcttggtttgttgggagaaaaacttgtaatgtttgatatgctggtccattccctttgttaatctttttttatgaaattgtcggttacagtctcagtaccttcttttccctatttaagggtagaatcacaaatggacttgaataacactggtgacttgaacagttatgctcgacaagttgacacctcttgtgctatttaccgtgacaattttgtatcaacatattttgttcaatctaacatatagatgcatgcgcctttgctaatgaatcatcagaaatatttgatgcggttggcttatgaagactactgtgttgagggacttggtgtggtactgtggtgtattcacaaacttgattttctttcagggcaactaatgcagcagaaatgacctcctacttttgtttctgtcttataagtgatgcctacatttgtgttacgtgcaatacagtagcctagagtagttcagatgccatttctaattttctacttataaatatgtgcaacttgaaacttgaaaggtacataaagttttctcctttcgccccaccctttccatcatgaagtttttctacataagctgcactaccttttcttttccaaaacttttcttagcaatgtgtttcatatgagtgaaaattgataatctttcaccttcactaccatttccataaaaaaaagaggaactgtactgtcctttccaaccttaaattaccttcctcttagcttttggtgcgttggaatttcataggattttgctggaatttaaaattagtcagttcatttcctgtaggaattggacaagatcgccactgttctgaatgtttttttttttggaacttcagctacatgttgggaaataaaaattgagaacacttgcaatataactgaattactgataaagacgggatatattcttcgtgtaagaattgctgcggaatgcatgtctttcttcacagttgaatcaactatgatcatgctaataagtttctagctataaaattagtgcagtaacttgtctctgaatttttttttcaataattctgccaagaattccaaatgaacaacaataccttcgaagttcagtaccaccatatgattttgatctgatggtgagctgaacctattgattacttcaaactcatttattcagaaggacaagcttgaggagggacttatgtactggtcagagttgtacatcaacctatcaaagcctgagatttaagtctatcttactctgttctgatggttggtctgaaggctgtgatctcaatctgaagctccctggccatgtcgaattcggcacctcctcataagcaatcggtggccagctgatgctgccttcatgaaaccttggtgctgtcctgatctgtgcttgctggcttgccttctgaatcactgagctctggtttactctcagggagtgcacaaaggcagcatgtgcctcaagaggcagccccatcatcatcctctgcgcatggtaggagcgttttgcggcgctccgctctcgcttgtgagcgttctgatggccgcccagagcctgcgagctgaagaacttcctcatgcagaagttacatgagaacaccttgtgtggtgcagaagaaggcttgggagcctcagactccgagcagtttgctgcttctgtttcttctgcttcggctgttgcttcttctggtgatccctgtgtggcaagagtgaggctcagccatgtcgcgccgtcatcatcttgctcgctggtaagctgctgctgctctgagctctctttgttcaccgacgactcgtctgcctgctccatctcctaccatgtaagtggttcaagctttctggctctcaggtttgcaactcatgtatggtgcatcttctttcagttttcagatggcttttataaaggatgacgaggtaggagaaggcagaggggaattttttttttcgggaggtaataattgaggcttgtggagggtctttgtgaggaatcaggaggtaaaagagttttgtctggagttagtggatctctcttttagttgcttatctctccttcctttcttgcctggcccttgcatacattgtagtggtgctatgctaccctggttgtacatatcccaggggcaaggcacaatgcatatgcttctgtcatcttttcctgtacacatctcactagttgatgtgtgtacccctgctctttttcctaaaagaaaacaagaatcatgatacaaggcatgaaatttccatgacaagctttcttccattggctggtatgcctcatacaggcgccgtttgactattcgtcagggggtttgatgaaagcgatttcccattaacaaagtcatgaatcttgttaggatttttggtctagtctaatcaggcaagcccacagcttctggctctagaatgatggttaggttaggccataagaagcaatcctacaatactttctttgtatgtgctcctgttgaacatcctggggatagatgctactgtaatagtagctatataaaatattcagtttttttttttaccatgtaccgtagaccatagttcaccttttctgaaattagttaacttgcacaaaaagcatgatggttaggtcagaattcacaataagcagcacatataggcaccagcagtaatagtaattagttaattacatcactgttctttttggagtactattattttcaaagatagtgatggaaagaagaagacatgcatccttcttgttacttctattgatattataacaatccgatctgagaagtgacaagtgagaactaacaactaaagtggagtggtgaggcgaatagaattgttttatgcgtcgtgttatcctttcaagagccaataatggagttatatactgcagatatattgtggccatctgctgttaacttgttaggcatcaattttttttttcttttttgctttagtgggagacttgctgtcataagcgtactggaggaggaccgccctgtactttttaggtagccttttgctgggagatggaagctgagttcttgccatcttagctttcctttgttttgtgcaagtgtgatgatgatgatgttagcattggggaggatggatgctttttattggtgatggatagagcttacatttgatactagtcaacttgatcaagatagaaaaggagaggcacctagcttccttccacatagttaaccatatctgcagggggcagtacccaacatgtgtcgctttcatcaagatatgcagatctatgcaatttctcagggacccattggtatctagttctttaatttgtttttgtgcaaacctctttctgttcatatttgatcattactagggggaggtctttgtctttgcttctgatcacttcttttctctggcctaaacaggaacacatcaattgtttgccctgttacaagtgctatgctgatgtcacttcaggtaccaactagccctcaataatgtaaatcttgttgtaagatgagctcaaatccagctcctgcattcattggctcacagttgagagttcagtaatctgaatgtgaaagtgggaaaaatcctatttgttcagatatacctttcttcagagggagggcaactgcattagttctcccaaactgattagacatgtactggtatccatcccatgtgataaatgagcaaacctttttcacaacagttagtaaatgaggaggattagtcatacatatccccttgtccaaaaggtaaataaaatttcttctctgggatttttccctgtgataatcactgttgtctgccatttcatattactggattggtgactcatcagacattgcactgcactgatgacagctgattgcagatagtcatataaaaaggggcttgatctttggatcatgtttggccacaatagcacctataggatcctaaatgatactttcttttgtattgtctagaaaggagaaaaagtttacatcttttggcgacatgcatgcttagtgctgacaaagtacagagaatggttgacaagagtgcaataaaattttggactcgatcaggcctgcctccacaatcacccctaactcaatcttatgtccatattagccgcctgccttttcgtgtgacactgacctctcctcctcgaaggtgcagttgttgggattctcaaggatctgaaaaacgttggacagtaattttcagtagcagttacagtgcttattacaggtgttgtcaccaaactggggagctctcttggcccttttctcatgcagatgaaagcagattgtgataccatttttcttgtgcagatttcttggcttatctaaactctggatctctgcatgctgacgaggttagcaagttgctcaagtaactgagcatggagatgaagaccgacaaagtatgcttcagagaaaaggttctttgaaaaatctgtctttttttcgtacgagtctgcacaactttcttttactccctttatgttctaaagttcttcataaccactttatcatacatcccaagaaaaaataaacttacatactgatgactgccttgaaaaaactcacatactgaataatatttacaagtatattagtatgcattctagattagtcctgttactaaacatggccacttaaaaacgtttttgacaagaacatgtcaattagcagttacaaacttagctagctcgtgagttctcagaagctcttttgggctcaaagcccatagctctatctaataagaagctcataaggctcaaagcctgtaaatctatcgaagatgcaatcttaggtttgtttgctgggcgcctgggccgttaggcaaaactttgcagcttcagaacttgatgatagcatacttggagttaaatggccagtatatatactctacaaattatgagatggatgattcgaatggaggactttggtatttcacagctgattcaagcggagtttagtaatcgagttggcacatgtgagctaatatattcatagagaaacaatctgtcctcaagggttatgattgacataaagcatgtctcaacctatgaactcggagcatgcatgcttgtgttatacagaagttcatcattcttgcaaaaatttggttgctgattccactggcccttttctggcattcagcaaatggagtgtttgattgacaagttgatcactttggatagggaaaaaaaagttcaggggagataagacagttcagtaagcaacaaaaactgtcggtgtcctatcaactgctatcttcatcattgagatggattttatacagggcactatgatcatgcagtataatctctatcgtca

SEQ ID NO: 39668 - DNA, 23844 bp, Oryza sativa
cgtccaaaccatgagacattcagatagaagcagagaccatactcctgacgaactcccttggccgtgggagacggtggtgtagccgtacccgaggacgtccacggcgagcagccgggggcctccccgccatcgcggcgtcgcacgccgtgaagcgctcccccgcgccgcggcgtgcgtcgacgcgagcagcgcccgccgcgcggcccagccgcagcgacaccagcggcgccctggccgcggcggcgcggcgagcggtgcagcggcggcctcttgagcaggtggaggtggccgagcaccggctggctcggcgctgcgtcgccatcacgcctcctcgtccgaggaaggatggcaaccaccaagaacagaacggcgatgacgatgaggaaaggggcggcgccgccggtcaccgccatggccgcgctcatggcaacctcgagactaccacggccgacagcaacagttaccgacagttataattacgaatacagaaaaaaaactactccctccgtttcgaaatgttcgacgccgttgacttttttttttttcacatgtttgaccgtttgtcttatttaaaaaatttaagtaattgttaaatatatttttatgtaggcatataattttatatatttcacaaaattttttgaataagacgaacggttaaatatgtactaaaaagtcaacggtgtcaaatatttcgaaacggagggagtactagcatacggaatactgtccgagctaagggataaattagaggataaggataccagttactcaattagttaattacgctttatctgatgttgttgctcctccctcaactactcgtctccgttttgtttttctttttgagataattaagatcagacagtagtatttcccataatcatttgtctcatataatcaggagacgagtgattatggaaagtctaggtcccatggcagcaggggaaacaaaggagaaagaaggctattggagaggacacctataagagcatgtacaatagtagactataaactagacataaactagatataattggagagagaagagcagcggactacagatttgtagccagctgcagcacggactctaagatacttgtgtgtatgacaggtaggaccaactataaattgtgtagtatatatttataggtaactattgtatgaatcggctattaaattgactataaatgatatggagtcggttgttggctatactattaaacttgctctaaggtatcagctatgagctacagtaccatgggtatcaagtatcacgtctgataccatagatatcaggtttggtaccataagtagcagatatgatacctataggtatcacgtatggtacctaagtaccaaccggtacccataggtatcaagtatcatagtatccaagagattagatctgatacttatggatatcaggtctgggaccccacgtacgcacgtacctggtatcaaggcactgacaagggacatgtgccactgctttgtcggctcgcaaaggtctaccgccaacacctcttgctctcatattcctttccctagtctcctcaacttcactgttccttccttgctgttgtgggtgttatcctgctgcagctgcgtcctgtgcaccctctcttggtgtccagccatcggtgctagcgccgctacttcctgctagcatcatcaccatgcgtgcgggagggtgggtacgtgtcctcttgcttcactcgttttttcactcatgggatttctcgtaggcggagaaaatgaaggggtaggtgattcattgaaatatcccattccacgggatcccgtactctagtcgctctccaatcttggtgcgttcagctacatgatgaaaggaatcaagcaagcaatagtattttaaaaaacaaaagtgctacaggatgttatcccgttcggacgggatggtacctctgagatattgactaatagtctgatacccagttcagacgggatgatacctttgaggtattgcttgataccgagtaggtatcgactgatatccaagtatcatacgatacctctaaggtatcatcctgttcgaatgggatacgtcctatagcattttcctaaaaaaacaagcatgtggtcggcatgtggccatgataggcacgagacgtccatctatcatctagtaagttagggcttggtttacatccattctgaaccaaatcatttaattgacagtgctaaaattttgtggcagtagctagataacattccataattttgtagtagtgagtactgagtagagctagggtttcactgtattcttatctaggccacaagggttaccccagctcgttaaggcttgcgagctagctcgagctagttcgttagctctaacgacctaaaatgccagctcagctcgttaggaaaatgagctgagccaagcgagctaacgatccatgagttttgtttcgaccccaagtactatgttttatgtacacatgtacttatatattctttttttaaaagaaaaatagtagcatgaaacatagcccggttatgttactgtgctccgagaagaaaaatatcaggcattgctgcggcttacatgtgcaatagaatgaccactatttgcacaaatatttgaaatttcaaaattaaatatatagttatcaaattattattattgattacttgcttgaatatcttttgtataataatcaagatctaaatattaattggttgattaattgtcttatcaaccactaccatgtttcatttatggagtgatgtacttatatattctaaatagaaacctagaacaatcacggttgttattgtggtccgaaaagaaaaaatatcagacattattgcagcttgacatgcgcaatatagtgaccactgatttgtacaaaggtttgaaatttcaaagttaaacatgtcattttcaattttttagagataatccgagaaatgccattgacaagcgtctaaatccaagatatgccatcgacaagtgtgagttacaagaaatgccatcgtataaatgattttgttccaaaaatgccatcgtcgttagggttttgtccatcctgtgtcgttaagtgctatatgatgaatagtgtatttaacagtgtggggtggacagaagcctaacgatgatggcatttttggaacaaaatcgtttgtatgatggcatgttttggaactcacgcttgtcgatgacatttcttggatttaaacgcttatcaatggcatttcttggattacctcaaatttttattgttgatcatttgcttaaatatccttttatatgataatcaatatctaaatattaattgtatttttcatccatatcatgtttaattcatggagtgatgtacttatatcttctaaatagcaacctggaacacatcacaaatgttactgtggtctgagaagaaaaataacaggcattattgcagcttgacatgtgcaatatagtgacccctagtttgtacaaaggtttgaaatttcaaagttgaacatgtcattttcaaatttttattgttgatcctttgcttgaatacccttttatatgataatcaatatctaaatattaatagtcttttccatcagtatcatgtttcatttatggagtgatgtacttatatcttctaaatagtaacctggaacacaccacacatgttattgtggtctaagaagaaaaacaacaggcattattgcagcttgacatgtgcaatatattgaccactaatttgtacaaaggtttgaaattttgaacatgtctttttcaaattcctattgttgatccttgaatatccttttatatgataatcaatatataaatattaattgtcttttcgactagtaccatgtttcatatatggagtgcggtacttatatattctaaatagcaccctggaacatagcgtggtcgttactgtggtacgagaagaaatatatcgggcattattgtggcttgactttggggcaatattgcggctattaatttgcacaaaagtttgaaatttcaaagttgaacatgtagttttcaaattattattattattgattctttgcttgaatatcattgtatatgataatcaagatttaaatattaatcgtcttatcgacaagtaccatgtttcacgtatggagtgatgtacttatatacccattcatacctttttatacagggtttagacttgactaagaaagtcatgaattcatgatacacatgaaactaacataaaattggaagttgagtgtttcttttattcgccattggaatacagtgattgctatagcacacgcaatctacaataccgaagccaatctgctattcacatagaagtagataggatagtcttgacaaactcccggggccggcagacagccgccaatggcgtcgccatcggcatcgtcaacccgccgccttcggtcatgtcgacgacatcgtcgtcaccgacctcccaatcaaagcactgcacgagcgccgccaccgacacgccgacgacgcgcacggcgagcccctccccggggcaccgccgccggccgagcccgaacggcatcatgggcgcggtgaccgcgccgccggcgtcgctgtccacgaaccgctccggcctgaactcctccggtgcgtcccagacatcgccgtcgcggtggatcgcccacgcgttcacgaggaccttcgtgccgcgcgcgacgcggaagccgcccaccgtggtgtcctccatggcctcgtgcgccgggatcaccgggccggcggtgcggagccggagcgtctccttgatgacacattggatgtaagggaggttcgccatgtcggcctcctccaccagccgcgccgtgccgacgttggcgtctatctccgccctcgccttcttcatcgtctccgggtgagtcaccagctgcgccattgcccactcgattgtcagcgccgacgtgtcggtgccggcgaagaggagcgactgcacaccatgatcgaatccattgtacatgttgatcacaatggagtagaagtgtagaagtgggacagtaatggaaaactgttttaaacactcaggtgcacgtctacccatttgttacatgttaattaaataattataaaaaaaattaaaaaaattgataagatagattaatatgtaatatatcactttaaaaaaatacaagttcaaatttgacgtctataagttgtaacaaaaataacaaatttaactgcgagtatacgttatatttgttatttttgttacaacttgtaaaagtcaaatttgaacttgcatgtttataaagtgatatattatatattaatctatcttctaatttttttgtttgaattttctcataatcatttaattgacatgcaagaaacaggtggacgtctacccgagagattagaattcatattcagacatcaatggctactcaccaagatgatgcctttgacgacattgtcggtgtagtggtcgggatcggtttcttgcagcgcgaggagggcgtcgatgacgcccttcttctccttgtcttggtcgccatcgccggcgctgccgctacgccattgccggtggtcgtcgataaggccggtgaccattgcgtcgcgccgagcttgcagcttcttcaggctgcccaccttgccgcggagacgatcgacccaccggagcgccgggaagaagtcgccgacgctcggcgtgccgttcaccgagaacgtctcctcgatgatctcctggagcttgcgcgcgtcgacgctggcgtggcggcggcgcgtcgtcgccgcgcgcagcatcacgttgagcaccagctcgaacagcctgggccggagcgtcaccttggcgccgccggcggcgtcgcggaggatggcgtcgacgagggacgcggcctcggcgtggcggtcggcggcgagcgcggcgaggcgcggcgcggagaggagctcgacggcgaggaagcggcggagcgcgcgccagtggtcgccgtggggcgtccacaggacgatggtgtggtcgtacccgaggatctcgccggcgagcgtccgcggcctccccgccagcgcggcgtcgcacgccgtgaagcactcctccgccgcggcgtgcgtcgacacgaccagcgcccgccgcgcgcccagccgcagcgacaccaccggcgcgcccaccccggcggcgaccgctgccagcgagcggtgcagcggcttcttcagcaggtggaggtggccgagcaccggcagcgccggcgggctcggcgccgcgccgccctcaccacccgaccaccatcgaacaagaacgacgacgacgacgaccaccacaaacagtagaacggtgatgccaacgagcacggcggcgccaccattgccgccgccggccaccatggctacctcgagaccaccagtcatgctcgatgcaggctacaatacaacaacagctacccaatgcaagaagcgatcgattcctttcctcgaggaagaactcaagctgggctataaaagagcaaggcccgtgtttatttcatgcgccaaattgtttttttaagtatacggacacacatacgaagtattaaatgtagactaataacaaaataaattacagattccgccagtaaactacgagacgaatttattaagcaaatgtttactgtagcatcacattgttaaatcatggcgtaattaggctcaaaagattcgtctcgcaatttacatgcaaaatgtgtattgatttttttcatccacatttaatactccatacatatgtccatacatttgatgtgatgaaaattttgaaagtttgaagggagctaaacactgctcagatctagtagtacagcccactgcttcaaaaattttcacattggcaaaatgataaaaatcattgtttaatcaatgcattgttagttaaactattattttcctcattgttccgtacgctctctcctgacacaagtgcactgcatggcagttaattggttgaattgctcgtgtctgcgttggagcgcgagtacagctagcgcttaaatagtcacctggtgatatactctctcacctccaactcactgctaattgctaaaactgatgtgacaggcttatcgctagttattgtagctgctataagggcatctctaatatgcatgtaatggtgaccataagcaataaaatacttcctccgtttcatattataagactttctaatattagccacattcatataattaatgaatctagacatatatatgtgtttagattcattagtatatatgaatatgggtaattttaaaaagtcttataatatgaaacggagggagtaatattcttagtacaactttatacatagaaaggtgtgtttggaagagaatattactatggctaatcttaagcttaaagctagccataagaaatataaaattactttatatcttattagcatgtatgttggtttgaatccttcaaactaaaagaattaatagggattattttttgaagaaattggaacgatgtgacggaaaagttggaaatttatgtgtagaaaagttcgatgtgatgtttttggggttcaaactttgaatctaaacacgacctgagtttgtgatgattggagattactagacgggttcgcgcggcgtgacgccgcacggaagtgtgaacaaacaacagtgattctaatttggtgtatacttcacaacagtgatttgatttgtgtatatagcattgaattaaaatctgatggtgttttttagagttctggtttggtctataggaaaaacatgcttagaggtgcgcgtgtatcagcttttggatgaatttatacgaaagagaaggccaggccatctccagtgttaatagatttatcaacatcaacaccaaacgaagtgaaagcataagtctcataaaatgattagaacagctagaaccatcaaaatgcatgggttctcccaaaggatgaggccattccttgaaaataggtagcgaaacacgccatcggcgacaacacttattgtaaacaataggctctccaggatggggcttgttctggtgtgtcctttcatagtaccaaaagacaacacaacatatagaacaacagtaatcagaacctccatagtaagagcggccagaataagaagctatacacaagcaaaagaaagaccacaataagaaagtgtaaaaagaatctaagtaataaatagaaaatcctaaaaaaaagagagaaaaagaagtacctttaagaaaatgagcatgctctttagaaaaacaacagatgaacaagtaaatatacctgtagagttaactggaaaaatatgccctaaaaacaaaataattatagtcacatcaatagttaaataaacaacatatggaaacttaaaggaaaaataaaagaacataccttataccttagttacgacgaagccggcggttattagccaaacgcctttttaaccggttagaaaatgcctccacgcgagaaatacgtaggaaactacgtgctaaaaaaacggtaggtgaacaaagaaaactatcgaacagacaaataaaataagattaaggagggaaaaacaactagccacacgcaagaggaggacgataacatatagattcatcttaaagctgttgacgagtaggaatggaaccaacggaaggacaaatgtgacctagcaaccgaaaatgaagaaaaagaagtacataaaaggcaaaaaaaaattttacacgaccaaaaaacatgcaaattttaaaaaaataaagaaaagtaaaaggaataggaaacaaacctaaatcgtgagcaagaaaactgaaacgagaacagcgtcttattgccccacggcgtgacctagcaaccgaagatgaagacatgacgaaagtgaaaaagagtaacagcaagaccgaacaagacacaaccacacaaggaagctcaacctgcaacggacacagcaaccatcaatttgagccatgaagaattaggagagagcaagccacaaaggaaatttagaaagaaaaaaaacaccaaccaaaactgatggaagaaaacacaagcttagcacatgcggaagaacttacagggaaaaaaatctggtttaggagatgtaatttgcaactacgaagaggcaatctgtcatgcttaaattaatatatagctgaaaaaatgacaaaacgtgggaaaaagtgaaatggctggcataaattaaacgaaccattgtgaacaccatggtgcccttccctccgtaataatatgctattatatcgtatgtagtgccaaattagttgtgtactatggtaattatcaagtgcaaacagtacaatatatggatggatggcatgggggcagcatgtgcacaccacatgttggcacgagcaaagcagtagttaggcctctcacagtgcaatctatagggtccatacccctagtctaaaaagttggcccaaagacacccaccctacagtgcaagcacccatatatgtgtggcttaattggatggagacacaggtaaaggaaacgaagcccacagtgggcgtgacctagcccaccaaatccacaacttaattccccaactacccctctctctctctgttcgtgccgtctcttttacttctccccggtgcgcaccgcatcccctcccgcatctcgcttgcatcgccaccgcttcgactccccttctccctctaccgacggctgcgccggatctcctccctccgcgcgccggctctgcttctcctctcctccctccgatgccggcagccgcggttgccggctcgcgcggcgaccgacgcgcgcgggaggcgccggatctcctccctctgccgccggtgccggcttctcttctcctccctccggtgccggcagccacgattgccggctcgcgcggcgatcgacgtgcgcgggaagcgtcctcgggaggctccggcgccagcggaagacgatgcgccgatggggatgtggtggccacggcggcggatgtggtagtcaacgccagatctcctctctccgccgctgccgccgtgaggaggaggtagtgttcgtcgaggaggacgagcagaagcaggaggagcagaagcagaagcaccggtgagctggtcctcctcctcgcctcccgtgcctgttcttggcgggcggcagcgagtcctccgccgatggcaggagcgatgagtcctccgccgtcaacgtcgctccccacctcgtcgtcctcgtcctcgtcggcggaatcggagcaggcgggggtggtgaagcaggaggagtccgatctgttgaatctcgttgtgatgattttgctttcgttttctttttcatcttgttgaatccgatctgttcttctcttccaatccctaagattttcttaccttttctcttccaatccaatatgtggcgggagaaattatgctgtggcaggaggggattttgggagggcgaatcggggattttgggtgctaggggcacgcgagcacgaggctacgccgtccacagcgcgcgcgtcccacatcttctcctcgctgcgtgccttggtcctggtgaggttctgttagctgccgagaaacctagctaaggcgcggtcgctcgctccacgtcgacgaaaatccgagctggcgcaactaggatccgcgccagctcggtgcactgtgagaggtcttagtgcatggactacagattgtggctgcatgcatggcagtatgcacagtacacatgcaagcacaaagcgtgcacaaacagctactccagaaatcgtttttttctgggacaaagactttcctccagaaatcgactctctttgtgggacggagggagtaaaagtctcaggatgagaactgactagcaaaatcaaaaggaaagtgaaaaagtactatgacgcacgtacacgtactaatccacgctgaaaacatagtatacaccggatacaagacatcagccgggaaccagcccggtcacactagaaaaaataaattacaacaagaaaaaagcaagccacgaggcaaatagcggaagtgccaggaaaaaaaaactcgtgtgtttagttcccgttaaaattggaagtttaattgaaattggaacgatgtgatggaaaagttgaaaatttatgtgtgtagaaaagttttgatgtgatgaaaaaattgaaaatttgaagaaaacgttgaggactaaactaggcctcaaaataccaggaaaatcgaaacctgaccggtgactactaggttagtattttcttcggttttcattcgtactgcactgctgtttgcttcgttactacttctccctatccaatccaacagtcttattttcatcccgatcaacatcgaacgggtaatatgtgttagatggatttggatccggtgcagtacactagtgtgactgcaacataagcagttacaccaggaccttttgatgtaaattcaagggtctaaaatctatgaagtactgtttacatttgaaaaaaccatagaactactgtagcagcaacactgtagcatcagatttagaccgttcattggaaaaaatagatggctgagatgatctcaattcgtctttgatgacgtggcctattcttacggtattttggattcacttttcacttggaaagatttgaagaaaaaaaagataaaagacaaacttttgtagattatagtagcccagccctgctaaatctgtccccgccactgggtttgagcatttgattccatttctaatataacaaaatatgataacgttaatggtttgagcttttttttctcccgattatttcatgtgaagagaccatcatcgaatcacccatgccggctgctgttcaccacggatcaagtccgttgccattgtagttgcggttaaattaatttcgcgcattccatgcatgtggcaaccccatgccggctgctgttcacgattattttttttattttaaacctttcaagtttttaattttaaaaaataaaatcacccgtaacttattttcagtcagactgacatggcgaaacaatgttggccacaccgatctctggctgacgtgataatattgttttaccacgccatcctggttagcgtggccaagcaatatcgtcaggcccaactctaagaaatgggaatgaaattcattcattttgtataattaagtttatatgataggctttttgacacatcaacacatcctatgaaatgctctcacctatcagactttttgacaacccattgctattatatttgttggcggatggcatgaggcccttcgaccaaatctgccgaaacccatggcgaagactacggagcaagaatggcaagaggcgaagggtcgtacgaggagtgagtaagctagaggcgtcccagacgaagggtgcaagatgaagagtatctgccaaaggaagacgacttcgtcgtggcgagttcgtccccgcgagggccaagaaagccttcccgacccatcaagcctaggggctatagggccggcgatcgcccaacggcccatcaggggcccatgagcctccgtaacgttgtgtacccttgtgaatgtccctttcgtaagggcaatcgtgtaaattcccctgtgtaacctaaaccctagcagtaagaacttgtaatggggctatatatagtcccctagggccatgtaatagggagacggaggaggaagaaattccaaaaactaacacacttcgtttctttccaaccactgttgagcaaccacgtctttcgacgtatgcggttgtcgtttcgacaacagctggtgccgaccgtggggacctccgagcgaaaccactgagagcaaatgccaccgaagaaggtcgtgaaggagaaggttacaaggcgaaaggaaagcgacgccgtagcggacatggccgccgaagagggagcagagccttcggcgttggtgaccgaagttggaggggcgccatctgcttctgcgcctgtgccatcattgccaccttcggcccctgccacctctgagcaggtgccgaacgtggccgacgtggcgaaggcggctgcagccgcaagggcacttcagaccagggcggagatcctttcgacaagccagctgctggtgccccaggccgctccgtcgtagccggcagcggcccaaactgcgctctccgccatgcaagtccaagtcaactctgaccctgagacacaaaccgaagccgacatggaagccatgcgacaaaacatgacacgactccaagacatgcttcgtcaaatgcaagagcagcagcaagcgtacgaggcggcaaggcggtccaaggtcgcttcggcaccaatcctccagtattcggcaggatatgtcccacctcgagtctatccgcaagtgccaccccagccccttccgccacaagtcgcgcaggcgtcaatgtacttcgtcgggcagccgacagctgcagcagtgcatctggccccccacttgcaactgcaagctcaactggctgcggcccaagtacatcctcaaccacttggccaagtgtcgcaagcaatggcagaaggggcttcggctctgcaggcacaattccaagctttccttcaacaaatcaatcaaccccacaacatttcgagtacaacctcctcgactcgtccagaggggaatgcaagtcaaggtgctctcagttggttgccgtcgaaccagccaagtctgggggcttcgccgtggagtcaaggaccgcagttcaacttcatcaatgctgcttaggcgccaaccgttcggccgcaagcaccaataccaagctttggaacaaagcaccaacccaggtcgccatgatgtggtcgcagccagttttcgacccatccatggcggctcagcaagcattaccaatcggagccgggcagccgaacaccatggcccaaactcatgcgcaagccgtaatttcgcccttcgccacgccgtacccgcagcaaggtgccgtgaacagggcgggaggcaaaaaggggctaccgctgagtgggggaatcaagacccgtccaatcccaccgtagttcaagttcccacccgtcctaggctactcaggtgaaactgacccgaaggaattcctatccatctacgagtctgcgatcgaagcgactcatggcgacgaaaatatcaaggcaaaggtaatacatcttgccctagatggcatcgcccattcttggtacttcaatttaccagccaacagcatttactcatgggagcaattgcgcgatgtttttgtccataactttcgaggcacctatgaggagccgaagacacagcaacatcactcggcattcgccagaggccgggagagtcaataagggaatatatgcgtcgcttctcgcaagcccaatgccaagttcaagacataaccgaggcgtcggtcataaacgccgcttcggctggtttgctcgagggcgaactcacaaggaaaatcgccaacaaggaaccacagacacttgagcacctacttcgcatcattgacggtttcgcaaggggcgaggaggattccaagcgacggcaagctatacaagctgagtacgataaagcctctgtcgccgctgctcaagctcaagcacaagttcaagtcgccgaaccacctcccctggctattcgccagcctcagccggtgatccagggacagccgccaaggcaaggccaagcccccatgacctggagaaagtttagaaccgaccgtgcgggcaaggctgtgatggttatcgaagaagtgcaagccctccgcaaggagttcgacgcccagcaagcaagcaacaattagcaaccggtccgcaagaaggtccaaaaagacctctactgcgccttccacggacgctcttcgcacaccacggagcaatgccgaaatattagccaatgtggcaacgcgcaagattcaaggccacagcagggagcaactgtcgaagctcctcgagaagcagttcaggagcaggcacccttagccgaacaacgccaagatgcacagcgaagggtaatccaagtgattacaagggctgacctgccaacccagttgtcgaaacggcagaagaagatgcagatccgaacggtccacagcatcacttcggcaggtgaaggggcaccgcagtatctgaaccaactaatttcttttgggccggaggacgccaaaggagttatgttgccacatcaagatcccctagtaatctcaaccgagatagctggcttcgaagtccggcgaatcttggtcgacggagggagttcggccgatgttatcttcgccgaagcatatgctaagatggggtttcccacccaagcccttaccccagcgccagcatcgctctgcggattcggcggagaggcagttcaagttcttggccaggcactttcgatgatagcttttggctcgggagagaatagacgtgaagagcaagtactgttcgacgttgtcgacatcccgtacaattacaacggcatcttcggccgtgcaaccctgaacaagttcgaagccatttcccaccataattatctcaagctcaagatgcccggcccggcaggagtgatagtggtcaaggggcttcagccttcggctgcttcaaaaggcgatctggccataatcaacagagcagtgcacaatgttgaggccgaaccgcatgacctgccgaagcacgtgccaaagcccacccctcatggcaagataataaaggtacagatggatgatgccgaccccacaaagctcgtgtcactagggggcaacatgggcgaggaagaagctgaaagcatcctggaggtgctcaagaagaatattggtatcttcgcttggagccctgtcgaagtgggaggtgtttcgacagatctcattatgcatcacctggcagtcaagccggaggccaagccaagaaaacagaagttgcgcaagatgtccgctgatcgccaagaggcggcgaaagccgaggtccaaaaactactcagggctagggtcattcaagaaatcgatcacccggagtggctggcaaatccagtgctggtgcgaaagtcaaacggcaaatggcgcatatgtgtcgatttcacagacctgaacaaagtatgtccgaaagacgatttccccttgccgcggattgatcagctcgtggattcaacagctggctgcgaacttatgagtttcctcgatgcgtattccggctatcaccagatccacatgaacccgcccgacatccccaagacagccttcattactccattcggcacattttgtcacctcaggatggctttcggcctgaggaatgctggagcaaccttcgccaggctggtgtacaaggtcctttgtaagcagttggggcgaaacgtggaagcttatgtcgatgacatcgtcgtaaaaagccgcaaggctttcgatcatgcgtctgaactacaggagacctttgacaacttgcgcacaacgggcataaaactgaatcccgagaagtgcgttttcggtgttcgcgcaggcaagctgttggacttccttgtttctgaaagaggcattgaggcgaatcctgagaaaatcaacgctattcagcaaatgaagcacccgtcgagcgtacatgaggtacaaaagcttgcgggccgaattgcggcacttagccgatccctctcaaaggcagccgaaagaggtttatccttcttcaagaccctccggggcgcgggaaagttcaattggatgccagaatgccaagcagcgttcgacgagctaaagcaatacctcaaagcctaccagctctgataagcccagcaccagggagcgaactgctactatacttagcagcttcgccagcggcagtcagtgctgccctcgtccaagaaacagagttcggccagaagccggtctatttcgtctctgaagcattgcaaggagcgaagacaagatacattgaaattgaaaagctcgcttacgccctggtgatggcttcgcgcaagctcaagcactacttctaggcccacaaagtaacagtgccatcacagtaccccttgtgcgaaatactccgaggcaaggaagttactggccgactcagcaagtgggcggcagagctatccccgttcgacttgcattttgttgcacgcaccgctgtcaagtctcaagtgctagctgacttcgtagctgaatggacatcagtattcgcctccgagctcgagcccgtcgaaaaatcctgggtgatgtgctccgacggtttgtggtcgcataagggggcaggcattgcggcagtactcatttcgccgaatggtgtgccaattcggtatgctgcaaggctgcagttcaacacaaccaacaacgcagcagaatacaaagccattcttctgggtctaagaaaggcgaaagcactgggagtccggcgcttgctaatccgaaccgattctaagttggtggcaggccacgttgacaaatccttcgaggcaaaagaagaaggaatgaagaggtatttggaggccgtttggtccatggaaaagtacttcaccggcataacagtcgaacacttacctagaggccagaacgaggaagcagacgccttggcgaaatctgttgcttatggcggaccacatttgcctggcatctttttcgaagtcctacttgcaccaagtgtgcccgtggacagcttggaggtcatggcaccgggcgaagacccacacgactggcgaaccccgtttgtaaaacatcttgaaactggttggcttccggaagacgaagcagaagcaaagcgcttgcaaatcagggccacgaagtataagatggtctcgggccagctctatcgctccggggtacttcaacccttacttcattgcatctcttccgccgaaggcgaggaaatggcgaaggaaatacaccaggggctatgtggcgcgcaccaagcggcaagaacggtggccttcaaagtgtttagacaaggagtttactggcccactgtgttgaaagtctgtgctgagcaaatcaagaagtgcgaaagttgccaacgtcatggccgaagccaaaccgtgccccactatgatttgcagcccattgcgccaatctggccctttaccagatggggactggacatcattgggccgttcccggtggcgcgaaacgggtataagttcgtaattgtggctgtagaatatttctctcggtggatcgaggccgaacccctcggagcaatcacttcggcaacagtacagaagtttgttaggaaaaacataatctgccgtttcggagtgccaaaagagttcatcactgacaatggcaagcagttcgactctgacaagttcagagagatgtgcgaaggacttaacctgcaaatcaggttcgcgtcggtcgcacacccgcagtcaaatggggcggccgaatgtacaaatggcaagatcctagaagcactaaagaaaaggctcgagggggcagcgaagggtaaatggctcgaggaaatgttatctgttctctgggcccttcggacaacccccacaagaccaaccaaatttagcccgttcatgcttctttatggcgatgaggcaatgaccccagcagagctaggggctaactcaccaagggtgatgttctccgagggcgaagggggacgcgaagtgtcgctcgaactcctggaaggggtaagagtcgaagcactcgagcacatgcgcaagtacgccgtaggcacttcggcagggacccctcgcacttttgcgcccatatcagtaagggcgaggcgaagcgtttggcacgccgttcgtgcggacttggtagttttcgccatctcccgcgagaaccgccgcgactcctctgcagcgctcgcttcggccttgctgacctcctggcgaagagcctccattttcggctcagtgaggttataataatccgttagcacggtggagtgagccttttctttctccagttcggccttgaggtgatcgacctcagccctagcctctctccctttctccaattcggattggagccgcttgttttcggcctgcgcctctttcagggtattggcgagggcctccatctccaaattcttgcggcctatttcgtcatccttggcccgaagacggtttttgaatccatcaagacgagcccgcatggttcgctctgtcgaacagtgagccgcaaggatctggatgcaaaatacgaacgccgaagagagcaaatattagttatgggacaagtaaagaagtaggggaaaactaagaatagagaaaaaaaacatacccgaaccgccaagcttttgatagcacaacacccctcatcgaactcgttcagttcggtgaacagactcggggtattggcaggtaagacaagattgcttaccccctccacaaaaggaaggaggtccgcccgggtctcgaaatcgctaggggcgaaatgaggcgccacaagcgaatactccgaagcagaagtctcgacggctgcccccttccccttcgcctcgattagcggcgatgcaaccggctgacgcagagggctgccgaagaccctcacggcagttgtcatgatccgttccgcggaggccgaagccccagcggcagcgctaccgccttctccgtcagcaccaagtggaagaacgggggcgatcgaaaggtccaggctacggccagcgggcgaagtcggagtcccatcagaagactcgtcgtcgctgaaaatgcgagcgacgtcgacgagtcctttcttcttagagatcttcttgaccggacctcccttcgtcgccttgcccgacgagaatgcaactagggccttcgccccgtccaaatctttttgtcgaaggggggagcttttcgactccaccccggtctcgttgtggccggactgggagtgggagtgtagccaggagtatcaacgcggtcttcgatcgcctcgctcgcggccttttcagccacggcctccgcctcctcttcttcctccccttcttcctcgccatcatgctcttcggcatcgtcctcatcatcggcgtcgaaatccaacgaagcaggagcccttcgcttcctaggggcaagctttacttgtccgcgtgttcgctttcgcgaaggtcctacatcgtcgtcggctttgtgggggttcgcccggggaggcaattcaccgttgtcgtgtcaacagctggctatactcgatgaccgacacatcgccgatcatcctgcgggcttcagtttcagcctggtcgagggttaacactgtaaaagtaaaggatgtagctacattaaaggtcgaacaaggcaaaatagaacagtcttactattcattccctcaaggagaaccagcttcggcaaactgtcaatctcttcgctctgatcaaccgtaacctgccatgactgggagaggggaaagatgcgaagcatacagaattcctcaaccaagtcacggcagctaaggcgagagcaaacctttcgtagaagaacgaaccgcgcctccatagcgccgtccacggcaatcttgggtttccggttcggcacaatcgccctgcgccggcaccaaagagctttcaccgagtcagaaccagcctcgaaggggatggtgtgatagaaccacctcgccatccaatggcggtcccacttcgacatggcggcgttcaccggccagagatcggaccgctcagggcgaacgttaaagttcacgctcccgaacactatcttctttgttccagccggggtaatcactgtcttcaagttcacggtggcgaaaaatatagcgccgaagagtgcggcgctaggttcaaacccggaagtccggcacgcccagtcgaagatggagatccgaaccaacgccgacgggctcaactgtgggagctccacctggaaaaggcgaaggatctccggcaacaacacgttgcacggaaaccgtagccccgcctcaaaaaagacggcgaacaccaccgtccgattgtcgacaggcttcggtactacggctttccccggggcgaaaccgcctcaaccaacgccccagagctgaccaatttcgccagctcgacgtcgtccatgagagaaacccccaaaaaggcggtgctatcatcatcaacccggccgggatccggccctttcgctgaaacagggtttggcttgcgaggggccatggcgaagggtgtgtatgtgatggcgaaggaagagaatgggcgaaacaccagaggggtcaagaaatgctgcggaaggaaagaacaaaggaaaagagtgcacgcggtaaaaatggcaagtgtaacaatgaaaaggacagaagggtgggaatatatagcccacccgggcgacggttcgcctacccaccagtgccacgtgtcgcaggggtaggcgaaacggtaaattcccatcgaccgagcagcatagtaaaaaagcccataaagggaaagcccaatattgttcccttcggcccggcaaaagtaaaagtatatatatttgtataccactggccatgggggcaaacagcggcaaaataataccagccgcacaagtaacaaactctatttgcaggaacaatgtaggtttcggcaggagcatcggtcgaaagggggcgccgcataccataccacatggtgtgcatggtctcggccgaagctccattctcacccttgcccgtgaggggcttgttggcggatggcatgaggcccttcgaccaaatctgccgaaacccatggcgaagactacggagcaagaatggcaagaggcgaagggtcgtacgaggagtgagtaagctagaggcgtcccagacgaagggtgcaaggcgaagagtatctgtcgaaggaagacgacttcgccgtggcgagttcggccccgcgagggccgaaaaagccttcccggcccatcaagcctaggggctatagggccggcgatcgcccgacggcccatcaggggcccatgagcctccgtaacgttgtgtacccttgtgaatgtccctttcgtaagggcaatcgtgtaaattcccctttgtaacctaaaccctagcagtaagaacttgtaatggggctatatatagtcccctagggccatgtaatagggggacggaggaggaagaaattccaaaaactaacacacttcgtttctttccaaccactgttgagcaaccacgtctttcgacgtatgcggttgtcgtttcgacaacaatattattcagtgtgaaccattaattatctctaattacttatccagatagtattgagcgccataatacgagttattatcatataatgaagtgaaaagccgatgtgaccggttttgcttttaagaagagctcagtgttggcgtaaaccatgaatcaaagtttaggttagtccattggtaaaggtcttttcttctatgaaagtttcatgagatattgacgtggtaccttctagactacaccaatgtcttacatttcctcgtaataataacatcattgttgttttggtcgaagtggaaacagtccgactagttgtcacacaatcctaattggtgtgggcgttaaacaatactgccacgcccattacgaatggcgtgataatgttgtttcaccatgctatacaggtagcgtggtcgaaaggttctcattttagaagtaaggccctgttcagtgcagcttactgctgcaacaactgtaactagccaactacactaacaacaccagtgtgtagaaataatgtagttgctgtagtggctgcagctgcgcagctgcaaaaaatttgcagcgaacagaccctaagttgtcaaatgattttatttttgaaatttaaaggtttaaaataaaataaagtgtcactgttcattggactactcctatatatagttgtcatatggcccattccatttagtgatgaaaggtatgtacaatcaagcatgaatgcacgagagacacagcaccattcatgctttgatgatgatgttcatcgatcgaaaagatgcatgtacttgatgatacggccacaagcaagggtcgtcttcgccgggatttggatattgtgactgcaacctaagcagtagcggtacgcatcgttggatacaaactgaacgacctagatcgtgtttttactgttcacactaccgcagcaataagcactgtagcacgaagtactgttcacctggttgctgtagctacgaatctagaccattgatcgcaaaaatggacagccgatgttgcgtgcagttgctaagttgcagttactactgcaactgcacctgatccgaattctcttcggcgagcaatcaaccaaggggacgcagctcctcttacagactgacacgttagagggaagtgcgttcttaattaataggtggggtctatttttatgggcccacatgtaagcagcatacgtccctctgatgtacgtcaaaggtgccttacccgtacgcaaggacatattttcacctgagaactgctttgtataattaactagatgaatatccagctgcgttgctgtggaaaattaagttgtataatatgtacaaataaattgtaatatgttttgtaaacaaaaataaaatgacttcatatattttatataatttacacatggttgtaaatttaattcatttatgaaacaaggaaagtatagcgagaaataattatcagttggaagttaacatgcacgcaatctatgcgtgtaaccagccacacgaccttttacattagaattttctaaaaagtttgtaatattcatagtaaatgttatgtgtaccatattgtttgcactagaaaacttttaagttcaaaaatgactatttttagggtgtttaaaaatgattataattctaagccatggattaattgttttgtgtaaaaccttaactcaaaatttaaaatgatttcaaaagtttgattagtaactgaaagcaagatgtgaaatagcatttgatcgactaaactgattgttctatcgtcatttggattttgaatatatttagcagattcattcaaggtattaattatgaatcctataaatctatacaagtgattctcaattagtatagttattactccctccgtttcaaaatgtttgacaccgttgactttttagcacgtgtttgaccattcggcttattcaaaaaaattcatgaaatatgtaaaactatatgtgt

SEQ ID NO: 39669 - DNA, 20023 bp, Oryza sativa
aatggtcaaacacatgctaaaaagtcaacagtgtcaaatattttgaaacggagggagtattacctattttcctgaactatggttgtgccacattatccaattgatccacaatcattggatgaaatctgaatggtttgccacttcacctaccataccaacaccaaagtaatcgaaccgatcggtacaacgatgagcgatcctggtggaatagcaagcccacatgtaagagaacccctaatgtgcgatcgatcgatggcatctccccgcgcgcgatcagatacgataaaacatactccctccgttttacaatgtaagactttctatattgtccacatatatatatatatatatgctaatgaatctaaacacatacctatgtctagatttattaacatataaatgaagagagaatccacttagtgccactgagttttgtccgcttctacaatatacccctgactttgtcaagttgaacaacatgccatcaggttttctttaactttcactgcgtgccatcgccatccacgagccgttagttggcctccgttgaccgtattgaattgtctctaaataactaaaataccctttgactaaaatatcattgtacttgttgaccgaaaaccgtaacacaccatccacccccaaatcgatctgttgatgtttctcctccagtgagcggcgccgactccccatcgatggaacgccagctgcctgactcctcgacgcgccgccggccggccggctccccgatgacgcgcggttggccgccttgctccccgacgacgcgaggccggccgcctggctcccccacgacgcgcggcccggagctcggctccccctcgacgcgcggcggctcgccggcctccccatcgacgcgtggctggtcgccggggtcccatcgacgcgccgccagccgcccggcaagcagcgtctccatctcaatggactaccaccgaatccacccggtgggcgtcggcgcaggagccgcgggcggcggtgctgtcggtgcgtgtgctggacgctgctcgccgtgctcgtcctcgccgtcgccgtcgccggcgagacgcagctggacagcgccgtggtggcgcagctgctgcagcagcaataggccgggttcgtgccgctcacggtgtgggcgcgcgtgccgatccgcatcaagttcggcgccatcaagctgtggaagatgaccgggaaggcgacctgcaacctcgtcgtcgacaacctcgtcgccggcaggcggatccgaatccgctccaacaactacagcttcaagctcaaggtctgatcgagctttgtagaggcgttgatccatctccatctctgtgaatccatccgttgagttgagattagcaggtggtagaggcgtgtatttacatttttaccgatactagtttctgcgaatccattcgtttttggaagcactgctactcagattagttttaatatatgagcaccgatgtatatatgaaaatgcatacgcgatgaatttctttgaaaattggaataaagatggctaacatatataataagttagaggcaaataggtctttttacatcgctaacagatgctaactgttctgtgatggcacgtagtgaaggttaaagaaaacataatggcatattgttcaacttgacaaagtcatgggtatattgtagaagtaggcaaaactcaatggcactgagtggattctcttataaataaatatgaacaatgttagaaagtgttatattgtgaaatggaggaagtttgtggtaaggcttctacgtgcgggagtccacgatgaattcaaaaatccatccaaaactagttccttgaaaaggctcattaactacatgccctccctctcctttcgacctatgtgtgaatagataaaaagcccatatttttttgctttgagctggcaaaaaaataatataaaaaaatatagtaggtagcaattttatacatagaaactttatacctagaaagtttatatatagaaactttcaacatatgacaaattggtatataagctttgtacataaaataattggtatagaaactttatacatataaatatttagcatatgaactttgtatgtaatgtaaaatatccggtataaaaacttttacacaaaaagtttcgaattaaaataaaacagaaaaacataatcacaaacacttgattgggcaaatgtgttcagcccaacatgtgcaagaaaaatgaaataggccaagtaaaaaaaatccatgcgtttagcccataaaacgaaaagaaaaatgacggcccaacacaagtatcatctgggccaaaaaaagcaaacggacgtacattaacttttggaaaaagtataatttgactccctcaactatcgtccgagtattcatatcctccaaccacaaaaccgggtatatcgactcctccaactatcaaaaccggtgtaaacaatatccctggttttggctgatatggcgcctacgtgacggttttgaccgagtcttttcctacgtagcacttacgtggcattagaataaaaacaaaaattaaaaaatatgtgggacccatatgtcatacaaaaaatatatatattgtaggacccacgtatcatcctccctctccttcccttcttcctccccctctctctcctttatctctctctctccccccggcttttctcttcaccggaggagcggcggcctccaccggcgggatgcgtataggtacggcggcttctaccaccgtggggagggattccatggcaacgagaagcagctggtggccgagatgcccgtcgagccggcaacggcgactaccgtggtgcttcccgtcgcggagccagatccggactcgagccacgatgccgccgtcgcggccgccgaggagccggtccatggcgaggccgatgaggaagacgaggatgagatggcgagtagccggacttcaccggagggatgtttgcgcagaccgttcacatgccgtccgatgtccgtctcctgcaaaagcacaaagcaggaacttcaacttcatctcctctccttttgttgcaaggggaacagaacagcagtgacggtgaaagaagaatgggggtaaaaagcttttgttttcacctggagcgccttgtacgggatgtccatgtctgccaggctctgcagcaagctcagcagctcgtcctccggctgtgaggaaacaaaacgaaaaaacgtgcagctcgtgtcaaatttcaatggtttctttgatcgaattcgtcggcgaggtggtgaaagaaaattaaaaaaaaaaacctcagttgttgtagccgccgccgggcgtagagccgctccacgataccgtcgcgccgcgcgcgcagctcgtcggggcggtcgtgcgcggcacaggccagcgcggcatccacgagctcccacacgccgccgcctcctcctccaaattccgccagcgcgcggcgcagccactcgtcgtcccgatccatctcccccctcgcggcggcgccggcgagacccgacccgtccgcgccggagtatatgtcggatctttccaactcagcgccacacctcacaaaccccatcaaccaaccaagaatccgacaccaatcaagaacccaacctccccatcaccactgccgccgctcccgaccgccgccgccgccgctctggtgaagagagaggtcggggagagagagaggtaagggagagagtgggggaggaagaagggaaggagagggaggatgacatgtgggtcccacaaaccatttttgtgtgtgaatgatatatgggtcccacatatttttttaattttatttttattctaatgccacgtaagcgttaagtaggacgaagactcggtcaaaaccgctacgtaggcgccacgtcaactaaaaccatctccaaaaccatctaggaacattgtttgcatcggtttagatagttggaggagtcaaaggtatatttttttttccttaactttttcgcacagcaaaggctcctatagtagaatagccaatcttgtccacctcctgatcttttttgtcctcaaggcacccgtccattcctcctctctcgcggaagcgcatcgccccacgagggagaaggcacgctccctgcgtccatattcagagagcttctgcaggccaggcatcttctcagtcaatatctctttgccataaccaccatctccgatctcctactctcttttcaatcgtttgatgttgcatctgttcgagagctccagctgcttcgtcctggattgctgctgtacaattgcaagtgcaacatgtactagctccatgaatcggctccacaactccacaagattctctcgcctctcacaacatgtttctactgtatttattgtttcacattcacaatcactgatcttttgatacaatgatattaggcagctcgctaggattaattaacatttcttctttccctttttttttcccagcagatgggccatattgcttagattttattttccctgacctcaatgctccagccagcttctactcgacgcctctctttgatgtagtttattagtatctcccctgttttttctatcttcaaatttaatttgtctctcccctatcagaactcaggtgtcctttccctaataagaggtggtttctggaattatgggggttgcagtcctttttttaaattttcctcaccattgtcatcaggtgattccaatgtactaaccaaataatttaattgcatgaactgatttgatcaagcacaaaccaacagtgcgcctgatgtccatctgtagtagtgttaaggtatttgatcctcctctagatattagatttccactagcaaaatgctttgctatgggtaaaatatacatactttgctttgaccattcttatttgaatatatgttatttacatgattgaaacaaatattaaagtattgcacaatatcatagactaatttgtaatatgtacaaaagtagtggtggggtcccccaccaccactattatcttttatagcggtatagattatctcaggctgataagtttgtcaatatttgttctcataatctcattggcttctatttgtgtcattgatgggttttcacctttcttgcttgacccatccatcaaatatcactttttctttcgtttacaaaaagtataaaaatgtttaagctctactgggaaaaaaattcagctatcattttagccaataaattgtgcagtatactgctgcacacgacgtaaaattgaccctttcaaatgtcatctcatatatttttactttttttttgttcagaactgaattatatgtactttttatattatatttcaatacagtatatatgttgactaaactgttactttcacacattggttgtcactgttctattcttttcctacatttttgggcaattctgatgtggtaagcttgctgcaacatgcatactgttgctcaatcaatagtgtttgttacttagaatgacagttgtcaacttttcattggatataaggcgctatgacttaatcaggtggtccattcaaacatgattttagtatataaaagagaatgtgactcccatgagcccttactaaaaatgtgaatctctcgattatttctcaacttgggtaattgtcttcttggcctaactttcctaaagtagtacttttttccctaacgagactactataatcgctcttccggcctcatcttttcgtttatacttatacttattagccaaaatttaaatttttaatataaaatttggagttgattttgtgattttttttcatcgaagtttatttttcagcctttgttttcagatcgctaagaacacgtatataaaaattttattcataaattatttttaatttgcaaatatgttgtttcgtttattccccaaataagcgaaccgatgggtccgttcattaataagcttgtacaggtacaactatttacttagcaaacatttattctatatttctaaaatttgaatttcaagacccctctaaacattgccatcactaaacaatccaaatcacattttggatttactattttctttcagaaaactacaccgaaacatcatatattcagaagcaatcagacaccacagtcttgacaaactctcgaggccggcagacagccgccaatggcgtcgccattggcatcgtcaacccgccgccttcggccatgtcgacggcgccgccttcgccgatctcccaatcgaagcactgcacgagcgccgccaccgtcaggccgacgaggcgcacggcgagcccctcgccggggcaccgccgccggccgagcccgaacggcagcatgggcgcggtgaccgcggtcaccgcgccggcgccggcgccgtcgtccatgaaccgctccggcctgaactcctccggcgagccccagacatcgccgtcgcggtggatcgcccacgcgttcacgaggatcatcgtgccacgccggacatggtagccacccaccttgcaatcctccatggcctcgtgcgccgggatcaccgggccgacggggcggagccggagggtctccttgacgacgcactggaggtaggggaggctcgccatgtcggcctcctccaccagccgcgccgcgccgacgttggcgtctatctcggccctgaccttcgtcatcgcctccgggtgcgccaccagctgcgccatcgcccactccgttgtcagcgccgacgtgtcggtgccggcggtgagcagcaccaggacgatgcccttgacgacattgtcggtgtagtggtcggggtcggtttcttgcagcgtgaggagggcgtcgatgatgccgttcttcttctgatccttgtcggcggcggcggcggcggcgcggcgtgttcggcggtggtcgtcgacgaggccggcgacgaacgcgtcgcgccttttctgaaggctttgtagggtggccacgacgccgcggagacggtcgacccaccggagcgccgggaagaagtcgccgacggtcggcgagccgctcgccgcgaacgtctcctcgacgatctcctggaacctgcgcgtctcgtcgccggcgtggcggcgcgcggtcaccgcgcgcagcatcacgttgagcaccagctcgaacagcctgggccggagcgtcaccgtgccgccgccgccgccgccggcggcggcgtcgcggaggacggcgtcgacgagggacgcgacctcggcccggcggtcggcggcgagcgcggcgaggcgcgcgttcgagaagagctcgacgccgaggaggcggcggagcgcgcgccagtggtcgccgtgggaggcccacacgacggtggtgtggccgtacccgaggacgtccccggcgagcagccgcggcctccccgccaccgcggcgtcgcacgccgtgaagcactcctccgccgcggcgtgcgtcgacacgagcagcgcccgccgcgcgcccagccgcagcgacaccaccggcgccgcccccacccgcgcggcgacctccgccagcgagcggtgcagcggcttcttgatcaggtgcaggtggccgagcaccggcatcgccggcgggctcggcgccgcacctccatcacccaacctcgtcatcacaacaacggcgaccatcaagaacagaacgccgacgacgacaaccaggctagcgtcgccgccggtcaccgctgtcgtggcaacctcgagaccagccatcatcgtcgacggatccgggaacggcaagaacactctcaggaagcgattcctcgaggaagaagaagacaagaagaggaagagcccatcactccaattgatgaatggcccatgccggctgctggccgccatggctgaggtcactgtcagctcagctaagcgtcgccatcgaagctgctattccgtcaatcgaatggaggagattgacatttggcgcattctagacaacttcccttttttagaataatggatttaaataaaacctagccacttctagacaacttctaattttgtaccgaaactgtggctggcacgtcgctgctcactgacatatgggtccgaggggctgtagggtccacacgtcagtgagtaatgctgcagatgacatgcatcctcgctatctatggtgtcctattttattcagcttaaccgtgtaactacttactaagcagacatgtttttttcatactgtttaaacggtgtatttttaaaatattatatataaaaataatacttagttaaatcaaataagtcaatttctcaaatttataatgattaatacttaattatattgtacgctattgacacgtcttgtttggcttgcaatgaaaaaactcaagccaacaccatatttaaacgcaacatagaagacatcctcggaacgtagagttgaatgaaatttggaaaaaattcaaggaaaatgtactagttagccaattactgcaaaaattacttttttattcaaaggaccattggtgattatgttaatctcaaaatatattggcccagttttctagaggtgtttatagggatagtgtgtgcgtgtgtgctcatagaagcgggtgtgtacgtgttgttaatgtctacgtttgtattgtgtttctaaaaaactgacaaaatatccaccttaaaacgacggatcatactttagaggagctcttggtgaggttaaattaatcaacgtgtgcgtcaatggaaaaaaaatcaagattagagctatggatggacatatgatcaagctacggatgaactcaaactcaagttgaacatttacaattaatgtatataaatggacatatgactaattatacctactgtagaatgggggacttttggtggaatttccgaggagttgaactaatttcgtttgaaaatgctgtacaagttcatgtgtttcaaaggtgctttaaagccttatccgtagttcctaaaaggttacgaaattacacaattaagatggatgtatgaccggttttaatggcgatagataattttggacggcactgcaaacttatggatatcccttgcttcaaagttttcaactacttcctcgcacagtgacttatactaaaatgaagctattttttcaccttcatcttctcttagccaagcataaccattctcttcaccttgtttctcatctccactaatcataatcttttttcaattatctctacctattttttaatacccgtgcttgtaaaaaaataattacattatgggatggaggaagtacatattaggcgtaagcaagtattttgggccttttgggccagatgagaaaaaaaatgtattttgggcctaaaaaaaagtggagtagagaccatatgcatgcctataggcctgaaaagagaggcctgattgcagttttggggccaaaatgaggaaatcttgaccccaaaatgaactgagatttcaagtgaggctttgttttcctcctaggtgaactttggctttttaattatgttttatttaccataaatcgagcatcaatttccctaaagtagtacttcctccgtttctggttataagactttctagcattacccatattcatatagatgttaatgaatctagacatatccgtttcaggttataagacttccgtcattaacatctatataaatatggacaatgctagaaagtcttataacctgaaacggacgaagtattaccataggttcaaaggtttctggattgctttgtttataattatcccagtgattttgatctcctgtcctttaatttgaagtgcatgtattgtaattaaaatggtataaattaacctatgaacacgagagctaatgaccgaatatttgactatttggttgaaatcaattacacaaaacaattatttggcgtgacagatcctataacgtatcaaagaaaaaaaaatttctagagacttttgagcacagactccatctccacacgtggtaggcacatggccatgagaggcacggccataggcatggtgagcccagaaccttcactcatatcaaccttcttctttccgacgcgctcccactgaaagcattgtatcataacccctagcgccatccctaccgtcctaagagcaaggccttcaccggggcacttccgcctccccataccgaagggcatcatccacccacttccatcgactttgaaacccttgaacctctcgggtatgaacttgtccgggtcctcccaaacacggggatcccgctgcatggagtacacgtcgaccaacaccatcgtcccgcgtgcgatgacgtgtccagcgaccatgcagtcacgtgacgcctcgtgcgggacaaggtgcggggctagagggtacagccggagcgtctccgtgatgatgcaccggaggtaggggaggttagcgaggtcgggttcctggaggaggcgggacatgccaacaacagagttaatctcatccgttgctttcctgagcacatctggattgttaaggaggagagccatcgcccactcgatcgtgcttgctgatgtgtcagttccggcttgtagtaaactctgtatagttacacacatgttgaaaaagattaaatttgaatatagaagcaacaaatttcaatggcaacatggcttaagcctttggtagaagtgacatatatgtcaaagatcattaccaaaaccattaacttaatcaatgctgaatcattgtgactagtaaataaactaaacactcagtgtgtactacacatcagactgttgacattaacaaaatggctagtgtgatgcatcatcactgacgactaatgccatacatgatagctttctttatatttttttcttgttaaattatcattcattcaagtactataaacagtgaaaccaactcaattcattttcaaacttataaagatactactagtatcaaccgtacttaaaaaaaatcactgaattattgccacaaattaattaattagctatagttcgcagtgcagtacacatcggcctcatttcgcggtgatgagatggacgaattttttgaccgtccgattgaaaatcgacggctaggagtactctaccacgtggcgcgtgacgtcactctgacacgatgcatgcgaggtggattatactattggagtacgtaccaagcagacggtacggatgacctcgtcggcgtacgactccggcgagctctcctgctgccggagcaggtcgccgatgaccgtacgccgcggcggcgaggaggagaagtcatcggcggcgacggcgaggcgacggcggtggcggcgcctgtactcgtcgacgatgcgctggccgaagtcgtgccgctccttggcgatgccggcgagccgccggcgggctctcccgaagtccagcagccggaggaacgggaggaagtcttgccggttcgccgcccccgccgccgcgagcccggcctcggtgatggccttgaaccggagcacgtcctcctccgccatgcgctcgccggcgaccatggacatgatcacgctcgccacgaacccgtacgccgccggcttcacgccgacgacgacggccgacgccgccgacgacgacgaggaggacgagtagagcctcgccgccatggcgcgggcctcggcgtcgcgcgcggggaggtggcggcgaggcggcgggcgcagagggcgtggacggtggcgaggcggcggaggtggcgccaccgcgcgctgtgccccgccgtggcgatggtggggcagccgtcggtgagcagccgccgcgacgcgagccccgggcggcccgcgagcgcggcgtcgtgcgccgtgaagcactcgtcggcggcggcctgggaggagacgagcaccaccggcctcgcgccgaaccggagcaggaggagccccgcgccgccgccgtagcgcgccgccagcgcggcgagggagcggtgcagcggcttcttgaggaggtggaggtggccgacgacggggagggccggcgggctcgggatgcgccggccaccgtcgccattgggtggtggagcttggtaggataggagatggaagagaagccatgtgaggaggaggaggaggagaagagaggcgaagacgaaggcttgtgagatctccatggacaaggtgaatgaaactctgcatgccatggagctcagaaatcacaatggttctggtgtttatgtagcactccctccgtctcactcccaaagacacggtcgaatttgtcatagtcttcaggacaaatatttgactttaaatttatcatatattataatatttgtagcaacaaaatcataaccatatgaaagtaaatttaaatgataatccaatgatattattttcatcaaataaaatttaatttataataagctatttattagtcgaatatttaaaagagttgaattttaaaatacatgtgtgtcttagtgagtgggacggagagagtagggtattgctggtctttaatttaatgtggtgccaagagtatgtaaaagattgaaacaatttatgatttgagctatatatttattatttgaacttatgttaatttagagtgggtcatcagggtttgctttcttcactatgattggctaactctgatcatggctttatttatactccattcatcttaaaatataaatataagacgtgttttatttcgataggataagacttcggccaacgattactctattagggtataatttttatgacaaaaataaattaaatttgttagatttatatctaaaaagtcttacttacgatcatagataaccaggccagaagtacttccattatcttaaaaaggccatgaggagcttagaatagacaactcacatgcctatccatcctaaaaggatattaaaaaaaccccaaaattatgccaatagtgatacgaatacttgtatatcacaaatacatacagtttttcagaacaacaacttacttattctccatgagcatgtttcccaacctgctgaaccgtgtgtttcatgaaaaattttctatatagaattttcagtttataaaaaactttgaagttttttaaatcaaataaatccaatatttagtgtataataattaacttgattaatcatgcactgatgacttatctccctctcaataaaaaatctcagtttacacgctgaaacgagctcatgcttagctttaatttgagaagggaattttcctttaagaaaataatctgacaaaacaaattatcctaagcaagaaatggatacatatgatctctgcaatatccaggaatgtttccaatcgtgcacgtgggaaatgctggcattaggatagcataaatcacacgttttttcatcagtgaaaatcacacgtttttggagagatatcgagagccatgcatatccatcaatccatcatggaccatatacgcgttagggttcaggggcccgttgtgatgcgttcttgcaccagctgggtatgattcggatctatctgaattctgatgatgatctgtcggcgagatgacgtgtacctatgccgaagttgaacattgacatgcgtactgttgttgagtgccgactccacttaattaccactgcctttcacattgtatatttggtgttgagtgacgcttgtcttattatagtattcagaatattccaatatcctaaaatataatataatataagtatttctaattataaatttagataactgttcgtttaaattcatacttaaaaaaattatattttgggcggatgtagtacaaaatatgaaaaataactatgcatcctcgttacttttactcctcaaattttgcaaattgtctaggtagtaaagttttacgtggttactatgtgtaatcactttctacgcccacatcaacgattgagaataggtatactgacaatatatcatatagaagcaggctcaacttggtaataaaccctgagatgcgcgcttatgtggttttattgtgagcttggtccatcatggtaaaaatttgtccaaccccatgggctttcaattatagcctatagattgtagacatattgttgtcctagctggcaaaaccacttgtcaaagctttcacatacgtgacatcactggatataaccactttagcagttatatagacatgattgcaaagtttgatgtaattatttttcatttcaaataatatatatttcattgattagcaacatggaaaatgaattattgttacgaacagatcttccaagagctagacgaatattcccatatccacaaatataagagagacttaaggtttcattccgactatatttaggaggaaaaaaatataccccttaataagtaaggggaagttagagagtgtgagagttggtgagagcaacgttacgaaaaaaaattgagaaataggtgattggattggtgagacaaatagtactcttaaaatactttttatttttggacagaggaataaaggaaaaaaaaccctttgtatgtagacaggggagtggtaactattttggccactatgacgggaatcttgaaacagctataccatgttggtacagtgcccactgccaagaggactttttgtctcaaacttgactcgatccgaccgtccgattggataataatagagaaaagcgtgcctgaaagctggctgccacagactgtaatcaatctctgctcctcaaagatgaacattgcccggtgtgtttttcacgccaaaattgaaagtttggttgaaattgaaacgatgtgacggaaaagttgaaagtttatgtgtgtagaaaagttttaatgtgatggaaaagttgaaagtttgaagaaaaagtttggaactaaacaaacgcccaattgaaggagcagaacatgcatgtcaggctgtcagcacaatattgcatatatacaccttaattatagtgcagtatttagcacagtgtacatttgcatttgtttcattaattttggccttttcttgtttatctctgcttctcctgaagagaagcactttgtaaatatattgtttttttttgtcttgatgttcaatggaatactagaagctctcttgctatcagtttcgataaaagaaatattttcgttttatggaacaactagtatttttccaaaaaaaacatgtatatcggtttctttctcaattttatttcaaaagatatatgaggcatgcaatcaaattcataagtttcctcttattattcatccactattgcattatggtgccaagcttatactatctattctcacatattttactttttactgagaggactttcaagttacttaagtattcctatgcaattacaggggctgacctggactaagtaatctaagccaaaaaggcacgtggtacattttggtgttgtttggataatgagaaatggattaatttcccacctatctgtaactttttaatcctaatcattcattctttccacctcatttcatccaaacctttattcatttcctaagcccattccacatctcatatcctgttattcgaacgggcccttctgagttttcaccatactagtggcccaagctataataaacatggcccaccatggcccacggactagtttttgatcttcattggatgaacagtgatgtcatttcgaaaagttcacttcagatccctctcttgattggatctcatccctcaaccgtaaaatcgggtacatcgcatctctcattttttttttcaaaatcattgcaaatatagtctcaaggaggttttggatggtggtttgccggtttcaagtgacgtggtacctacgtggcgtgttggcttggtatttatctaacatgacacctaaaaataaataaaacataatgccacccatgtgtcaatcacaagaaaaccatctatattcaatgaaatcggcagctcgccgattcgttcaaaaaaaatcataagaaaaaaagagaaaccacaagctcacatatcagttggcattttctagccatacttcagctagtttcgcagcctcggcttctcttcctcctcctccgacatggctagctagctccaacctcgtcctcccagatggcatgcaagagtggcatttggggttgttcattttcgaaggatggcatatagtaaattctcctcgaaaccccttctcttcttaatttctcgtttcattgacatataatccccactcaaccatgtagtacaaaacaaccgtcgaacccacttgagaaaacaaaatggaccagtattgataattgaggaacattgtatacccggtttcacggttaagagacaccgattgaaactgatcctcaaatcgagggatgcaatatagaattttttccatatcatttttgcatttccttggatcctgggttctacttctacgggtcaaaaacaattgtcctgaaaacgcagcaagtttcttgtactccgtgcaacaaaaaaccacacgcatatgtctcacgttgctgatccacctaaagtctcttgccacttttaaacatcacacacttggagttgagcagttgactctctgacaggtgcgccccccgacgcaatccaagtccaaaaataatactacctccgttttttaatagatgacgccattgactttttctcacatatttgtccattcgtcttattaaaaaaattacgtaattataatttattttgttatgagttgttttatcacttatagtactttaagtgtgatttatatcttatatatttacataaaatttttgaataaggcgaatagtcaaatatgtgagaaaaagtcaacggcgttatctattaaaaaacggagggagtactaacaataacccaatggtggaatattgaatacgtactttccttttccacccacggaaatattctacgcacgaaagccgcacacgtgtttcccgcgaccgcgccacgtcaccgcaaaaacaaaaccggggggagccacgtgtgcccacttccggatagattcacgccgacccccctacgtcacccccgcgggccccaccacagccactgacacgtgggccccacgagtaaccacctgttccgctactagaagtatagtaggcttcgcggcggtggtgggtaaaagcatagtgagctctcccgtgccaccgacaggtgggccccacccgcgcggcggaaggttctaggctctccggcgaaggttctggaaggttcgggaggaggggggagatgattctgtcggcgctcgcgacttcggtggggatcaacctggggctgacggtgctcctcgcggcggcgtacacgctgctccggcggcgcccgccgtacgtcgccgtgtactcgccgcggcggccgtacgcgccgccggagccgtggctgcccgcggcgtggcgccgcaccgaggccgacgtccacgccgccgccgggctcgacggcgtcgtcttcctccgcatcttcgtcttcaggtcccgcttccccgctctcctctcctccaatctcggcatacacgctgctcgctttactatgggggatggagattgacgaggtgatgggggattttggtgttgtgcagcattagggtgttcgcggcggcggcggtggtgggggtgggagtgctgatgccggtgaacttcatgggggaccagctgcggcagattgacttctccgatctgcccaacaagtccgtcgatctcttcagcgtctccaacgtgcaggatggctccaacaagtgagctatttcgagcttcctgatgcctaatttttgttcgcggatttagggggttttagtgggttttgtgtgattgttagtgcttcaaggtggatacaattgtttaataataataaattacgtgccagttatagattaaattctcgttttcgtattaggaggatgaatctcttggattgttttaatgaggttgagtattttgtttatgctagtggctattgagatgttcagagtatgcttcactgcacagttttagcttaggattgctcagtttggtgagcactttgatggttttcttttcctggccactagtctatttataaagcatgatttgtttttctcattggttccttatttttctgaaattctaatttgtattttctttgttttgaaggggcaaagtgctaactgcatgaaaaaaaacacagagattcactaattcacctatttgatgctgtctcgagaaaatgcgttgaatctctctcataaaagaaaaatatttcttttagtagtatttagaatttgatgtcggtcatttaaaatccaacggtttcaaacatgggcctgcatgcttaggccttctccatggctccaggctgatgcgaccattttgctagagtgttaagttgatttctgtctggaatttatcttcattattgggctagcaatgcatagcatactcattaccggtggtaatgtggtgaacagattgtggctccacttttcggctgtgtacatcataactggaattacatgctacctcctttattatgtaagtaattgagtattttgcttctttttggctacctactcactgttttcaaactaattcaacattttacttccctctcttatatttgtgctagacctaataatttgatctattttcttgattggatacttcttcagtcaaactcatttgatatttcagttaccataccatgcatgcttgtcagatctggcattcatttatcaaattcttctcgttgaagttctgctttgctgctttcctgttttcacatctttatgtacacaatggtttatgttagctctttgcaggaatacaaatatatttctggcaagaggctcgaatattttatgacatcaaaaccactacctcagcatttcacagttctagttcgagctatacctgtaaccaatggtgtgtctgtgagtgatgctgttgataagttcttcaaagagtaccattcatctacctacttgtcacacactgttgttcatcaaactggcaaactccgccgccttcttgtaagattcgattgttttgctactttctattgcttcagtatggttaacatcctatattttatccatggttccaacaacacttactatatggggtgtctatagattgacttattgcattgggtacatgttgttgtattgaaagtagatagtgataggtttgcaaggcttgcattttgtttcagttataatcaatatgttttgacaacttattagtcctttacttaatttcttgtgactaaaacaactcaccatactggaagttgctattttactttcaacatgtcacttctaactctatgttattagtctgatatatacatctagtgattatgtcgaaaagtagattttagattaaacgtggagtcacagaattgctcctttccattgtttcataaataaaatacagaaagtatctaatatgtttctgcctagacatgtcaaaaaattcaaggggagaatatatacatcagttgtgatcctcatttgaaagttgtccgtatcttatttcacctttcaacacgcagatttattccctttttttttgtcatgcgaacaattttgtttatcctaaatgtatcttaagaaatggtacaccagtagattttcttcatcagctggaaaactaaacagttccatctctacatttagatcaactttataatgtctttgttctatattgcttaatgtaatctccagttccattttgatagttaactccatctctgtccagaatgacgctgagaatatttgcacaaagcttgccaacttgaagtctgtacggcgtacttctggagatcctccaggaaaatttcttggaatatttggcagaaatgatcttgttgggaaatatcagaaaaggctggaggacctagaagaaaatgttagaatggaacaatcagacactactaggagcagacaggtgcatatttctaccaattttggtcttgctcaaaccatgatgtttcaatatctccctatctgtttgttatactgcattggaattagtatttggctctggtgctcatctttcagaaaatttatttataaacatttcaatattttgtcatctgttctgattttctttacatctctttaggaagttcccgctgcttttgtgtcattcagatctcgatatggtgctgcaaatgctatttacataagacatcagacaagcctactgagtggcagactgagcatgctcctgatccccatgacgtttattggcctttcttttcaacatcattcatg

SEQ ID NO: 39670 - DNA, 7122 bp, Oryza sativa
ctcagtgagatataagagaacaaagaacgccctttatatgttcttaagaatttcgagaacttccacagttgatttcatgcgtttgcaacggtcacatcatctataataggtgttgtaaatacttcaggcgtcctatttatccatgcatttggaagctggtatcagtataccatgtattctggttacactggtcctgcaaagattaaacgatgtattatttgttatatgaaaaattgccaaatcaacaccatgcattctaaaagtggattgtttagctggataaatgtgccataccagagaaccatgacacagttaaagtgatatttttccatccatatagtagttaataaggcaccaataattctacattgcatcatagtaatactttaggcccctttagtccgaccaatctggaatttgcacgtgtttaactctgtaaagcattagtttatccgtgtacacttcttaactttgcatagtacaaatgcagctttttaatgtatattcacccaagtatgacactggtggaagattctggcccattgtgcacgggggaacaatattttctctggtgctgatgcatgttattgcaattggagtatttggattgaagaaacttccccttgcatcaagtttgctggtacctcttccagtgctgacccttctgttcaatgaatactgccggaacagatttttaccgatcttcgaagcatattctactgaggtaatgtgtttttcattttgtccaagggtgcaatgtaattctctttgtgcaactatgtatcaaaacgaacaacgcatcattctggtccttttagcttatcacttcgatagttcgattagatataatgtgtattcacgttctacctttcgtgctgcagtcattgataaagaaagacagagaagaagagagcaaaccagaaatggcagaattcttcagcaatcttgtaaatgcgtactgtgacccggcgatgaaacctatccaacactcctcgaattcagatgaacgcactacacctctattgtcttagatccagataagtaatagcttgcagccttactgtcatggcgtgaattttggtttgacaccgataatcaggcatacaacaatacacctgtgcttcttcttgtgatgttactgttgtaaagcattactacatacttgactgtggagttgttgtgcatatttgatttgtacatcttaatttgtgcttactgcgtagagatgaataatgcattgctccttaatgaagtgctgtcaatgcaaacctgtgtgggttgtacttctagatatgtcaaatcacctttatttgttcccttcaaattttgtgtatatggatgttcttttgcttcaacctattcagtaatgagattatttggcagttggaatgatgtgatattagtactgatacattattatcagtttatttgagttatacttgtcctttttttgtgcccctctgagactattatcatatacaatttgatgccaaaattcagttttctaaatacaaaaggtttcaaaccgtgttgaacagaacataatttgttagcctgtttcctatagtttgctatcacccaattaattatatgctgagattatttgacaagttcatactctacagtcactgtggttttgaaaatgtcatgctatccttggatttggagcatactgttctaatatataaatagacatccattttcttttgtccctttttgtgtatgattctcaacatgctactccaacaaagatttgcttgcatcagattgagcatatatatacatgatcacaaacaatgtgaatatgggccccaaaaaaaatcagtcaattaaagatcagcaatattgacgtattcctaatcgattgttctattatttggcttccatggaaaggaaatgttcatgtgattgcctgccacttggagagagaacagaggtgtagtgttgtggtaatctatcttaagcaagcctgtaattagactcgtactgaggcttaagtcaccattaacaaagattatgtgattaatgttccatttggctcccatgttgtctgttgtagtagattgttgaatgctgatgaatcctaatgtggcaagtagaaggccatgtcaatgtaagccataggccttaaaaaaaagggtaggagtaaaagccatagcatattgtgccatttgtcttgattgttcaaaggaaatcttatgtagaaacatgctatgatgctgataatattttcctattggcaagttgcatggacaaaatgatatcacattcataccaagttggtatccctgttagtagtttaatccttttactttgtcctaaagtctctgtcatttgtgcctcacaacttgtagacatctgctggattcttggtcacaaagcatgaaaaggcattgtgatgtgaacatgatgacatatctaattggaatgtagggtatattgttagaggtccttttctaatttgtatgtcctcagccaagacccatggaactctaatttgcaactgattgcagccttgaccttttcatataccctatgtaagaccattagctagacttgaccaagagactgtgaaggagatgatgatgagaggctaggtcaagcagtcaataacagcaatataagcacgtcatgtttgatctcacaaccattaaaaggaagagttagtgactaaatcatgtacatatacaaaaccgattacatgtttgataaaaaaaaatcatgccaaaataaaaaataaaaatatgttgttatagtagaactcgaaccatgcatgctactcaactctcatcgaggttttaccaaaatgaaaattacaagctaaaatttaccaaataaccactactatgaaacacgttttgcagatggccaaaacacgtttttacatgtggccgggcctacgaccaaaggcaagtgaaatatcgcgtaggattttgtgggggaaatagttgttttgtgagcaatattgtttcatgataagaacatatgtgttccatacttgtagcatttctgatcatttttatatgccgataatttttgttttgaattcaccaatgggaatgaactatcctttaaaagctggcagcagatggatacatgacatatatgaaaagaatatgaatggtatattctataccacgaactactttagtttgtaagatttttttacccattagaaaccagtgatagagttacaatcattggttgaagaaagggcgtgtaaagggacattggatagaccgtcatcgtcatccatgacaaacacaaaaggataacaagaaaaaaattatatcgaagctgtttagattactcagttcaactggggatgaagtaagaaagcatagaattaaccacactcgttgcagttacttccaacaagcaaatatcatacacaatttacagtacacctttgccttgagaatcgtgatatataatttggcaatatgtgcgtattttttatactccctctatcccataatataaggcgtggttaaagttggcaaggtctccaaaactaatcttttacttataatttctcatatagtataagatttgtagcaacaaaattataaccatatgaaagtaaatttaaatgtcaatctaatgatataatttttaataaataaaattcatttcatattatattaagtattggacaaatgttttaaatcttgaaatgtgtgcacgccttatattatgggatggagggagtatatgagtatttcatgtatgactttgtcttgtatgccgtacagcttagaggacaaaactaacatttacaaagtataaagtatgaatctgatgaattgttccatgatttttaatgagtgaaggggacatagttattgtggtgtatttggtgaaactctgaacccttagcttggcaaaaaaatggactaattaaccacagttaatctcgatttactatgttgatcaaatgcttcatgctaattaaattttattcacaattataatctcacctgctagctaagtagatctttgatacttgctctcatgctatgctttgtttgagaccttaatttcaatgaactttgcattaacaaaactaagctggatcactaattaacttccctagctttttggttgtccttggacgacgttataatccaagttatgtgcattgccagtaataaaattaatggtgcaagttgcatagaatgtacaatgaaaacatactactagctatgtagctatagttgatcaattcaatcccataattcaccaaatataatataagccaagcttgcatcactctaaaaaggttcttgatttagcacgcaagacatgggctaatcgccaaaaggtgatatctggatgtcccggacctagtcaacaaggcaatgcaagtatgaactgggcaaggtccttttcatggttttttttaccctttgttcattgtcttacttctatgagaatgacgactacaaaattaatgtgagaaaatgatttacatcatagacagtacataatttgtttgatgtgtgacttggactatatatttataattcattgtagtttatgtgggtccatgtgtcgagtatgtgcgtacttatgtgagaaaccaatagcttaaatgtacacgcgattgtaaaaatcgcttaccatgttgcatatattaatttcttggcctttaggatcacatataatttggtgtggtggttccaatttgcatgttataaatttgatatgcggatgatcaaaagcccttgcaagaaaaaaccgcaaacattaaccaatcgcggagtgtctgtaaatgcatgggaactatattataataaggcaacaactcttctggtgcggtttacgaaataacaaagaggtagaatgacttagagttgtaatagaaaagtattcaacaatatggcacagtccatctctatgggcactccactccactcctactgttataatccaacatatattaattgttatagattgaaaatcatgtttctctagtatgatatgtgtcttcccaacaattttcttgagaaaaaaaaacataactttgaatgctgattacagatggggagtatagagcgtgagctgcaaattgatcgttctcttttgcctaactatatatacaatgtatggaaaccacaaaagtcttagcatataaaaagtgaggtaacaatgtctgcactactgcaatctcaatgtcatgtccacctgtcaatgactaggcctacacaaccttacactcatatcattagctaagcaataacatcaactgaattaactaagtatccaatctctctcactagattaccttgtccccctccacaatctatatgttcatcacaaacttaaaccacatctcaatccatcatcatcaacaacaacataagcacaatagattatatatacatgcatgcaatgattttccaaaacaatactaataatttggtctaataataatgatactacccatattctttacttgacatcctaaaatctccgccgtcaaactttctagagtttaactacaactataatacattactagttagcaaattaagggtctgttcagattgtagccaaaataaaccttaccaaattttggcaagatagcaatattgtcaaaattttagcaggatttcttatgtatttaccaaatttggcaacaaactaaacgtagacatttttttggcaactttaccaaaaaaatggtatggttgaaaatggcatcaaagtgaacatgccctaaatacttccgcttggccgttacacaactcttgacgttttggacaatgttaagatcaaacttttatatctttgcctctaaacaattctaaaactgtttaaaggtactggaacaaaatatatgtaaatttttcttacaaaatattataataaaagtaaaagtttgtttttatttatttattgtatataatatagtgaaaaaacatagtcacagatataatcatttcatttttaatataaaattacaaaatgtaagtctaattgtcatctcaatgactgcaaaatactaaagaaaaaataattaatcaaaacttatgcacaagcggttgcactttcaataggtttttattactaaagctagggatttatcactggactccatctcttcgagcatgtgtcatgaacgtatttgcaggtgtgagtgtaatgtgcatacatgatggtgtagacgtatgcgtattctgacagggaaaaaaactacaaaggtagtatacacaacctctctcctaaaatgtacgatgtcgttaacttttcgcatactatttaaccattcgtcttattaaaaaaactacatcaatattatttatttatttgttgtgaccatcaaataaattataatcttaacctatatttttatatatctatactaatttttttaataacacgaatggtcgaacgttatgtgaaaagtcaacgtcgtcgtacattctgaaatggagatagtactcgttagctaacttagcagttagcacaacataattatcagcttgtgaaagcttctccaccatctccatgtccccccttatatatactcctcgatgatcgccatggccttccacctccaacctcactcactcactcaagccaagctagcaatcgatcgatcgagctcaatgcctccatccatggcgacggcgagggtggcgtcaccgtccacggacaggaagcgcaaggccagcagcgaggacgacatagacgccgccgccgccgccgccgctctcacctcgccgctggcgccggcgagggggaggaagcggttcgtcggcgtgcggcagcggccgtcggggaggtgggtggcggagatcaaggacaccatccagaagatccgcgtgtggctcggcaccttcgacaccgccgaggaggccgcccgcgcctacgacgaggccgcctgcctcctccgcggcgccaacacccgcaccaacttttggccccgcccctcgccgccgcccgccgccgtcgcgccaccggagacgacgacgacgccggcgctgccgtccaaggtcaccaacttgctactgctccgcctcaaggctcgcaaccagcaggtcgtcgacgccggcgccgcggcgccgcaagaagccgctctgttgcagctgcagcagcagacgccggcgtcgtgcc

SEQ ID NO: 39671 - DNA, 5737 bp, Oryza sativa
aggtgttcgtccgtagccacggcgaggagtacggcttccacgtcgacgacttcctcagcgacgcgtgcagcaacgagcagtactccggcgacagctcgctgggattggacgacgacgacggcgaggtggaagacgaggaggaggaggagctcgacttccagttcatggacgtcgcgcccggggcgtcgtcggcggcggcggaggcggggctaggcggcgagggcgcgctgtgctcgccgttcgagatggtcgccgcggagctcggcggcgcggtggacgtggccgcgcacgacgcgatgaggcagatggactacgagaggaagatctccgcgtcgctctacgcgctcaccggcgtctccgagtgcctccggatccgcgccgccgccggcgccaccgccgctgcgcgggaccacctcaccggcctgagagaggcttgccggaagaagcagaaattcgccgccgccgcggcggcgccgccacagcagcaagaaccatctcctcctccacagcagcctgagacgccggcgagctcaggcggcggcatgtcggagacggcgagcggcggcggcggcgacggcgacgtgctgatgtggagctcactggacttggctccgatttgccacatggcatagttattattagtagtaaacaccatacttaattagggctgtggaatttcttggtgatgacatgcatgcatggctgatggctcagacgagagctctggaaattattagctttgcttagctttgccccaattgttttgttcaacagcaaaaaataaagtttagttatcctctctgatcatctcatataaaccacaaattatagataatgaagtgtttgatgtgtttgttcatgattttcagatgagcactgtccctgtatacattgcagtttctcctctttcccttgatgttattttttttttcttttgtgatttgtattcagttgaattggtcatcaggtgtcaaatataatactactcccttcgtttttttaatatacgacgctattgacatttggcacgacgtttgactatttatcttattattttataaaaaaatataaatatcatttgttttgttgtgacttattttattatcaaagaaactagccttagcttatattttatatatttacactaaatttttaaataagacatacataaacgttatgcgaaaaatcaacggcgtcatataaaaaacgaggtagtactagacatgaactgtgatattctttgtattcatgacagtggatgatccactgataaaatggagccaaggaactccttaattagtccacttgactacatgagaagagctgaccaatatctgctgatattttttatcagtttaaattccaagtatagcacaggccttcatttgaaaagaaaaaaaagaaggcatataaaaaacatgaggcataacaaactgaaacattgacaggacaactaagcaaatccaaacggtagataaagccaaacaaagtcatcaatctatcatttttgtggtttgtagtctgtactgtacatgatgcacctctatgtaagtaatacagagaaaaggaaactcaagcaaaactcgcactttaaacggatgccgcatgcaagacccagtaattggccagttagcttcatagtcaccatatcatgtgaaacttgttagtgtttcagacagttaagaggagactccttagcttgtcaagctcatgttgctgacaaaattgggcgaactgcatcggtgaaatcttcatggaacctatgctcagaaaatctttgagcgcgttttcgtgctgctgttgccatctcatgcctctctgcctccggcatccgcaagaccttgacaattgcctcggcatattcttccttctcggaggctagaaatcctgtctgttggccatcctcatctagcacaatgtccatcattggtcctgccgatttatgggctgcagaaagcatggaacattatggctttgtttacaaatcaatggaatgacttatgacccaggcattttggttggtggcatcagaaaattcaacttctacttatgtatttcagtggcgtttgcttcatgccttaagaaattcatcctgcccttggtattgaacccctctgaccccccccccccccaacgcgcgcacacacacccaaagcacaaaaaagctaataataacaacaataatatgaaatacggaatgcagtcatatttggacttattcaaaccattgttatgtgcgtaccagacgaactagaggcacttatcctgtataccattagcagtcttggaaaatggtattaatccaaattttaccaagtcaataggcccagataggccattcttgacgaaaataaagtgctatgaactgaaaagatggatagggcaatctggaagttacttaccaattggaatagcaccagcagccatgtattcaacaacacttatcccaaaatgctcatctgtcattgaatggagcccagcaacagcaccacctagaagctgtaccaagtccctgatatatccatatgaatatcctgtaagtttactgaaagaacctgcatggtgagaatttcttagtgctaggttgaccacactacctgtaagagatatccttgtggaactccacaagctcatctatgtgtagttcagtggatctgtctttaagcttttgcaatctttccagatcctctttattccgacagcttccaacaaattgaagctttggcttaggaaattctggacttagctttttaagagcaattgcaaatgcctcaagctgaagtccatgggcctgggagaaataaatgggtacacataatttttctggaatgagtgaacagtaagctcttgcgctaagaatttgatccagttatagtaagttggcataccttttctggccgaaactgtgcaactgatataagaataggaggtgtagttgatctttccagtggaagcatctgttttatgcaacaagtgtttctgatgagtaccaatttaatcatcttcatttgattaaaaaaataatgcagtagtaatttatatcaatgccttgcttggttagtgtgtccacatggctatgagatagagctaattaggattgacaaccaacagtttagaaatatagatgtctagaatttggatatacctgcagggcagaagtatcacatggagggtataccctcctagtacgctctggtatcctccaaatattttcaatatgggatcttgtccacgatgaatttaccatcacaagatgtgcgcatgaaccgaccagaccatataaccaactgaatatgctatagtagaggattttgcatcgggacaaccatatgctgcatccaaaagaatactctgttattctttgcagctgagaccattgtatacaatattaatagatcatatgtaaggcacagagaaaagagaacatatggcatatgaaaagcacttttaggttgccatgatcaagttgggttgaccaatgattaggtacaaagaaagaagtttacataaatatataatctgttaatgcatgatcatgttcatcttgatatatctaataagagaggactgaacaagtcatatgttaaaaacataaatgatagatgaagaatgagaaaaagggatgactatgacctatatgattctgatccctaagaaacaagaatgcacccatgaattaaacatatcgattctccaataagaagaattagagttactctgtgaagtgcccaccttccagcaatacgagagtcgttattgtacatagaactgcgttgcttaacacgttcaaccatgtcagaactgattgtcggataatgagtgtagcagatgaccttacagccaaatagccgagccagtggatatgtaaaagcatagccgctcgtatcaaaatagaactgcggggtgaatttgttaagagcttcccatgcaagataaactgagccaagactttgcccaatcatcgtgaagtggggatacgtgcttgcttcaatccactttctcctattcaagtgaacaacctgaaaatgaagcccagacattttttatgctagtgcgccataatgtatctgattatgctaagagaaaacaccagataatgctttattttatctataaaagatagtactcaactttgatctccaaatatagatcagacaactcctttaaaattaaaattcgtcatcatttttgctcccttttactgtgtttttagcctataaaccaccaaggattctgactaggaagacaatcgtattctcctattaccagtgttagccttcagctacccgtccgaattgtataaaatcaacgaaatcttgtaataatggcattatttctttcatatatgggaacagagcatctctgagactacgtttctgagatcatcaagcaattccaccaaccagtgactagtgagatcccaccgaatttcaccctaacttaaatgaactatatcagaccaaatatttacaagaacaacttaataaacttctcagaatatccatcatttgagttaaaaaaaactaatttgcagaaagacgagcagctaggactgagatccagttttcaggaaggaaggggcacatctttctgaaggcccgatcgatcgggggacacaggaaggaaggaattgaaaccgaacctgcggcgggcggaggaggcggaccccgaagcggtcgagcgcgcgggcggcgaggccgtcgggggaggcgtcggcgtcgccggtgaagacggcgcaggggaggcccgggcggagctcctgcgcggcgcgcaccgcgcaccagagcacccgctccccgccgccgccgtcgttggtgtacgggtggaagaaccccgcggcgggcgcggggtgggggtggcggcggatgcggcggaaggcggcggcgaggagcgcggcgaggagggcggcgaggccggcgaggaaagccatggatggattttgcgacgcagatggtggggtttgggttttttgggtttttgggtaagtgggttgatgggttcggcccattgggccgagttatgggcctaggcgactgtagcatggggtgccttctgttgggaaaaagtacaccaaatgtccctcaacttgttatcgggatacgaaaacgtcctcgaaccgcaaaccacgggtcccttaactatacaaaaccggtcacaataggtccctcggcggttttgatcccggttttgtcctacatggctgctgagtcagcgtgggatccacgtgtgccctacatgtcatcgtgccatgtcagcctaccctctctttccccctcttctcatctctctcatctctctcttctctcagggcagcgaggaaaggagcggaggccatgccggtgtcgcacggcctctcgcggccatcctctcacaccgccagcgccgccggggaaggagctgagcgcggccgtcggggacggagcagggcgcggctgacgggagtggagcagtgcacggccggcggggtggagcttggcgcgtgcggcagccgccggggaaggaggtgggcggcggcagcggcggcggggaagggtaggcgcgggaggccgtcgccgcggttctcgccctctcccctcccccacgtctcggggtcgaagaggcccgagaggtgggagaaagaggaggacgtcggcatcggcgggggcaacgtcgttggagaaggggagggcgtcgccgcgcgggcgagctcgagggcgtcgatggcgatgtcgtggccgtggttgagcttgacggcgtg

SEQ ID NO: 39672 - DNA, 5441 bp, Oryza sativa
  unsure (1)..(5441): unsure at all n locations
ccgtcctgctggtcctactaggtctccggcacaccagccgcttcgcatcgttggcgctggtcctgcctctccccaccggcctcctcacatacacccacctccccgctactgtcgcggcgccagaggacgggtccgcgccagccgtggtgaactgggcagagacggcgaggccggcgacgacaacgatgccgtcgcggcccgcctcgcggagcacgaggcgggcggcggcgcaggaccgcgcgcccaccggccttgcccaacggcctcctcccctcctgtcggctagcctacgccgccctcgccggtggcctccgctccttcccccgctgccctgagattagagagagtgagagaaatgagaagaggggaaaagagagggtaggctgacatggcacgatgacatgtggagcccaggtgggtcccacgctgacttagcggccacgtaggacaaaactgggatcaaaatcgtcgagggacctatcgtgaccggtttttgtatagttaagggacccgcggtatctggttttacggttcgaggacgtttttgtatctcgatgataagttgagggaccttcggtgtactttttcccttctgttggaatgagttcgctttaagttcctcgtcttgaactccgggtttgaatcgtgtccttgaaccgtagcaccatatataatgcgttcttgaacttgccataccgaggtatccaaggtcctagaacagtattgtcgcgatttcgactaacgtagtagtgagtggccctatgtggtgtcccaggacagtattgtcgtgatttcgactaacgtggcactgagtcaacatggaccctatgtggtccccgcaggttagtggtcagtcttcctcctctagatctcctcttgtttctcttcctcctaggccccaagtggtcatcgacagggcagaagtgcaatgtctgataggatagcagctggacggtggcaccacgctaccgagctggactagtcgtcagactgcagtttttcaatatttgttggttttcctcgcttttttttagcgatttttttatgggggaggaggcaagaggaggaaaaaggacgaccatgctttttaagtaattaatatatgaaaaatcgctatgccgcttactcattgcgcagaggaagatcacggatgttgcataattacttccatagcaaccaaatggcaagaactttgtagctactggatactgtgtgtgagctactggattaagaaaaaaacggatggatccagtacttgcttgatccacttcgtcgacccattctcggtcatatggtccacgaaaatttttaatctccattgaaatgcacaggcaatctaaagtttgcaacgggacaaacaattgactaaggatagactttcaaatttgccaccaagctaactttcaaaaaaaaaatgttaccatcaagatatatgttgccggcttcgacacatatatagacataacattatgttttcaaaaaataagaaaaaaaaacataacattatcacaaatcaatgaatatggacgtcaaaattcaccatatataagcatcgatcctggctttttttttatggtggaaatctagctacttggcaagtcaatattctggctcgatcgtcctcgatcttactggctacgtacggtaatttccactggtcacaaaaatatgttatactattctggatatgattcaaatcaaacttgttgttttttacgtggtttatatgccgcagcttgagtatatctcacccaatgacccaaacacttgataatgttacgaatttattgtctacttttacaaaagaaaaggaaagaaatttagtgctgaaagttacaattttggcactaaaatatccaaaaatggtatgtttttctgtggtaagagaaaatgacccccttttttttaagaacggtataagggcatgtacaaaggtagagtcggatatgagctctacgttatctagagactagcatcctacaacagttagagacaatatggtctctaatcattaatgtatcaaaatattttttcttacttttctttcctttgtttcaccatcatgcaaaaaaatttgctctaataaatgctaagagtcgactctgagccgttgtcatgtataacaaccatactcctttctctttcttctatgtcaccaaatttacttgcatggcaatagagagagaccactaataaacaccgttgtatatgccctaacacatgaagatgcttctatatatgcatgttttcgttgatgccggtgcgaatctagctgagaatatcatctggatcagcaccattacatacacgatgaaccttgaactgaaaaaaataatgttttaccacaaaacatttggaaatttcaattcatgcggtaggctgaccccagaatctagttagtttcatcctgagcagagctagcattcactagcggatctagaaacattttaagtcccatgcaaaacccactagcatagataatctgcattgtacaatactctactaaacaaaagatttttctggacaagcatcttaataggttgcagtcgagcgataagtgtctgaatctgaccagttgactggccgcaagcgatatacattatcgtgtgtggtcgcttaagagatccgcacataataatgcagccgcatcacatgtggtcctcttaaacgatcgcttaaaagacctgcatgcgatcatggaccatatatccatcccctagaccgagctactaccggttgaacctgacgtttctctctctaaaacgaagcacaaaaagatgatgttttcaactcgaaatctttgcttgcctgcgaagatatatcttcgcgtgagaggttgggccgtccacaagcgaaaaatggtgatcttcacatacacctgggagcagacggaccggccaactgcacatgaaaatgtttttcggccatctagagaaaaccctttctataatagtgataccagcaacatgccattttcatttcttgccttgtgtaagccagttagggccactatctaggatagtcacattggctctatcagggtctagcatggcaagtggcgacatctttgatagtagctcttcgagtcaacttgccgtcaactgttcgtctgttgccacccatttcttacccacatgattttcttggatatgtgagttcatctgaaccgttaaatctcaatcggacggaggaaaaaaaataaaaatcaacagtgaatattttgaagttttctcacataagaagatttatatgctttatatatgggggaagatgaggtatagctttacgtgcataaaacataaacgtttaattattcaagttcgctcaacaaggcgcgaaaaaatggcgcgaaagctgttcgttctcgtgctcatcatgtgttcgaccaccgccctaattacttgcaccaatggcggcgccggcgacggaggcgaagggctccacatgaagctcacccacgtcgacgccaagggtaactacaccgcggaggagctcgtgcggcgcgccgtcgccgccggcaagcagcggctggccttcctggacgccgcgatggccggcggcggcgacggcggcggcgtgggcgcgcccgtccgctgggcgacgctgcagtacgtcgccgagtacctcatcggcgacccgccgcagcgcgcggaggcgctcatcgacaccggcagcgacctcgtctggacgcagtgctccacctgcctccgcaaggtgtgtgccaggcaggcgctgccgtactacaactcgtcggcgtcgagcaccttcgcgccggtgccgtgcgcggcgaggatctgcgccgccaacgacgacatcatccacttctgcgatctcgccgccggctgctcggtcatcgccggctacggcgccggcgtcgtcgccggcacgctcggcaccgaggcgttcgcgttccagtcgggaacggcggagctcgccttcgggtgcgtgaccttcacgcggatcgtccagggcgcgctccatggcgcctccggcctcatcggcctcggccgcggccgcctctcgctggtgtcgcagaccggcgccaccaagttctcctactgcctcaccccttacttccacaacaacggagccaccggccacctgttcgtcggcgcgtcggcgagcttgggcggccatggcgacgtgatgaccacgcagttcgtgaagggccccaagggctccccgttctactacctccccctcatcggcctcaccgtcggggagacgaggctgccgatcccggccacggtgttcgacctccgggaggtcgccccggggctcttctccggcggcgtcatcatcgactccggctcgccgttcacgtcgctcgtccacgacgcgtacgacgcgctggcgtccgagctggcggcgcggctgaacggcagcctcgtggcgccgccgccggacgccgacgatggcgcgctgtgcgtggcgcggcgcgacgtgggcagggtggtgccggcggtggtgttccacttccgcggcggcgcggacatggcggtgccggcggagagctactgggcgccggtggacaaggcggcggcgtgcatggcgatcgccagcgcggggccgtaccggaggcagagcgtgatcggcaactaccagcagcagaacatgcgcgtgctctacgacctcgccaatggcgacttctccttccagcctgccgactgcagcgcgctctgatcatccaagccgccccgtgtcataatttcgtaaataaaaccatacaaactttttattaatcaatcatgatataatcattcacaagtaattaatttgtggttaaaaataaggcagttaatactgtccgttattcgagaatggaggtggtaatttgcctagatgtttcttcagttacgtaccctaagacaaatcttgatcgatcgagatgtaatacataattgaagaaacatccactgtctcgatggtgatctagcggggtagggggaactcaagtcctcccaacaccccacgctggatccgtccctgagtagggcagagagggagcgacagtagtccaagctaccgtggcaatggcggaggggtgtgatgtcgccagatctgcctctccccaaccctatcgcatgcagatatatcctttgtcacaatcctccatgattgcatcctcattgagctctatcggttgccaccgctgcctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39673 - DNA, 1321 bp, Oryza sativa
  unsure (1)..(1321): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccacaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaa

SEQ ID NO: 39674 - DNA, 817 bp, Oryza sativa
tttctgctttctgacagatttcagtcttctctttacatgcctagatgacttcatgttgtctttcgaactgttcaccttaataatcactatttgattatcacagttcattaggatagctggcactggtttttcaaccaccggcaaatccatcaggagttcacgaagccactcggcctcaactgtggcagtatctagtgctgtgagttctgcttccattgttgacctcgttaagatggtctgcttgcaagacttccaggaaacagcgccacctccaagtgtgaacacatatctacttgtggcctttatctcatcagcatcagatatccagtttgagtcactatacccttccagtacttttgggtaaccagtatagtgaatttcatagctcattgtaccctttagatagcgcatgaccctttccagagcttgccaatgatcatctcccggatttgaaacaaaccggctcagcttgctcacagcaaatgagatgtcaggcctcgttgcactagccaagtacatcaatgaaccaatgatttgggagtatctcaattgatcccttgctattcttcggtttttccttaatagcacactggagtcataaggagttggagctggcttgcagtcactataaccaaagcgactcaaaaccttgtccacatagtgagattgcacaagtgtaatcccaccctcatctcctctcagtagcttaatgttaagaacaacatcagccactcccaaatccttcatttcaaagcttttggacaaaaagtcttaacctcctcaatcacattgaggctggttccaaaaatcaatatgt

SEQ ID NO: 39675 - DNA, 14255 bp, Oryza sativa
  unsure (1)..(14255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaattctagacatatatccttctgatacctgcatatcatcctctagtgttttgaacggttttttatgtatgattttttttgtaaattaccaggcagtggctcttttcaagtcatactttggtggtgcttttgatgaagatgctatcagaaataactttgttttaatctatgagcttcttgatggtaagggacatcttatttttggactttgtttcatcaatttgcactgtggatgcttctatttacctgtagaactgtctctctcatctaactgtgcagaaattatggacttcggttaccctcaaaacctctcacctgaaatcttaaaattgtatataactcaagaaggagttcggtcgccattttcctccaaggtgagaaaaatgtgacattgaaataagataaccggataaaaagtcacatcaaatagtttgttgctcatttattttgtgtgaaagcatctgaatcattttttttttgttctctgcactgatagccttcagataagcctgttccgaatgccactctacaagttactggtgctgttggttggagaagagagggtcttatgtacaagaagaacgaggtgcctgttccaaatgccacctccaagtttcatctgtatttggacatattatgcattgctagctagctagcatttctaataatcccagctcagcatagatgctagtaatgtcagaacgctgcatgtatttcgacatgcagaatagttttcatacatattgtcaatgtgcactagattgcctgttacagaagtagtccatactttatttgttgatttctttgttgccattttggttctgcatactttatttctttttagcactttgcatgactctttttagcattgagatacactaatatagtattcttttctcttgaaaggttttcttggacattgttgaaagtgtaaatcttcttatgtcttctaaaggtatttcatggattactatgattttattgtactgctctgatgtttttgttgtccttaatgttgctttgactgatgtttaatgtggaaattgccttctctgcagggagtgttctacgatgtgatgtgactgggaagattcttatgaagtgcttcctttctggaatgcctgatctgaaattgggattaaatgacaagatcgggcttgaaaaagaagctcaactcaagtccaggcctgcaaagaggtatcactttatcaataattagtacatgaagaaaaaaaattgagcatctggtttttctgattagtatagtttatatggtatgtacacaatctttactactttaactgaattgtctgctggtcggttctcctttttcctcaacagcggaaagaccattgagcttgatgatgtcacattccaccagtgtgtcaacttgacaagatttaactcagaaaagacagtcagctttgtgccgccagacggtgaatttgaattgatgaagtaatattatgatccctccttatgcttgtattagttttcccctgtagtgacatttttattctttacttggcttttgaccacaaaattctgttgtagatatcgaatcactgagggtgtaaatctcccattccgggttctaccaacgattaaggaattgggccgaacacgcatggagataaatgttaaagtaagtgtgcatatctgaaattgtgaatgcatgaggccattatcacgttttctgacacgatgaaccttttacacaggttaagagtgtttttggtgctaagatgtttgcacttggtgttgtcgtcaaagtccctgttccaaaacaaacagcaaagactagtttccaaaccacatctgggaaagccaaatataatgcttcaattgattccctagtgtggaagtaagtgcaaattatttctatatagcagtttatctatgagaaagatgttctttggcttttctttttatgggttaggtcttgttctggcagagcataaacataaacctaccaatttttgttggttacggtgtacaaagctgtatccgatgctatattggctcaattttcttactcttgaagagctactccttgccaattttgccacaaatttattagcatgccttttgcactcataagtcttgacacacttctgcaattataggatcaggaagtttcctggacaaactgaggcaaccatgagtgccgaagttgagctgatttctacaatgggggaaaagaaatcatggaacaggccgccaattcagatggaattccaggttaattttacctccttttgaacaaccctcttatcattagcaaaatctgtcagccagttcattttatttttgagcttacagaaaatgcaatgttagagatatcataacagttatgaattaaacttgagcatgcacaagaaaaaaaaatggtattccatcattcgttggcctttgagtatgtttattatccgaggtgttatcttgaagtgttcttacaaaaaaaaacatcttctgcttcattgttatgctgataaaatgtgccttcgagtttggttatcttgtttaaccatgctttctgatttgttgtttctgtaggttcctatgtttactgcttctgggttacgagttcggttccttaaggtacgtgcagggaatgctaatatagaacctttttaacacataccagacagttcagaactcatgttgagatgcatattccaggtgtgggagaagagcggttacaacaccgttgagtgggttcgctacatcacaagggctggatcatatgagataaggtgttagcgatgaagaaaaaagtcccaggtatttggcacggttatttcaaggattcgcggagctttctttctagtacggcgtcatgaatgatcataaagcatgtatattacatatgacaccactttttctttaagctattactttggcaaagggtagagcagagcagacaaattttcctgggttcttgtaatcgttttgacacgggatatctagtatcccctgagtcttgtttgtgtggtagggcatattttcatttgtatatgagaagatggcggtagcgtttgttcttgttgatcaatatacatatactcattggcagtttgtattgctttcttattaaattgatgggtgaattcacttgcagaagcaatgtgtataaacatgtgactcgacggtgctcgagacatcgactcctgaagtatacagtgtcttaacattttttgaggttttttttgcccttttgcgaatgactatttgtgattgccaccggagtccatgcgttttatagggcttacattggtatcgaatcaattttcgtaggaatctgaaatatttcctgcgtttcatcatagtagttgatgggttgagatagagatagagaaaaactgaggagtcagctgatttttatgatagctatttattaagatacaaacgaataaattaattcctacagagttgaaatcaaaaggtattctaaaaaaatattactacacctagtacaaaggtgaaaacttattttagaaaaatattttaagaatagggtagtagcgcatgagcatccgattcgatatggcacgcatctccgtggcgtcgttgacactaacaatgtcgcgtgattcgtacgggagtcgggacagcctcctcttgatctcgtaaaaatattagaacttcataaaataacagaaaacctatacaacgatatcccattagattaggatacccttttatgagatagtatctgattcttttgtgatactagctgtatggtacccgatacctgtaataccatgttacatggtacctataataccgaggacatgaaacctgtgatactcgcaagagaatagttaatatgtctatcccgttgtagtgggatcccgttttatagcagccctcgataataaagttagatagattttttgaactttctttttttctctaatttgcaaatctatttttcgatctcgttttcatgtccaactttaattgtccattttatttaattttttttaaaatctaaaaatataagtcatgcataaaatactattaatactttataatatactaatagcaacaaaaatattaatcataaaatttttttaaataagatgaataattaaagtactattcatgttttattctaatatactaatagcaataaaattattaatcataaaagaattttaaataaaacgaacaattaaaattaaacacgaaaacttatagctacgcttattttggatagagggacttgattggctgagtttgagagtaaaggaaataagaagattaagaagagacgcaaaataaggtgagctattagcgcatgatgaatataactattttaaaattttaaaataaattaatatgattttttaaagtaacttttcaatagagttttttttaaagaaaaacacatcggctagtactcctccgtcctataatataaaggattattgtttgaccactcatcttatcttaaaaaaatttgtacaaatataaaaaacaaagttatgtataaagtaatttgaataataaaataagttaaaaaataaataataattttaaattttttttaataagacgagtggttaatctttatattttatattagggtcaattgcatatttgccatcggtttgaaccggtacggtgaatttgccattataaaaaattttattgcatatttgccaccaaacacagatagaacccaacaaccttgccattagactcacagatcagactaacactgttagaaggttggttttgatgaaaattaggacaatgttaccttgccaaggaaattgaagcaacagagtctttcctctcctttttcttctgccgccatggtgctgctacaacatgttgctgttactgcagtccgaagcagcaagccgctgcagctgcccaagatgcagccgtgctcgccgatgttgtttgccgcagcttcacaagcctctgccgtgctcgccgctgctgcttccgtagcgtcacaaactgccgccgcgccgtcacgccgtggccgcccgccttgctgccccgcaaaatccatccccgccttgctgccttaccatatcctactttattgcaaccaatttttgtttgatttgctcttgatttggaagaagagatgagaggatttggggatgtagtagggttcgaggatagggaagggaatcggccaatcgggacctgcctttctgggagatgggggcttctgcgtgcgagaggggtagggaggggggcaaaacggtcttgttgtgcagctttgtttttcacattagttttatgaattatttttgtcttcttatttgcactagctcaaacggtaatggtaaacggaaggtacacatatcagttttaatggcaaatttgcagtttgcgtttttttatggctatttcgaattagagggtaagagtagtggtatatttgcaattctccctttatattatgagatggacggagaagtagtttgggaaggtgttttctctcactcaatctcccagcaacgaatagcaacctaggttcccatcgcaactgaccgatccccagccgccgccgccgccgccgccgccgctcaaggaagcgcatcagatggcatcgccgtcgctcagggacgccgtgggcggcctcgaccgcgaccccttcgtctccctcctcgggaagctcatcggcgagtcccgccgcctgcagaacgacccgccggccctcgtcccgcaggaggacctcgtggcgcagcacgtggtcgacgcgctcctcccggtgtccatggagaccgggggcggcccgctcgtcgtgcggaaggtgagctacgccgagggccggagcaacgtcatcgtcgagtaccccggcaccgtccccggccgcgccatctccttcgtcggcatgcacatggacgtcgtccccgccaaccccgacgaatgggtaggttgctatggagattgttctcctgacgctgtcaaaaattgcttctcaagtttatgcttctttatgaattaatgatttgagtggttgcttgatttggtgtgtttctgccggatattttgattttgtgatcttatctaatttcgttgatggttgcctaaattgcatcattctcatatttacgggtggattatcctggtgagtagtgaccttgtttatgtgagctggtgatttctccatagtaataaccgctttgttgtgtggttgttgtaagaaaataataagttgcatgctagcgttgcataagcatattgatagatatgatgggatatagtaatgtgaaaaatggcatattgtttacttccactgtgttgtatactgcaaaaatctttgctcaatttcatgatgtttatttttgctcgtgctagctttgttgcgtcaaattactaaaaggtttacctcaagtaaatttctccttggttctaattggtggcccaaacgtctctacttgtccaggatttcgatcccttctcactaacgtttgacagtgaagacaaggacaaacttaggggccgtgggacaaccgactgccttggccatgtggcgctggttgctcagctcatgaggagacttggtgaggtcaagccggtgctgaaacattcggtcattgcggtgttcattgccaatgaggaaaactcacttatcactggcattggtgtcgatggccttgtgaaggatgggttgctggataagctcaagaatggacccttgtgagtattgtgctgtttgatgcatggagggaatgtccgactaaactaatgtgttgttcgtgaggaatatgtgctgatttggttgtcattgttgtgtggcattgtgaaggttttggatagatacggccgataagcagccttgcatcggcaccggtggagtgattacatggcatctgaaggcaattgggaagctattccacagtggcctcgcacataaggtacctgatttgaacttgtcagaactcagaatagtgtacttgttgtgttatatagctccagtaggttccagcaatacactgcttcgtggaaagaatgcataaagcatatggttcattttctatgacctgtgttcttttaaattgtatagctgcataaattaagcttgcatccttgtagttagtgcaaaagcaacaatttatattgatcaatgccaaattgaaatgacacaaaaaggataaggaaagtgactgcttaaacatgagttatgttgcaacttacagcgtgatcactctgcttttgaaatgttatctgttgcaacattaccccttggattttttttggggggtaaaaagtgcagaacgtgtcttcatcatgctagggaagattcattcgaatattcaattggcttagagggacaaaacaatttcaaacatacaagttgggagacaacaaatattgtatttgtatatgaattacttttcttttgtgtgtgtcaggccataaatgccatggagttaaatatggaagcactgaaagaaatacagactatgttttacaacgatttccctccacatgagaaagagaagctctataagtttgctaccccatctacgatcaaaccaacaaaatggagctgtatgttcaagttttacttgtgttttctaatgttacaactttttagttgtgtttcctaatgttaaagaaaaccactgtgtacaatccatgcaattaacaaatggtgatttgcagatcctggtgggggtctgaatcaaattcctggagaatgtacaatttcaggggatataaggtccaactattgctatatggttcttgaatgcactttaattgtactcaaaagaaaaatggtccaagcttttgttttattatgttcatacattgttataggcatggggacatgcggttggtgaggctttgttcctcccaggggccctaccataaatttgcttggtcatttaggcggtgttcttttctactaaagatgaagttagggcacataaaataagaaagccaatagtgcatgattaattgagttttaattattaaaaacttgaaaaatggatttacatgatattttaaaacaatttcatatagaaagcttaagcacaaaatgcaccgtttagctttttaaaaagcgtgctaacagaaccgaggtaaaatctatgtcttaatcagaaaagaacggggccttagtgttacaatgcagcagagtatcactgcacaaatttttatatgtttgcaggactaggggaaacaaaataatgggatcaccagtatttcacaagtcacaacattcaataaagactgatgcttctgttgtttcttccatatcattgaaaaatagttttttaaattatactgaccatatttttgtacatattacaggttgactcctttctacaggtaaagcccatttttcatgcatggactgttctctctcataattttgtctccacttctgccgaatgttgttttaatttgacagttgcatgttgccattcatacagcacgacatctgtagtgaagaaattacaagagtatgtacatgatataaatgagaacattgaaaagcttcctactcgtggtccggtatctaaatatgttcttcctgatgaaaacctccgaggaaggtgaagcatatatgactttattctcttatggcagtaacagtaaccatcataatttacagattgattatcaattcgccattacttaccattgatcttgctaggcttgagatcactattgatgaagatattatgaatggggtggcctgtaatctcgagtcgcgagctttcaagcattatgcaaagcaactgaggaaattgtcggccacgtggaaccatattccattactgggagtctgcccctgattagggaattacaggtttgagaggaaactggtgcaagtgttatcttgggaacaatcgccatttaactaaaacaaattcctcttcaaactttgcaggatgaagggtttgatgttcagactgctgggtatggtaagtaccttaccaaaaaactgtttcctgatttctttaggtcatgtcatcaatgaacaattaatggaaaagtctgttaacagtattcacatggttgagagtagtatagattaaattatgtataccgttcattttttgttgagttccacttggcatcctattatattgatatactatcgcggtaaacaagtggaaatgtagacagtgtgctgtaaatgtttatctgatgcttcttctgttcctgtaggcttactcaagacataccacgcaaagaacgagtactgtctattttcagatatggcccaaggctttcaagtatttctgagcatcatttcacagttggaagcagatgtttgagtcttgttttagggaggaaaaaaatgagcgttcactggtacttattcctgttacttgttgctctaataaaggcactcacagtgcaagctacccaaaatgaggaacctcaggctaaggccacacctcctctcccacggtgcaaagatgctttagggtgttcttagtttttcatgtaaacccttgtcatcttctattctagtcctcacatgttttcaaacaacataacatacaaaatttaccactaaacaccctaaaatgtacaaactagtataaaatttctcccccgccctcaatctctccgttccccaatccaccacaacagcgccaacggaagccggcggctccccgacctcttcccagccagtggcttggagggcgacggcggcgtcacgagaactcgctggggccccttctctccctgctggcaacgagggtgacgggggcgccgtgagagctcatcggtccctccacttccggtcggcgatgagggcgcagaggggggcggcggcgcgagagatcactagcccctctactttcggccgacaggccgatgacgagggcgcggagggcggctgcggcgcgagagctcaccggcccctccacttctggccgtcgacgagggcgcggagggcgacggcagcgcgagagctcacagggcccctctactcctagccagggtttgcaaaaccgtcagtaaccgcgcggttaatggtaaaagaaaaaccacgataacctccttaaattcaaataaatttaaaaattaatttgaaattttgataaattttacacggtttcgtatggtttgccatggttaccgcgcggtaactgtgtttaccatcggggcgtggtaacctcggcggagggggggggggggccacgatagatccacattgccgggaggctggggacaagacgacagtgtcctcggtctcgtctccacggcgcgggagcggagcacggggacgaactcagcgaagcagagcggagcaaggggcggcgacggggtcggtgacgcagagcgggagacggtgacgaggtcggcggcataggagcgggagatggcgacgaggtcggcggcgcggatcgagaggcgattctcccttgaggtggagccgacgagctcaccggttgccgctgaatcaagtttccctggcgacgaatcgagtaagctcgccagagtgggtctacctcctcgccctagtcctctcctcgttcattcctctccgcccattcctccctagccatcgccatcgccgcgacccaacctgtccccgccgctttttcccgtcctttggcttctcctcttcctcgtcagcacttggcacccggcgagctccaagcctgctcagatcttggcatggcagcgtgggttggcggggacgaatggggaacatttgggagtagcaacagagaggggaccgctcgcactttctttttcaggcatgaggaacccggaccctagctaggaggcgcaaaccttgcaagggcacgagacccacctccttttctcctccacgtcaacaaggtaacgctccacgtaggagcattgtgaaaggcttaatagttctctgctcttggactcagtccattgtactaggaaatcgagctcatgttagagcataagcaatgggtggcttagggtcgtgcccttgctcatggccgtccgacccagttacctttcgcgcctgagccgtctcctctgctaggcacgcgactactagcggggggacacgcccctcggtcacttttcgttgagacggcgtgggggcacgtgttgggtgcgcggtggcctggcgtgtgtccagtggacaccgctcccacccctatattttaccgttccacccctcgccctcgtcgttggaagtaggcaagaggcacacggcagtgaggaggagctagaggaggcgaggtggtggaggagccggcgaatctgcgatgaccccgcggtggcgacggccccacgacggcgacgggctcaccagatccagggccggcgacgaccccgcgatgccaacgggcggagggagagcggtggcggcccggcactcaagatccaacctccgcgtgccgctcgccgtggtggaggagctgttggccaccctgcgcaccatcggcggccccacgaagatccgcgacagcgacgacctcacggcagccgacgacgggagagagaggccgatgggagagagaggccaccccgcgctcccctcgcggtcgtccaccccgcgcgctgctcgcctttcgccaccgtgcaccgttcgccatctatggaggagacgagaagaggagaggaagagacaaggacggcagcgtcggtgggctgatgagccctttagctgggctatagaagggtactttcataatttttcactttgtgggctggagtatctttatcaagtggtctcagattttgaagaacccattggaggtatccttcagtgagagatgagttccctagaaaggatcctcagttagtgaagacactctaagggtggctttggatgtagatgcccttgtaccacgtagaagctcttgtcaatatcgaacaattccattgtgtgtgacaatcaaggatggtgcttttccgctgggccattttcgtgggttgttctgacaatggcccgaacttatgaagtctgacaggcagcatttgttcagtttctcgtttcatgggctgcatacctgatggtcatcctcaatagccaggttgcaatggaaatccatcatcttggtgcacgaaatgggaatatgggatatcactacatcctgggcctagggttaccacatttagggtccatttgattgttagcaaaaacataggaaattagaagattttgatttgtatgaaaaacatagaattttagaagattttaatcgtataagaaaaaaatccaatgaagtcttttgaagcaaaggattaaatcatatcttttccttggagattcgtacggaatgaacaatcctatacgtattttgaagaaaagttagcaagaattctaatatctttttcatccgattcctgcgtttatctcacgtcctaaccaaacaaccatcttgtgtgtttgcaattatctattttgcatttgttttccttgtcaaaaaccttttttttctattttttttgttttttttaatttttgttttctattcgtttcaaatgaacctttacactttataagctcagtaagtcattgacttgtccctagactgtcatatgttcctaagtaacctggatcacaggacgagctaatgttcctgtcccgggaacgaagcatctgtttgttcctaagtaacctggatcaccagatgagctaacgttcatgtcctgtgaattttgttccctgatcgagggtcgtgattgatgtatgggatgagcagggtgttgcacctagcacaaggccaatcgtcatagtaaaaaaactagaatcggtgggtgacccgaccgacctctcagttcactagtcttggcttgggcggtcgtagttcacgtatacatttatgttattattcctttctattcacaaggtgaggaatagtatgatggttagggaatgacgtgttggaaatatagtcatatatcggcatattttaatccaaaatattaagacaataataatgcatgaacaatgtgggatgatctagtgataaaatctaacataacaggagcatgcttaagatagaataagcatcatcatcatacaaagaacgcaatagaattgcgactaacaaagatatcaaaaattgaaataacagtaaacgcagaaggttatacctgtgaatgtccctccgctggattgtgaggctgaaggtgtggaagaaccccacggcctcggcccggcgcgccgcgcgtgtggctttccgatccccacctcaaccggtcaatagggagcctccaataactccctatttaagttgagatactcctcttttaattcccaaggtggtattattatccttaacatttattatgggcctttgagatttaatagaataaatcgggcctagcccatttattctaacatgacattgtcaactcgctagccaatcagtagcgattttgctatatatttgtcgacaaattttctcccaaaaatttgacagatgtaattacagtacaatcgtagtgtaattacgctgtaacttgcatgtaattacactgtaactatagtgtaacttgtatgtaactttcaaaaatctctctgtaatatgttatttcggtaaaatggaggttgtgggaacaaatccttatacatatgtgtgtgccgtgattttttttcttcctcagcaaaacaaatcttgtaatagatataatgatttaaaattacatgaaacttacgtacaagttacactgtagttacatgcaagttacagtgtaattacatataagttacagtgtaattacactacgattgtattacaattacatctgtcaaatttttaggagaaaatttatcgccaaatgtataggtggtcccatcagtagtggtttaatgtctggttcacctgaaaaccaactggttctctaaatgcatgtctagcgagttgatttttaggtgaaccagatattaaaccgttactgtttggcagcgagttgacaacgtcattccctaaccatcatgttattgctcaccttgcgagttgactagagcatttgtgcaattattgttcattcatccataatacaaccaagcaggagtggggtttattatcttccgatgacccaacctaaaatatttttgtatttgatttagtgatcatagccccaaaaccccttttgccaaacaccaggtccctcacaaatctatctgtcgactacagaacatcgacaacgaccatcacattg

SEQ ID NO: 39676 - DNA, 3723 bp, Oryza sativa
tccactactagctcgccatgcatgcagctcatctgtctcggcctagaaaccgggccggggcgcgcgccggtgaacctactacttgctggctgccgcagcgcccccgcccgcgcgcgcgcatatgcgtccgttcgcgtggcaccaaagcgcattgattccatcccttgtctcgcacaggccggagggggggccatccgcgccatgcgatgcatgcatgggcgcgcgcgtctgcctccccgcccgcccgctgcgacgtccctccaaaaaaaacggccggccgggcggcacggtgcgcaactgcacatgcccacgctgcatgcgcctgcgccgagagcgcgcagcccggccggcggcgcgtgtcagcgagggagggaggggtgatggtgggtgagcccggcctgcctgcctgcctgcatgcctcgcgcgcgcaagcgcaaaccgcacacacggcaggcaggcaacagagcgccttgttgttggccgccgggaacgagaagcccgtgaacgaccgagcgaggccgcgccctcctgcgcgcgcacagtgacgcccgccgtgccggccgggaggatctgtcgttgcgctgcccgcgcgccggcccgcgcgtttcggacgcttgtgcttgtccacacgttcgtcgctcacgaaaaacgtaccgatgcctagtccaagggctgatgttacttactactactactactacaactgatctcgaagtagccggttctggatacatgtagccgtggaccgtttgcaacgtcagatcgagtgcgtacagcgtagcgcgctatatacagtgtgtacagagtaaccgtgtatcgatccaaggacatgggtagcaggaggagcaatacagagaactgactgtaagatagagtttctttctcttcgcttctatacgcagtacaagtattagagcaagtttaatagtacatccaactacaagctccaatttatttatagctaatttaatagtcgatttgtacaatagttgcttactatactattaatacctggtcccacatgttatatacacatcacgtcttgtaatccgtgctgtagctggctacagatttgtagcccgctgatcttctctcctattttatcactttaaaatatgtttatagctggcttatagcctatacctgctcttatactgtactactattgtgttctaagattggaccatgtggtccaatttgtcaggggaatccatgtgacgagcaacgatctcgaaaaccgcgtcacagagcagtgatgggtacaaatctcgggcagcatagacacgaacaaacttgcgagtgtaggtgtgccatgcactcatgcaggcagccgtaaactttttgggacaggtcagtctcaccaaactttctacgagtactttgccagtttgcctggttgaaacgtcgggattttgtcaatttaaatgcatcgattcgtgtgaaatttaggggttgtttgttccctcccaaacattgccaaaccttcttgccaaacctagccaaatatatggcttataaattgatggacacaccttagacatggtttgactagaaaatggttgtatgacacgtgggcctttaaattagaaaactgtggcatgccacaagtttggaagtgaaacaaacatatgtcttaaaaagtgtggcaaagtttgttaaagtgagggagtgaaccaaactccctccgtctcacttacgagcaactatgagtttccgtggctaattttaatcgtttgttttattttaaaaattataattagtattttttattgttatgacatgatagaacatgaatattactttatatttgacttatgtttttaaattttttaaaaaactttttaaataagacggacgatcaaagttgagcacggaaaattatggctgcacttaaaataggatgaagggagtacaactatgtgtttaatatagtactactagtattccctctatcccataaaaattaatctagtactccctctatactcgtaaaggaagtcgtttaggataatgtttaagtcaaatcttatgaatataaattatgaatatctcttaagttgttgagtttaaaaatgtaaaaattatatgaatagatttgtcttgaaaaatactttcataaaagtatacatataccaattttcaataaataattttatagaaacaagaagtcaaaattgtgttttggagaccgtgccgctgtccaaaacgacctcctttacgagtacggagggagtactggatgtgacacattaatttggacatacctctatttagatccgttgtactagaatatgtcacacccaattctaagttcgttttttatgagacgaagggagtacttagagtgggtttagaattgtttttttcttatttttgtaagaaatgtactcgtaattgtgatgttagttttctaaaaaaactaatgggacctggttttcatatgatcctggtaaaactttataaaaagaactgctcatctcgtttggagtacaaaatcctaaaaatgcaagaaaataaaagcacaagattggaatgtcacggcatttcaaatcccatggaaaaaaatttgtaagaattattcaaagcatgtattccgatggctcatagaaaaaagagtaaattacacgcgaagatgtcatattatcatctagactcgtaaacttgaaaaattgcacattgagatccactatcttgttttaatgatccataagtggtccaaagtgtgtttgactatagccgaacgcctatgtggcgctccacatcttaacgtggtggtaattttgtaattaccccctattgctacaatagtcatcgaaatcccccaaaatattctaaatccctttgcattcccccccccccgccgcgtgcttccatgggagaggcctaagtatcacgaggatgatgtcggcagtcatcggcggtacgagatgattgaggtgttaatttgggttgtgcgacaaacgatgctcgataggcgacggacaacgcaccttcctcgtcgacacgacggttgcgatggacctcaactttaagggagaagattaatcggtgtccctaccgtcgttacctcatcgtttcctgccgcctccgaacagcatcctcatcattgcaaccctagtcgtcaggggaatgcaaagagacgaagggattcggggggatttcgatgactacattagcagtagggggtaagtacaaaattatagcctcgtcagatgcggaggaggctggatgcaaaatgctgcctacgtggagcgccatgtaggcagccaactctggtcaaacgcgctatggaccggctatgatttattaaaacaagattatggatcttaatgtgtaatttttcaagtttatagatctaagtgatatctttgtttaagtttaagaaccggtcatgtattttactctagaaaaaatatagaaattttgtgatataggttagttaccccatctgtctctaaaatacttagttcctagaatccaaatgcacattttgtaacgagagtaaattactctaatgcctctaattaatagaaaattagtttggtgagttggtagataacggggtattgaaggataaattttcttgattcgtgaaccaatattaagtaataaggtactacgtatgagttagatttattttgaacaaagtttaagctctataaatttattttttttagacgaaaggagtagattagagtgagggtaaagagagaaaaggatatt

SEQ ID NO: 39677 - DNA, 13123 bp, Oryza sativa
atatatatatatataatactaagaagtgtcatatctgatattagattaggattttatatgatagaaggagacatatttagatttgtcatactagaatgtatcatatttgtactccctccgtcccataatataagggattttaagtttttgtttacactgtttgaccactcgtcttattcaaaaaagtttggaattattattttatttatttttgacttactttattatccaaagtactttaagcacaactttttattttttatatttacacaattttttttttaataagacgagtggtcaaacagtgaaagcaaaaacttaaaatctcttatattatgggacggagggagtaggttgtttttttatatggaatggaagaagtaatatggcaaattactgcagacactacacgtaccaaattaccaatcactccgcgtctccgccactccggagtcctggcttctgaacggcagagttggcaaaggcagaggatcactctcccctgcactgaactcaaatggagaaaacgtaaaagactggacaaatgtacgggatcccattgggtggattcgagtggttgttggattgatgtgcatcccaattgatagagatgaattcaacggagttaactcgaatcaatcagcgagtactcatatctactcctagtactgtttcgcagttactacagagttgagtggatgagcgcatccaggccagatcgagaggcgaagactgtgaacgatctactactgcccgcaacgccttcaatgcccctcaccaaccctaataacttcccggcgccgccccgccctatctactcacccgaccgtcctacgtttgcttccctgtctaccggccgtcgttaatcctctcctctccgatcgcttctcagtttgggattttctttttcccctttcgcttcacgtgaacggccggcacggcgtcgcgtgcgtacgcgatgccgcggcgagaaaaaaagcaacgcgcgcgggttgcatgtttgttacacgcgcgtggcgtgtgcatggtgatgttatgttacgcgggggtgagtagaagtgtgtgtaccttctcggagatggcgtcctggacgacgaggatgtcgctggtgatggcgttgatgacctcgccggtggaggcctcggtgtcgaagacggcaatgtcctggtccagcatcgaccggaggtacgcctggcgcatcttcgccgcctgccgctcccccgtgtgcatccagcacgccacctctgcacgcacacgagagccaccaatcaaccaaccaccgcgcgcattgcatcgctcgcgtctcgaaatctacgcatgcatcagggctcaccggtccacgacgagaagagtatgacgatgccgaggtacacgaagtccagcgagtactgcatgcacggggagacaaggtgagcaagcaaacagagtgtgacatgcacggtgcagtgcatgctcaatgggtggatcgggatgtgttactagctagtgtaccttggcgacgcggccggagacggtggtggggaagaggtaggcgaggccgatgatgttgatgagcttgccgaagaagatgaagaagacggggacggaggcgccgtgcgcgcacgcgcccagcgaccccaccgccatcagcacgtagtcccaccggtcggcgaacgagaacagcttcaggaacggcaccttctccaccttcgccgccgcctccttctctccctgctccgccttcttctcgccgccgccgctctgccgatgctcctgcacgccatgcaccggcgagctcatcttctccgactcgctaccaacaagatcgcgtgtgcgggtgagccaagacgctgtgtggcgcctgcgtggggggaggtggtggccggccgcgcgcgagctgaggctttaaagactaggagtacacagtggtacagctcctccagttcacttcactcgctgtcgtcgctggaatggtggcggccgtaatttagcccgcgttttagccgtggcagcagcgagcaaccggccgcgtcgcgtggtggtagtggtagagaaagcaaactgagactcatcgacgggtggggttggttggagtagatggttaatgtggtgcgcgaggtttgactcgccttgtgctggctactggctagctcaggccctcgcagtaatgggtgctgagcaagttagtgctgcagtaaagagcgtttgtccaaatgctgttgttggatttgactcgaaaaatcaatgctttggcaaatccccaaaaattaactgccgtgagtttacctgtgggatcctagtactgaatgaatggctgaacagttaatattagcggaattgttaaatcacattcgacattgattcttaggagttcatttttttttcagattactgatcttagtatttgctttacaattcgtgccctatgatcccgacaaacgacattagagttacgatctagggtgcggggaggagattactatgcttacagatctggccaggagatacgatggcttgacagtggatggtggagatggacaaaagacgaggcactagagccacagggaagaaggagggcggtgggctagcgttgacggtaaagggcaagtgagcttgtggttaattacgggtacgaacaactgcatatggctgggcggtgtgtggcacggggtggcgcccgacaggggcggtgtaggcggcgctcctttggtgaataaggacggccggatgcaggcggcgagaggtgacatcggcgctagcaacacgtgaggagaggggagtgactggcgccggcaacatgagaggagaggagaggtgacgccggcgctagcagaaaggggaagtgcggcagcggcggcggccctagcagcggcgcactcggaagtgcggatacaacagaaaggggatcgagagcagcagagagagatgcggtgtggatgcggtgaggagtttagggttttctctcctcagccgccggaggagttgggcttgggccttggctgttgtctgttgggctgggtctttactctagtctctaggagtcctagctcgttaaggctcgcaagcagctcgcgagctagctagctcgttatctctaacgagcttaaaagtcagctcggcctgttacgaaatttaaatgagccgagtcgagcgagctaacgagccatgagttttatgtccacctctaattgttagtacctctttgatttggtcaagagtagcggtgtagtcgagagcaaaattggcttgacacacaaatctgcggctatgcagttgttcgtacccatataccgtactgttataggtcacttctattgaaaaaaaacaaattgttagagtcagagatcacggccctttattccccactttcaacatgtctctccaacgcaacacaccaaagctcgtgtatgattttaccctgtagtaagatgaccaaaaggaatgaagaggtatctaggcgagatataatgatacatgtcaacggtttaggtcacgactatagtatttgcatggtatggggatcgtcggtaccagggaatatgcgagattaaggtaaaagagacaaagacaaggattttatacaggttcgagccccttatcggacatgtaatagccctactcctgttggccgaattcggtgttgctcctgttggacaagtacaatatttgggataacttatctagctgtcgtcgacttggtggcatagataaccaacacgtagtcaacgacatggtagtctttctcctcgagtacgaactcatcgagatcagaaatggcgctaaatccctcttgtcggcctccgcatgcaccatacagggtctgtctacttgtctaggcttatccctgatgttaatgtctagcggcgtgtgttggcttgtgtattgtgtgtcaatctgttgttgtgtcttgttggtctctccccctcctcctagggggtcttgtatttataccaatagatatcctcttgttcaattaaaactagagagaccaatatggatacaattcgagtagtacttgtcgtttccatatagaactctacttatcattccttatccggaactctttctatatacgagatatgattccgtataagacttaatatatggttgggcctgtcgtgcttagtcatctactattaggtatatggtatctataaccatgataatactacttggttaatccagggtgggatcagtttttgcatcacaaagccataaataatctaacatcagtacgtgggacattcttgcaaactgaaatggctggttgcagagttgcagttcgcaaacttcaaccttatcaggcgggctaaaactaaactgaatacgtacttaccctactcaacagtctatcgtatacacacatgtgaaatgcctcacatgccatggtctgtctacaagcagaagcagggcaacgccaaggaggcttttattttcacttgatctgacaccggagcagattcgtcttgtacttaatgatatgtaccgatgcgaggccttaaatggccacaagggaaaaagggggtgatttaaatgtggaaggaaaatgcagttgaggacgggatagatgggaggaggatcatggcctgatgcgatcagataattgccgaggtggacacttgtgccgcgcgcagcaaaagaatgccaagatgctgggacttttgctgagagcagcaagaataccaacatgctgatgactgatgagaaattgagaatgctttggttgctttgcttttcccatcgctgtggcgacggacacgcaattgatggtgaattgacgacaataatgtgtcgtttttgcccttgatttttttttgtcttccgttttttattttgtttagttcacatcaaaattaaaagtttgattaaaattgaaatgatacgacgtaaaaattaaaagtttgtacgtgatatgatagaaaagttggaagtttaaagataaacacggtgatgcgcgtagtgtgccaattcaggatgcgcaactaccgttgggattggtggttgcagaaaggcatactagtacttgcttctcaccgaagtacactgcccgtctgcattgcaagtttgcaacttcgcaagacaggcacagcgccggaaactgtaggcatattaagagaaaagaatatgtgtacggccatgtttccacgtcaaaataaataagaatacagcttgatgctcgtcaactttaagtatatagctgagtaaatgtgcatcagccaattgcatcctgcagaccagatacagattcttctgctgaagagaggaaaggccagggaaggaagagaacgagaaggtgatgattcttttttaatagaacgatggatttctgtgccaaaagcatactggaagttggaagcagcatttgctactaaggcccaggatcagtatgaagcccagcccatgtaatgacatggcagccagtaaaaggccggctcctcggtgttttgtttaggaataagtccatttaacctccctcatcttgtgcttgtctgaataacatcctccaaccggaaaaccggatatattacctcccccaagtgttaaaaccagtacaaaacaactccctcggtggtttttgacggtggttttgctgacgtggcagcctagtcatcgaaaaaaaattaaaatattacgtgagggcccacatgtaagtgtcatttctattcttcctcctccactctcctctctcctctcccttctctctccctggacagggcacggccaggggaggtgccgaagcgcgcgagagggatggggaccgccggaggatgcgggcgcgtgccgcgaggaaggggctcgccggccgcggcgcccgcggggagggttcgcttgccacggcaagcgcggggggcacggttcgccgggatgggtcgtcgaatcgccgccactgccgtcgccgccgacgagttggctcctctcgtcgccgttggtccaaagggaggagacggagacctcgctccccttgtcgaaatcggcggagctcaacctgggcattgctattgctgcctttggctccacctcccggatcggcaagacaacacagcggctgcgcaaatccggcagctcagcggcggtctccgccgcgggaggccgtggtagtggccagcggggtgacgagaggatctagtaggcaccggtgtctcgacatcggtggctgcaacgggagtcgtggtgggagacggcgaggcggtgatagtggccatcgtcgggcggcggcgcccgggtgtaggatcaaggaggccgactagagggggggtgaataggcggttttaaaacttagtggcacttaaacaaaactaacctaagttgctaggcaaggtaaggtgcaaggttaactaagcaactaagttaagttttgcaaacctaggtgatatgggctcaaatatgtctctatgaatgtaaatagaacaaatataaatacaacaaataaatgagacaagagacaaggaatttttcaccgaggttcgaaaacttgccggtttcctaatccccgttgaggcgagcccaactccaccgctcaaccacgaagccaccgcacgcccccttcgtcaaggggtgggcaaggcgggagctggtgtcacgcccagaaatttaacccaaatttccagactattttgcgtattaaatccctgtccaggaccagccagggtacacaaaacgacaagtaatatacagttccaaacgtaaataaagcgtaaagtacttacggaagaggcacttagtcctcacaccgaaacagaacgacagcagaggaaaaaggtgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagatgtgcaaggggatacaaggatggtttgtggctatttgcataaaggcggttgtaaaatattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgtttccgtgcgccgacatgccaccatgacataccggaaagaggtcgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttatggtaagtacgataagttcttccagggcatcccacgaaccggttcttaactgccatgggtgcgaccagcaaaaccatgcacccacagcccaccattcaatcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccatggttgacaaaggacatatatcaagtaaacatggcacaagcgagtagataggtaaaaccctgaccccatgtaattagcaaaacatgcatatttatttgcaaacagtaaaacatttgtaaattgggatcaacatgctcaaggggaatgtgtgacttgccttgcttcttcacttggattttctgaactcttttcctcgcgaccgcgatcttccgaaacgacggattctatacgctggcacgcaaaacgaggaaaaacctaataaaaacgaaggaaacagtacctaaaaaataaacaaacatgtagaactcaattttagatgaattttgcaatttgaatggcccaatttggagttcgaatgaattagatatgaattttagaagttttgagccactaaatgaatttctataattattaatgatttattgcgcaattattaaatattttcacaaatgaaaaggactgccgctgacgtcagcaagagagggggccggcgccgacaggcggggcccgtatgtcagcgagacgaggtggcggtccaccgtggaccgggaccacaaggacggtccaccgccggtccacgggttggacggcctagatcggccaaggccgatcggacggctggggacggccgggcggcgcgcagacggccagacaaccggcggcggcggcggcgcaacgcggcgctggcacgggaggtggccggcgaagaggaaaaggaggagggaggcggctcaccgagaggcgcggcgacggagggagcggccgcggaaggaggcggcggcgctccacggggtgaagacgacggcggcgattcggcggtctccaatgaaggtgaaggagcggccggggtatgggggaacgcggcgaacgcagtagaggcggtggtgtggcgcgaggtggcaaggaacagcggtaagaggcggccgaaggcggcaaacgcggcgacgtcctcggcttcgcggtggagatggtgttgctgcggtggaacgggaaaacgaagcagaggccggggtgctacgcgatgcggcgaagccgacggtggcggtggcgtggcttggtggtggctagggcggcggtggcgcgctgccggagtcggcaaagtggcggtggagctcgggttcacggtggaatcggtgcccgggtggtttattgcggaagcggagcggtggacgggatgcgacaaagcgcggcgaggccggcgatgcaagcggcgcggcacggggacggcggtagcggcggcagcggccggctggagtccgccggcgagcggcggcgcttgggctcacggggaggagggggttccgggcatgggggagcttgggagagaggggaaaacggaggaggggagcacgagggtgctttatatagggctcagggatggagatcgtggccgggagaggtgggatcggccggtgacgtggggaggtgaagtggagctcgtggggaggtcaaaccggcgccgtttcttgcggggtgagtgggggaaaaggtggaggacgtggacggggtcgtgtccacgtggttggatgcgagctcgggtgcgggagggcgccggattttgcggcgacgtgggcggcaatggcggttggggttggccggcgagaggtaggaggaggagctgacaggtgggaccgccagtcccacctgtcggccggatggagagagaggagggaaaccgggggacgtaaagtagactttcgcaaggcgcgggccggccgagagagagaggaggcgcgcggcctgcgggagaggaggggaaggcttgggtcaagcccaaaagggaaggatggagaattaaatttgttttctttttatttaattggttaaatgatctttgtgactttaaaattatttcttgagctccgaaaatttgcggaaaaatccggagagtattttagggcacaaagaatattacaaaatattctcggccaatgatttttaaaggaaattttaatttcctctataatttcacttgattaaattgatttaacttttaatataatttcttgaaatgcattattaattgatttttaatcccgaacgaaaatcggggcgttacagctagcccacggagaagactacccaagcctcgatcactcggggtagttcttccttcactccgaaggtggtgaactccaaaccactcacaaacggcgccgggcctcctccacaatctcctcggagaggtcaccgggcaacacctacacaagccgtctaggaggcggcaacctccaagatgaataagtctaggatgcttgccgaggatgatcaagtgccacactagctataacaatgaagcaatgcacttggattggcttaactcactctctaacactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttgtgaggccggtcagaccggactactttgtaacggctagggcaatcattgagcccactcaacctggccggtctgaccgcagtgtagtggccggtcagaccatccacggctcggtctgaccggttgcggctctggcggctctgtatcgccaccaaaaaccagaccagtgcaacagaccagtggggccggtcagaccggctaacaggcccggtcagaccggcctaaggcccacggtcagaccgcaggtcacttttcagctcaaccgaccgttagtaaaacgacgatatctcttgactcgggtctcggaatttggcgttcttggactttatggaaagattattcaaagggctatccaacccatgaacaatccatccaagaaacacaacttttcttagggagaaagggctcacactccaaaggatactccacaggacataaccacatgaggctacccaaacctataggatttgcccacatctctctttgtttaggacttgagaaaactcaccacacttggctagacaagcccaccaaatacacctacatacatatgaactaatatggcacatgatcatccacaagctcgcttcatagacccctcttgatagtacggcgtctatctagcaaatccggtctacaccaaacaccaagaccgggaaaagactaagaaaacattcttagctacattatacctttgccttgcgccatccatcttggggtcaagtttgagtcgagatcaacacttgtgaccatttgattcaaccatgtttataccaaggtatttaccatcatttgtcaagactttcttctcatcacaagcttgatttcattcttgccaacatggcgatgtccttggcttggtgaccattaacccatggtgtcatccattagcctcatcatagtgggacctattccttttcacatctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctaaaacatgcacaataaatgtataggatttgctccccctaagtatatgcatacaaagaaatataaaagagagacaagtgtatgcataagtaaagaagaaccaatggggtttatcctatacacatagagaaggcatatgtagtaatgatgaagataaacaaaaaaacacataccttcatgatctccatgttctcaatgtaaaggagactaaataagataagactcaagtaaacattagtctcactcttatataacaataacattgaaatcatatatatgaacctatcaaaaagtaggagataagaagtgatatatatcgctttatctccatgaatttcatccttgtcatgattaaggtccatcaccaaagaatgcatatctaccacatctcattatcgggaaataaccttgttgaaaacttatgtaaaagagaggttaatcccataaacatcggtttatcatctatcaccaaagtaacaattacacaaattgtttaatccaagatctttcaatattttctctcttttgtgatagataataatccgatataaacaatacaaagagatgagatgaaagataatttcaaatcaaggtagagatcttataatgaacaaaatatagaataagctccccctcaagatgtgtatacatatggatatgaaggaatgcatatgcacataatcaatcaagatcaatgaggaagctcacactatattttggatctacaagatagaccaagttagaatatgtgaagtttaatacatacctcctatcatttttactttcatatccaaataagactagtcaaagaaagactcataaaaatgttagtctcatataattagatttgttattaatcatcgaaaccaaattaaggcacttgaacttacaccgggcttgttgaggaaaggggaaggggcggcgtcaccacaggacccgcgtgcagccggccgacaatctcctccccacacgcgtcgtggccggctgacgagctcctccttccatgccagcaaggttgtcggcaacgtcgctaccgagcagcagcagccgtcacggctgtcctgccgttcccgccgagctcccgccgctcttccgagatcctgccaccccgccactctcgccgtcctgccgctcccgctgagctcccgctaccccgcctgtcccgccgctcccgccgagctcccgccgccccgccgctcccgctgttctatcgctctcgtcgagctcccgccgctctgtgatcccgccgatgttcctacgcgttgccccgccatcctgctgccgccgagctctctccatctcgctcgccgccgagttcatttatttttattgttttactcactgacatgtgggtcctatttaggtttgttttattttagtgccacgtaagcgccacgtcgatgccacatgggaagtcaaccgccacgtaagtgccacgtaggacaaaaccgcctccgaaaccaccgagagaggtgatttgctctggtttttagagaagaaggaggcgttatacccggttttccggctgagggatgttattcacgcaagcgcaagagatgagagaggtaaaatggacttattccttttgtttatctgagatgaatttcagtgagtgagaaccataacgcacatgacaatcgtagaaacaactcaaatactcaatttgacaatttgttccactatggtgaaaaaaatcagcacggtgatttggtaattagagatcaaacagccggaa

SEQ ID NO: 39678 - DNA, 2264 bp, Oryza sativa
  unsure (1)..(2264): unsure at all n locations
ggcagggacgaagcaggcgtggaggactggagggtgctctcgtccaccgcatgcgtgggtcgcgcatgcatctcacttggcggcacgcttggacatgaagcaggacagcgaggctgaagtgttgcgcgccgtgtgtgctgctgcccttcgacctcgcggtggtggtgttgctgccgtcgattcattcccctaccgtgtagctcgttgtcgatgacgactacgggaactccagtttcttgctgaccacgatgaaaagcgacgagtgtggcgcggttgtccaacctcgcaggcggcatccacaagcaccgaggtaggcggaaacatcgcccctgccctcgccggtcgcggcggcggcggctgtgaatggaccgaattgagtagcatactcattgggcttgtaggctgataatggagattggagaacggactgaaacgatttctcccatcagatgtgctacgaacaatgatccagagttggacatcctttgacatagaagcctccacgtcagtggatcttgtacccttcgttacaaagtgaaacaaaaaaaatcctaactataaacttaaacatagctttatagttgatttattttgagatggattcgtagctagtggttgatttattttgagatagagtgtgtagtagtacaagattatgtattgtcttgctccatttaagcatttcataacctgacaagtgctctatggactagcatttcatttaatcaaaatcgggtatgggaactcgtatggtgcatttaagctgctatagtgttatgaactttagtactccctccgtttcgaaatgtttgacactgttgactttttagcacatgtttaaccgttcgtcttattccaaaacttttgtgaaatatgtaaaattatatgcctacataaaaatatatttaataatgaatcaaatgataggaaaagaattaataattacttaaattttttgaataagacgaacggtcaaacatgtgctaaaaagtcaacggcgtcaaacatttcgaaacggagggagtactatgatactacaagccctttatttcagagatgacaagttgttcatgttcctagcatttttctttgcagaaagtcaaaacaggaggtgtgcatggcatcatttcagcaatgacaagttgtatatatttttccaatcaacctactacgggatcacagatgacaggttgaacaaaaaatggaaccttaagattatcaactaaaatgttttatttctcgaactagcaagtgagaatgcataggaagaattaaatataatttcaataactaaaataaaggcacccaagtccaaagtcaaaaagaactcgaaacctcaatggtgggggtgcatacccacacatcccaccggcggaggtagaatcagttcctcacttctcaaacaagcaagatgggcacttgatttttcctgtcactacttatctcatgattatcttaggtggacttatctgcttttgtagatgagcttgtttcatgctcaagtatgttggtagcgtcatggaattccatatggagcgcatgaaattagtatgtacaagaactctattatcttattagagaccctttaaacatgacaataccactaattgatggtactccatgaatcatacaagcttacatacaacagtttgtttgatacatgaatggcttttacagcatatctaagaatccttttatattgatcaaatgggccaacaattaacgtaaatgataatctcatcctaatatatgccatagaaaatccagcaagtctgcataaagtactgcatgctttcctcaatttcattgaggaaatttattaatatatccaactaatataaaacttagtatcagtctccaacaaatacaaaaaagtatatctaaaggtgaagctaaatggaattataagtataccaagctaaatggagctcgccgataaatgaaaatgcttatcaactctataaatagttagaattagccagaataagaccggaagaacctcatggatggtaggcaagtcacttcttccaggactacatcacgaggcttcataaattgacagaacagaatcatctcatcatccagtagcagaaaactggatgtcagcatctcgggaggcctttctgagcttcaataccctgcgcctgaactttgcctgctcaaggccatccatcgaaggcacaatagtcatcatctctaacattggtgtgttcttgagcagnnnnnnnnnnnnnnnnnnnnnnnnnnnnnnnnnnnnnnnnnnn

SEQ ID NO: 39679 - DNA, 719 bp, Oryza sativa
cctgcagcccacagggcggggtacacagtcgccgtcccatcggttattcaaccggtcagatgcgcagcacgccgcattaaatgcgacatggcgcggttgcatagaccgctttaaatgcagttaggtggcagttaggcgctcccacctaaccctgtacacgtgggctgatacatggaggggtcggggcagctcgaccccaagcgagggcggcctcctccctctagcttggaggggggcagccgccgcgccaccccaggctcaacccccctcggggggagccacgtgggtttgggggcggcccaaccccaagctgggagggggcagccgccgcaacaccccgggctcgacccccctcggggagagccacgtgagtttgagggcggcctcctccctctagttgggagggggcagccgccgcgccaccccgggcttgacccccctcggggggagccacgtgggtttgggggcggcccaaccccaagctgggaaggggcagtcgccgcaacccccgggctcgacccccctcggggagagccacgtgggtttgagggcggcctcctccctctagctgggagagggtagccaccgctccaccccgggcttgatcccccctcgcggggagccacgtgggtttgggggcgactcgaccccaagctgggagggggcagccgccacaacaccccgggctcgacccacctcggggagagccacgtgggttt

SEQ ID NO: 39680 - DNA, 2393 bp, Oryza sativa
actgtcccaggttttttttgaggaaaaaaacttttaaatgtaactatagcagtacaaacacgcccaccattattcttaataaacgcacactatacatctaacgagaccatatatgaattgaagtgatttgttctttaaaatttagaccagtacagaccggttttgcaataattacgtacactacaaattttgaaatgaatatgcttatatgcctcaattatttgtctctgtctggttcctgcgacccagtgctcattgtgtctccatagcttggacaaggacaacaatgggtactgtggcaaaagtagcatgagttaattaataggcaaaaagttaatcgcacgagttaagctaagccctgaattttgggcgatgcatgattgattgctctagggcttatggagctatggtcattgctcgcatcactgaagtactgcttcatgttactcatgtggcctccttgtctcctcgtcattccctgtactgttaatccatgtgacattggtgtatatctgttgttcctaccctgattctcgtccttcatctagctggaaatgttataccttaagaataacaaatcacaaagttggattgttaactttcggagactgtctgctagctgcctagctggaccagttcctcaataatttacatattcgggaagataaaaattccatgtgccaacatttctgtcttgttttcaaccttaagatgaacatttcaggtcttgaaacccatctagaaattgggaataaatttttgacagaactttacaaattcaaacaagaactttaggggcaatttcctttgcttcgttgctcacgttgaatatcttttgtcccttgttgcctaggaaggagcccattctacgatattaaacttctgcaaatgtctaaaaaataaaggaatcataaacttcaagctttaatatagtttaatctgaataattacatcaaatgtttcgttttccaacattggcctcttctctttgccagcgtgtatgccattctctgtagtgtgaattgatcaatcttcctcaaattcactacttcttccttgttctctgcagcttcaggttcttaggtgtagttttattttgcttgtttaggacttccttaaagaattgaatgggtaggaaacgctcattctcaaggttaaggctgtgttcgtttgtgtgagatagggtgagaaaacacctcgttttccgtgcgcacgcttcccaaattactaaacggtgtgttttttgtaaaaattttctataggaaagttgctttaaaaaatcatattaatccatttttgaaatttaaaatagtttatactcaattaatcatgcgctaatggctcacctcgttttgcgtatcttcccaatcttttcaatcccctatctctcaaattgtaacatcctgaaaattctcaataataaaaatcactaaaattttgaactttttaaaacttttgcatcatgctggttgttataactgctattgctttccaaaccgtaaatgattacaaagaaagtaaagaaaagaactacatttaagcaatagatataatttaagagagttattatttatgtttaaccctacaagtatttatgcacaaaagttccaaattgcattcgggggttgaaatttaatagattaaacccctccataaaataaactaacatataaataaattgagctaatgtgttactgcgttaataacggtctcattaggaaattatagaatctttaataaatcttaaatatcggacaatattaaattttgggaaaattcacatttggacacttaatatggtcacccaaatgcttaggagtaatacaaatttaatttataacttttcccaatttataaatcaaccaaagccctaaaagtaggaaaataggaatacttagaaaaatatataataaaaataaaaataagttcaatattaaatttgaatacaaatttcaatggaataacttaggattggtgtatttttacattgtgacaaaattagtggcaacaatatatttttcctaattgcaaagtaccctctaaattcaaaaatagttggctagcactgttcattagcccctaggtgttcgatttggtttctagccatcctagctctctttctccccactgttgcgccgccctagccggcctcgagccccgcccgcaccggcgccgtcgccgtcgcctcgctctgccaccgctgccgcgccgccgcatcatgtcgcgtcgccgtcgccgcgccgtctccaacccgccgtcggctgcgccgcgccgctcgtgtcaccgtcgccgtcacccgcgtcgcgccgagcctcgcaccagtcgcgtcgccgtcgccgtcgcatcagtgcctcgcgccccgtgcgccgctgccgcgccatcgcgtcaccgcg

SEQ ID NO: 39681 - DNA, 2981 bp, Oryza sativa
tatgcattttctcaaacaccttgtgtgcatgccggcagcttcttctccgctccaccaacgccgccgagcttcgtcgttcctccatctctcggtaagtcctcgctcctatgtcctctcctagttccgtagaaactagagccccctttaatttcgccaattagcaaccgtagccatgccggtccggccaccgttttgccgccggtgagctcgctgtggacaggccatcccggagcccctcctctccatctagccagcaaaatggaaccctcacacgccatagatgctgacgccctcaccaattcggtcggaaaccctccttatcgccttagcacctagctacccgtgcccggccatggcggccttgcagcgccgctcgcccccgcgccgtcctgcgccatgaccgccggcaggtgtgcgccgtgaccgccggcaggtggacgccagagccttgccgctcccttccctggtcgctgtcgggtcaccctcgcccgggcctagccgcgccgtgctctgctcggccgatggctggaggtagaagacgataaagaaagaacgagagagagagagcagtcgggcgcacttgtcaatggttcataggatttgctttagaaaaataatccagtaggaaagcaaatacaatcctaaaccccacatgtcagtcacttggagttttggataaagtttaggaataaaaataatggattaggaacagtacctttttacaatttctcagatttattcaaatttgaatctttaaactagcgtaactctctcattttaactcggatttgagtgaaacttgaacctaaatttatctaaattcataagctttccaatggtatataattcactatttgataaaatacatttataattattaaataattaatactaagataatgcataatagtcaacttaaaaatgtgctaacaaataaaattagtactttacagtaaggtagatgtaagaatatttgtctttaacatgctttgtcaatgtaacaaccacacaaactaattttaaatgatgtctcaaattaatgtataggaagatactagtactattaaatggttgtataattaaaccccatgacttatagattatttaaataataaagttagccttataattaggtaaatcaaacatgaatacagatagatgagtctttaatttatttatgaggaataggtacagaattgttatgatagaaccacccaaataaggttgagtcggttagcatccaataattactcaaagagtaaaatcacttgccaacccacttaaatcacatatattgtacaatccatttaaaatcatacataataacaataacctacctttagcatatattaaaccaaggagtatatgacaaacatgtatggtggataaatactagttataaatcttgacctcatataattatagttcaactgtaagttaggattgttcattaagggataatctgtaactataatatgattaacctaaacaactctaacatacaaagcatggataattattaaccttttctaatttatcgtgacaagtaaaatattttcataattaaagcaaagcctccatcaataaaataataatacaaatggttccctgcgattaattgcttgatcccaaatccatctaacaacagaacctctggtatgtaaccgtgctatttaatagatgcatatatagccataatccttccatagccatttgatagaataaatcgccgattagccaaatatatatgtatcccataaatgctatgttggttaactcctaaatcgaccacgatgacaatagaaagattaagaagccttagccctagcatgattgaaatccattagcaaacacgaatagtatgagcaaccctaggatcgaccccaacaattatcttttgcttgtgcatatttgcttgttgtttgaatattggtttttctcgcgtattatagaccttgtgtatcggttagtcgtgaggcaacgtctacaacttccaggaggtgaaggttgatcaagattatatcaataataagaattatcctgagcaggcaagtcatcactattccttgaacatgttgatcccaattgcgaaaattattttgtttacaaataaaattgcatgcaatgatgaacatcctacttgtgattatgccatgccttgattattgtttacccttattcccttgtaaccatgattacgtatgagtccctagtcaactatgacaaatgcttagaaatgctactctagaatcatgcattctcatatttatcaaatgctatatgcttgggcaattacctttgggaaggtattgagatgcggcatgtggagacataagcgccacattgccatgatgttgatgacatgatttgtgaaaggagaaataaaattaaacaactgttttcgactggggcggacggaggatttgggtggtatccggaaaaggctagtatcgtccccggtcaattaaggaccgagccatgaagttaagcatgaaactacccccgtacaaccgcacttctcgtatgggtatagacctagcggagtagatagctgagtggaatccatgcatagtggtttcttgatgtgtgaggcaggggctctacggtggggcagccattggtagaaccgcgaggtgggtgtctacagtggtgtcgccatcggtaggactgccatgtgagaatttaaacataattataacttaatgcatgtgtgagtctttccttcccgggtgcgctagaactcctctcactgctagaaaccgtgtacgcctagagtgcatgaggatgtaaagttcatggagcgggtattgccaatgtgaggttatcgaaaagctttgccgtgacgcgtctcatgtgttgggacgggctcatgtgttgggcagtcgcgaagtgcgggtaaagtgtacatccactgcagtatgagtaaaccaaatctattcgaatagccgtgctcgcggttattgagcaccgggacgtgtatt

SEQ ID NO: 39682 - DNA, 5036 bp, Oryza sativa
tcaatcctacttgaaacacgttataaaaatatagtcaaacccacatgtcatccctatccatcttcttcctcttttcccatctccttcgccatcatagtccaacgagctaggtccacttgtcatcacctctctagggcgcccctgtctccttgcagaaacactattcaaacaataccaacgagagagagcaagagatatgagagaaagggtcattcctcaaggcgacaactttgtgagaggatgtcgtagcgaagactcgggaatgatgagatggcagtggactggatgacagaggagcttgccttgaactagctgttgaatagtcccacattggttgtggaagggtaaggatcctaatatataagtgggggagcccttcgcctcaataactagcttttggggtgggaaagaccctttacgatcctacactagctcccctattgagctctctcagtggtaccgagctcgaacaaccaccacggactcctccaagctgcaaggccatttgccacaaccaccatgtaccatagttattaagaccggacaggataatgaactggtcgagctctcggttcacctgtttgatggtccgaccaggttaggccggtccaaccgcggttcgatgtataatatgacgtaaatgtctcgtaccaacataagtgaatagatggagggttggctagcgcgtgctgctctcagccatgtgaccgaaggtcgaatccccactcccgcaccctcttctagcgatttttggtggggtttgctcagtgggcctcgcctcagcccatcaacaaaagccttacccggtctgaccactccagttcaaagcccggtttatataaaaaccgccggttcaattgcacacccgatcttttaagaggaccggacctgtcgaggctgaggttccggtttttcccggtcgggtcctaataactatgccatgtactagtccgagttgcaaggccaccatttgtaggacccccggcaaccaccaccatgggactacttcggagctccgagctgcctctaggagagcgtcatcgctatgggaagagatggtgctgccatataatttccctcctctctcaccatcctacttcccatctagctcatcatgtcagcaccaccttgcagtcatgggagtggaggttgcgaatgtgacgaaggttgttggaggagaggggagaaaaataaaaagggaggaagaagatgaggagtggttaaatggtggatctcatgccatattggacaccacataattccaaggccactgtgtgttgagtaaaggggagtaatttgtctagttttaagagttagtggatgttaaatgtccggtttcatagttgaggaggttagtcaagcttaacgcttttccttatagcctttacacctccatacttaggccccctttgaattggaggaaaaatggagaaaaaacaaaggaattgaaatcctacactattcatgcctttgattcgtaggaacaagaaaaggaaaaacgtaggaaactttcctattcctacaattctagagcaaaaacgtaggaaagttaacatccactctaacctcttggaaaactttccttaagtctatctctctcatttgattcctgcattttttctgcggtctaatcaaacagtcattcctatatttttcccgtgttttgcaatcctctgttttacattgcaatcctaccaaaatccggggttttccaattctccggtttttaattccggcgattcaaaggggcccttagagtgtggatggtaaggggctttatcaaacttgatgtagcaagaacacacccgacctaagagtcgataatcttgtctaacccgatcctgatcgccttcatgagcacaaaataaatgcctatgatgtgcccatcgagaacctaatttccaatgagtttttattgggtattccaaaccattaatagtatatccatgctcacataattaaaccaaactgacatttgaccacaagctagcaaatattaagtcatcaacattccaaaccaaagaatgcaatttacaacattctaaataagagttcccaaatcagcattaagcacaagacggaaacacatatatcaggtcagagcaaggattatccatgggcataaaacaatacccatgattgcccgtcaggatctgtcataccaaggttagaaagctactccgtttacccatttaggttcgatttgaatcgtagaaataaaaaaaaaacatagaaatagaaaaaatataggattctgacatgaatgtaagtataaaacagagaatttgcaaaacacaggaaatacatagaaatgatcgtttgattggatcatatgaaaaacaatggaatcggatgagagagatagactcaaaggaaatttttgaagagctttgagttcttgctaagtttcctctaaaatctctatagtattgtccattacatagaaatttcaaatgattagataagattcaattcttcgatttaaaggtattcatataatttttctttagtattgaaattctccaaaatttatatgtttttcttccaaattaaatggaccttacgattgtttccataactttgagacaagttgctatatgtgtttgctctaatgaaacagcaaaccctacaattaggcgagttgggatcattctgacttttcagcccatcctcccttctgacagctcgattacgcaacgaagaagagcccactcagctttctgatcatttttttgcctgttctactggatgcaggccgagagagagagagagagagacctggtgccactgaacgaagcacagctatagttttgctgctctagctctccctctctctaccgcttgcatagtttcattgcatggctgtctgggtggccgcacatcccaccactgttgctgtgcctaaaccttatcttttccccatataaccagctcacaccgctagagagaaagaaacatacgcatcccaccaacgcgacgagctcagaatctcagaagtcagcagcagcaaagaggcgataagtagccgcggctcaccgttcgttgcccaaaaccacccaaaagcgtagcgacacacgagaagccaccagccaacgtagtacgcgccgagagctgaggccatccacgacacacgaacatgagcacactagtagacgcgctgtgcgctccctgcagcgacaccgcgctcatctacgacaccttcaacgcctccgccgccgcgagcttcctcttcgacaatgccgccgccttctgcgacgctgacatcctcggcgccacggcgacaggggagaaggaggcgacgtcgtcggccgcggccgcggccgcggaagccgccccgccgaggaagaagcggcggcggcgcgcgaagagctgcaagtcgcgggaggagacggagacccagcggatgacgcacatcgccgtggagcgcaaccgccggcgccagatgaacgagtacctcgccatcctccggtcgctcatgccggagccctacgtccagagggtacgtcgtactacgcgcgccggcacacgtctctctcgccctctctgttttggttttttttagcaaaccgacatcgcttcgtgtcaagtgtttctaccctcttttgttctgtatatctgcgttgctcccatttgtcaaagagcaagaaagcgatgtcggagcaaccggcgaggagaacggcgatgagagaatgtttggccgaaagagactcccccgccatggcgccattgtccgccgttactcatggcgtatcgtctctttactgctcaatctcttttcatgaacagaagcatccattctttgcacagaaaccttctgcccattaatgtgtctcccctatcattaattcactcgtacacagagagagttgcctggatgggcctgtcatgtcaaaattaatgcgttcttgatcatttttaaatgttgtgtagggcgaccaggcgtccattgtgggaggcgcaatcgagttcgtgaaggagctcgagcagcagctgcagtcgcttgaggcgcagaagcgaacgctgctccctcaccacaaggcgagatgcgacgacgcaacgccgatgcataacgccagcggcagcaacgtcggggccggcggctgcatggagcccacgacgacaacgagcaactgcagcagcagcgtcaccgaggacgcgccgtccgccgacgcgcccccgttcgcgcagttcttcgcgtacccgcagtacgtgtggtgccactcgccgcgcgactccaccaccaccaccaccgcggcgtctgcgtcggcgtcggcttcggcgtcgtcgtcgtcgccggccacggtggcggcggcgctccagtcggagcaccgctccgggttggccgacatcgaggtgagcctggtcgagacgcacgccagcgtccgtgtcatgtcaccgcggcggccagggcagctgctcaagatgatcgccggcctgcaggccctccggctcaccgtgctgcacctcaacgtcaccacgctggactcccttgtgctctacaccctcagcgtcaaggtacgcctacgcctatcgcctgcgtctgcagccgtgcactgatttcagttcttttttcaacaaaagtgcctcaattttcggccactgcatttcacacgcatttcgcgctgaaacgcgcaccgatgcagtagctagccaggcgctcaaaccgagcgataccaccagcacaaacgtttgtgcgtgtctccatgcatggtttgggaatcatatgaggtcacttcaaccgagttaattaatcggagtaatctgggacgattattagagacggtgtttgattggtatagcgtctgaaaagaaaacgtgtcagatattctcctgcctgcactgcacagcacaggcataggtcatcgcatcaaggacgcagtcgtgcaggcccccaacagtataatgaacagaaacaagagatgagcagagatggagatcgcttcacccatcggctttcgatcaagcatcattgttcgagacgcatcaaaatttctcagaatttgatcgaatccgatggacctgactaggagcctgag

SEQ ID NO: 39683 - DNA, 2749 bp, Oryza sativa
tactccgtaggagtatttcagtaggagtaggcaggtcgggcccctgcagccaaaggacttgtcaagtccaaacggtgagtagcgcacagtactactagtggtctggtagtcctagtaagcactggcctaagctgtgcgtagtgtgacgcttcacgaaaaagctactgcatcagtcagtccagattgtgtaagaaaaacgctgccacggagaatcctttctgctgagctgagccatgctatagatttcgactggcatagagaactgagcagaaaaggctatagctacagtaggcacaagtatagcgctggtgttcagccatgacagtgtgtgacagttccccgatggaatctgtgtgggagtagtgctaatctacggcattttttttgcgacttagtggcagattccttcgctccctaaccggccattgcacatgcacgcaatctcattagttctcgtctaatcctaatcttgtctttgcgtggccgtgtgctgcacaggtggaggaaggatgcagcctgacgacggtggacgacatcgcggcggcggtgcaccacgtgctctgcatcgtcgacgcggaggcggccgcctcggagcatctcctcgcggcggggcaactggccacgacggcgacggcggtggcgaagagagaactcgcgacgtacatgtactgagccgctccaagtgccttacatgtcgtcgtttgtgtggtcgcgtgtactgtatgccgcgctcccgtttttctcccctttttaggctcgtcacgtttttgctgtgtagtggcccggcaggttagatctagttctagttgtactagtagatgcaaaatgctatgtgtccagtagtcccagcctctcgacgagggcgtacttgtctgtttctcgttctgaaaacagaatgttgtattgctgtacctgtacagtatcctgcctcgcctttctgtaataagagcgactagcgagtagcgacattggaaggaacagttcgagattcgtattatccgaacagggccttatgagggtactagcttacaatgggccatgtgagttaccactgcttcatggcaagggcgggctttagcctactcaaagtccatcaaccgtgtgatttgctcgatttgtgggccgtgataaggccgaaggccagcttgctgccaaatctccaaccagccccgccgaccaccaggagcaaatcaacccgtttgacggtttgaaaagtggtctatactgatatggcatgttgatttggtccacctgtgatgaatgaactttgtatggttatatttgtagtaccacatctatatctatacctaatataaatattcggattttttctgtcgtcacatccttttcaccagcgatttttcgtcccgcgttatccgatttcttcccaccgcacacaagtatcacgcacaaaaaataccccacaccgattcctacttcaatttgccacattaagcccacaagcccaaattaagatagatgaggcacttcaatatttaagattggaaacagtaaaattagagaaaaaaaaataaacgaaattgaaggggaaaaaaagcctaaagtaaacaacaaaatcaaaattgaaatccaataaaacacgcatggattcccagctgattcgtctcaaattcacctcatcgggcagccaattcatcacaaattcaatcacaagaaaagagtaaataaaataaaagagagggaaaaaaagatcaaacccaataaaccacccacagattcgcagtcgattcatcacagactcgccttgtcgggcaaccgattcatcacagattcaatcacaacaaaggggaaaatcaaaatcaaaaagaggaaaaaactgcccaaaaaaaaggaggggatggtggagcctcagcgagcccaccaccgccacccgcgaccgctctcgtcgccgtcgtgttcaccgctgcagcactgtcacaccctgaagttctcctcccaagcctaaaatttaatttataaatgaccctaagaaaatgctggtgcaaatcaagagaaaaccctaagaaaataatacaaataataatcgaatctggcatatggaatttttcttgagttctacatgtagaaattcattaacaggattttagtggaattttcagagccctagaaataaatttaaccaattaaaattgagcaagcaatattttaattccagggaaaatccttttcttcctttttctttttctttttccccttttcttttcgggtgggccgccggcccattctccttcctcccctcccctccactgggtcggccgaaggccaaagcccagctaggtcggccgcctccctcctcccacccgggacgccgacaggtgggccccacctgtcgggcccgtctcctacctcgcgcccgcgccgccgcgcccgcaaccgccgtcgcgcccacgcctccgcctcctccgggccacgtcggccacgcccgcgcgtgcgccgcacctcccgcgcccacttccccctctctctcgtccgctcccgcgcccgagatggccgggattcgattttcgaatcccgcctctctctcctctcccactccccgcgttggccggcggaatcttgcccctaccggccacgtccgggactcccctcccctatttaagcttcccgtcgccccctctcgctttttccctatttcgccgaactccctcgtgctccccatcgctcccgcgccgtgaaaccacccgccgccgccgcttccgttactccggtcgccgctagccgccgctag

SEQ ID NO: 39684 - DNA, 11371 bp, Oryza sativa
ctcccgtggctcgccgtcgccgttcgtcgtcgtcttcctccgcgccggccaccctcggtgaggcgtcgtctccccctctactcccctccctctccctcctagtgccgcgccgccgcttcaagtcatgcgccgtcgccttcggctgccgccgccgcctcccgtgccgccggtcgccgtcgccgtcggccgcgtgccgtcgccgctagccctagccggccggccagctttgatgccgagccgagcccggcggccgcctctatcgccaccgcccgatcagctcggggccgatctgggccgtcggtcccgtggaccggcggtggaccacccgcatggtcccggtccacggtggaccggccccccctttgagccgctggccagtgggacccgcctatcggcgccgccccccccttgatgacgtcaaccctgaaagttattgcgcaataaattatttaaggactttttgttatagtaataaacacagtgaatcttctaaaattcataactaattcatccgagctccgtttaagcccattcaagtctcagtaaatcaagaaaaatgtgtagactccattaaaaatggttttgttctctgtttcagtagtcttatagtctatttgcaatgtttgccttgtatgtcgctagattccggttcttccgacgctccggtgtacttcgaaatagtcgccgaggttcctctagcagcagagcaaggcaagtcatgtttgtcacttgatcatgttgatcctatattgcaaatgttctaatgttttctttcaaatactgcatttgttttgcaataacactatgggatgtttacctattgttacagccatgctattttggtaccttgctcctttgttagctcgggttataacatgaatagacgttagactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgttgcacccagagcaattaaggaccggttcgcgggaaaccctggaagaatttatcgtgcttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgtgaggggactgcccgtcgcccgctgaggacgggggtgaaacctgaggtgtgatgtgcttggctagagggggttatgcgaagggtcttgtcacgacctctttccggtatgtcgtggtggcatgtcggcgcacggaaacttgtcgtggggctgtgtcttgtgggtacagttgtacacctctgatcagagtaaaactattcgaatagccgtgcccgcggttatgggcggtcaaccagattcaccgtgatttgtctcaccctagtttagtcttttgaaattggatagtataggtggacgattaggcctgtcgcaacatggtatagcgttggacggtggatgattaatattgattaattattacgactgttttcttctttaaatttctgtttataaatgctcgctttatgcaaatgaaccacgctagctctcctttgataattccctgcatcatacccctattccggtatgacttgctgagtacagtggatagtactcagtcttgctctatttttcccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgttttttccgctgcatttttgtaagacttttataatgtttgtaagacgtggatctgtatgtcaactttgtcgtttatgtaccccggccggtcctggacggggattttaatgcacattctgcttggaattctattcgggaatttctgggtgtgacaagttggtatcagagccgaccttgatcgtaagccaaatgggaaaaacctaagagccctctgaatccttttcattccatatgttctttgtaattggatttgttccgggaaaattgggatctgttcttgtggttcaagggaaaaatcttggtcgctcgtttaagtgagatttgtcaaaacaagtcagtctagggttttagtaaaattattgagatttattcgtcagtcagttgggatttgatgggtgaaatgcattaggtcccagctcaggaatatgggttgcaaggtatttatgctcttattgttattattagtatgtatctaatttccccatcattttatcgttatgtaagtctgtcttatttattcgccctcatgcaaaatgatctatacataaaatttcgctcttattcgatactcttatttgagtcctttattactttatttaaattggatttgagcatgcattgatcctactcctttgtcttctctagatggccggccacccacccaaccaccacggagaaggcatgattgactttgtggcagagttagcacgtatgacgctggtggtgggctaccccaacgcgccggagtacacgactgttccaccgctcagtggcgagcttccccaccgtgtccgcttggaggtccatggctacgtggggacttgcctcgctaacatggtggttgaggcgtccggaggcacagcagatcacgcctgtcaggaggcagcatacctgatgatggccagactacgggagtgccacaactacatcttccatgacacggcgtatcgatttcaccctcgtcgagccagcggtgatgatgtcagtaccttccgtccaatagccggcgagaacgacaccacctttgatcacatgtgcgccgtgatgagggggatggacaggatgcacttggacctgcacaagacgtccaaggccttgaatgatgggaagctcatgaggatcgtcgttctaaaggacgagatagcgcgcttgaagagggagaatgctcagttaaagggtcttcccgcgccaggaggagtccggatccacactacgccccgcaagtcgacaacggcacccgtgcgcatccagcttgcgcccaggaacccacctccgcccgcagttcccgcagcacctccagttccgcccgcagctccagcagttcccgcagctccagcgccagctccagctcatgttcccgtgtcagctcctgcatccgctctctccttcgcgcctgcaacagccgtcaggggccccgccagtggcaatggaggttggttgccagctactcccagtggcagtcgcgacctcagcagcagcagctccagtggctcagagctgggtagcggcgagacttatctgccaggctccaggagtcgctcagagggacgtggtgacgagcaggaggacgcctttgactccaccgaccgcaggagccgttccgagcattaggctcgttttccattagcttatcgactgtctagcttttgcttgttagtttgtgtgtttaggttgcttgcttggggtcagtcgacggtcgatatcatgtgcctatgatatggctgtctcaataaggatttttgcttgctgtttcaagtgttttaattcagatcagaacaattgcagtttaaatttctatataataaagcttagttcctgagtatctgtttttctccgtttccccgtctactcttcctccagatggtctacaccaggactggcacccgcacgacaggtgagggcagcaacggcgaagaacgcgctgatggtgtgcatcccaacagtgattccggcaatggtccgccaccacttcccaagaatccgacgctagcccaagtaatggcacatcagactcagatgatggcagccatgatgcagcagatgcagcagcagcaccagcagatgcaccagaggatgctgcatgtcacgctctaaagttcccctttccagctttaaaatttgtaaaatgaatcgtccgaagaaattgttctttttaacctagagatgaatccctaattaataaatgcaaataataatcagaatcgacatgtggaatttttcttggattcgacatgtcaaaatatgataacatgatttttagtggaattttcagagccttggaaataattttaaccaattaaaatgagcaaagggcaatattaaatccctggaaaaatcctttcttctttttctttttcttattcaccaagtttcttatcatcttgggcagtcggcccagtatattcgcttcccgcgccggccttccatcggctgggccggcccaagctaattcctccctcctccctaacccctccgggtcaccgacaggtggggcccacctgtcggccccttcttccaccttccgccgccgctccccaagccggcaaccgccgagccgcccacgccgcccgcctgccccgccttccacgccccactccgcgccccgcgcccacgtcgccgcccaccatccccactcctcccactcgcgcgtgcaccccgcaacggagggattcgaattcgaatctctctctctctctctccattccccacgtcggcgagaaatccggccgcctcccggcctcgtccgcccctctcgagcccatataaaccatccctccactcccctccaccttttcctctttccaccgctccctcccgtgccctctatcgctcccgcgccgctacaccggccgccgccgccttttccactcctccgggcaccgctcgccgccgctggagccgccgctgagccaatccgccgccgccattagcttcgccaccgccaaagctaccccggccgccgcatccccatccaatcccgtcgtcggggcccgcttctccctcgtcatggacaccctctttccctctaacctctcacacttcctctcttagcgtgtcccggagctcggccgccgttcgccgtcgccctccggttgctcaccgtcgccgtttgccatcttctcctcccgcgccagccgaaccccggtgagaactccctccccttctcttcctcccgcgcgcgccgccgctccccgcatgcgcgtcgccgcgatgcaccgtcgccgcgatgcaccgtcgcccgcgtcgccggccgccgccgtcttctcgccggccgccgccgtcggtggccgcttgccgccgccgccctcgccataaccggccggccggcttgaagccgagccgagccaggccgccttcctccttcccccaggagccgtcgcccggagggccccgcctgccagtacccctccctcccccttgagccgctgaccagtggggcccgcatgtcggcgccgccccaccccttgctgacgtcagccctgggatgaattattgcgcaataaatacattaaggctttttctttattagtaaaaacacagataatcttctaaaaatcataactaattcatccgagctccgattaagtccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgattcgcggtttctcgaagacgttgctctggttccatcagtgcgagagcaaggcaagtcatatattataattgatcatattgtacccaatttacaaatgtcccgcatttctattaaatattgcattgttttacaatatcatgtgggatgggtcgtattactcagctatatgttgtttcccttacgccattgataacttgggtattaaaatgactagatgttggtttaggagatgcttagccatgcttagttcaactagtgcacaaaaggggatcacattaaaacatagactttgattattggcaatagctttggattagtgccaccgcaatggtgttggttaattaaaatacactacatggtgggctgtgggtgcatggttttgctagtcgtgcccatggcgattaaggaccggttcgcgggatgccctggaagaacttatcgtacttaccaaaagccagcgtgggcaacggctgggcttgtagtgtagcttttctctagccgacgtacctaggcgagggtgggcgtgatggagttgggtcggccggggtgtccggttgatcggcttccggattcaccgtggcacgaaaggggggctgcccgttgcctgctggggacgggggcgaaccctaaggtgtggtgcaatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagacgtgcccgcggttatgggcggtcgaccagattcaccgtgattagtctcacccctagtttagcttaatgaactggtgtagtttaagtggttggttgggcctgttgcaacgtggtgtagcgttggacagtgattggttaatactgcttaattgctactactgttttactgcttttaacttctgcttttaaatgctagctttatgcaaaagaacctttagcccccttggatatatcctgcatcatacctcctcttccggtacgacttgctgagtacagtgggtagtactcagtcttgctcttttcccccacaccagagttgaagttcttctcagttggagatgtctcgaagaggttggtttcatcgctgccgtcaagggttgcctgtggaatggaatcgcccactgcaggagtcaagtcttcaggcttagctcgcttttatcttttttcgctgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacactgcagcacgccgaacagcagcaccagcagtttggtccccctccccctcagtccaagttgccagagtttctacgtatcaggccacccactttctctagtaccaccaaccccatggaggcaaatgactggctccatgccatagagaagaagccgaatctcctgcagtgcaatgatcaggagaaggttgctttcgccacacaccagcttcaaggtcctgcgtcagcttggtgggacaatcacatggccacccgcccgccaggcactgaagtcacttgggcggagttctgtcgtagcttcaggaaagcgcaggtgccagacggggtcgtggcacaaaagaagagggaattccgggcactccaccagggcaacaggacagtgacggagtatctccatgattcaatcgcctcgcgtgatatgcaccggaggatgtccgtactgacgccgagaagcaggagaaattcctagcaggtctggatgatgagctaaccaaccagttgatatctggagattacgccgactttgagaggttggttgacaaggcaatccgtcaggaggatcagcgcaacaaaatggaaaggaagaggaaggcggcgcagttccggtccaaccaagggagccaccagcgaccgcgcttcactcccggacagcagggtagacctaccaccctgatcgtccgccagcaccgccctttcaatgccagcaacttccatcagggcgccagtggctgtcagaaccaccatggcggtcagcccaaccgcagtgcagctccgtgcccaccaatggcactagcacagtcagctacgtccgcgcaagctaagaaggagactgggacaaagccagggtcctgcttcaactgtggcgagcttggccacttcgctgacaaatgcccgaagcccaggcgtgccgggccaaggtttgtctaggcttgtgtcaaccacgcgtctgcagaggaggcgcaagcagcaccagaggtcgtactgggtacatttcctgttaactcaatccctgcaatagtactttttgattctggtgcaacgcgttctttcatttcaaagaaatttgtggggatgcatgggttaaggaaagaagagcttaatacaccaatgagggttcataccccgggaaatagttcaacctcggtcagttttagcccttcagtgctaatagaaatccaaagatcaccatttctagccaatctcattcttcttgaatccaaagacctagatgtcattcttgggatggattggctgaccaaattcaagggagtcattgattgtgtgaatcgcacagtcaccttgaccaacgagaagggagaaaccgtagtgtacaaatcactagtctcaccaaagcaaggggtctccttgaatcagattgaggcggaaatcccagtggtcaccgaggagaagaattcgaggaaattggaagagattcccatagtttgcgagtacccagaagtctttcctgaagacctcactaccatgccacccaagcgagagattgaattccggattgatttggcaccgggaaccgcgcccatttacaagaggccgtacaggatggcggccaacgaactagtagaggtcaagaaacaggttgatgagcagctgcagaaagggtacatttgaccaagtacttcgcattggggtgctccggtcatttttgtggagaaaaaggataagacgaagaggatgtgcgttgattatcgcgcactcaacgaggtcacaatcaagaataaatatcctttaccgcggatcgatgatttgtttgatcaactgaagggagctaaggtgttctctaagatagacctgcgatcaggctatcaccaattaagaatccgggaagaggatattccaaagatggctttcaccactcggtacgggctgtatgagtgcacagttatgtctttcggacttaccaatgcacccgcattcttcatgaatctgatgaacaaagtgttcatggaatttctcgataagttcgttgtggtcttcatcaacgacatacttatctattcaaagtctgaaaaagaacatgagcagcatctccgtctggtgctctagaagttgaaggagctccagttatacgccaagttcagcaagtgtgatttttggttgacggaagtcaaatttctaggccatgttattacagctcagggtgtggcaatcgacccatcaaacgtggagtcagttccaaatggaccccaccgaagaccgtgtcgcagatttgaagttttcttggacttgcaggttattaccgccgattcatcgagaacttctccaggatcgcccgacccatgacttagttgcttaagaaagatgagaagtttaaatggacagctgagtgcgataagagctttgaggagttcaagaagaaattagtatccgcaccagttttgattctgcccgaccagatgaaagacttccaagtctattgcgacgcatcccgccacgggcttgggtgtgttctaatgcaggagggcagagtggttgcgtatgcctcgcgacagttgcgtctacacgaagggaattacccaacccatgatctagaattggcagcagtggttcatgctttgaagatctggaggtactatctgattggcaaccgctgtgaagtatatacggaccacaaaagtctgaaatatatcttcacccaaccggacctaaatctccaacaacgaagatggttggaactaatcaaagattatgacatgagcattcactaccacccggggaaagccaatgtggtggcagacgcattaagcaggaagagttactgcactgccctatgcatcgagggcatgtgtgaggaattgcagtaggagtttgagcatctcaacgtgggaattgttgaacacgggttcgtagccgctctggaagcacggcctacgctcgtcgatcaagttagagccgctcaagtgaatgatcctgaaatagcagagctgaaaaagaacatgagtcggaaaggctcgggatttccttgaggatgagcatggcacaaactggatggggggaaagattgtgtgtacctgacgacaaggaactgaaggatatgatactcaccgaggctcatcagacacagtgttccattcacccaggcagcaccaagatgtaccaagacctcaaagaaaagttttggtgggccagcatgaggagagaaatagctgaattcgtcgcactctgcgatgtttgccagcgagtgaaggtagagcatcaaaggccagcaggtttactccaacctcttcaaatcccggaatggaaatgggaggaaattggaatggattgtataacaggactgccccggacatcatcaggtcacgattcaatctgggtagtcgtggatcgactcaccaaggttgctcacttcataccagtgcataccacctatacgggaaagaaattggcagagttgtacctggcaaggatcatgtgtttgcatggggtacccaagaagattgtatctgatcgagagagtcagttcacctcaaaattctggcagaagctgcaggaagaattggggacccgtttaaatttcagcacggcctatcacccgcaaactgatggtcagaccgagtgagtcaatcaaatcttggaagatatgttgagagcttgcgctcttgattttggtggagcttgggacaaaagcttgccatatgcggaattctcgtacaacaacagctaccaagccagtctacagatggtaccgtttgaagctttatactgccggaagtgccgcacaccactcttctgggatcagacaggcgagcgtcaactgttcgggacagaggtattagcggaagcagaagagaaagtcagaaccatcagggaaaggttgaggattgccctgtctcgacagaagagctacacggataaccgccgaagggagctcacttttgaagcaggggattacgtgtatcttcgtgtcactccgctccggggagtacaccgttttcagacgaaaggcaagttggcaccacgcttcgtgggactatacaaaatcttggaacgaaggggggaagttgcttatcagctagaacttccatccaatatgattggcatccacgacgtgttccacgtgtcccaattaaagaagtgcttaagagtacccgaagaacaagctgattcggagcatattgatatccaggaggacctgacatatgtggagaagccggttcgtatacttgataccagcgaaagaagaaccagaaacaaggtcaccaggttttgccgagttcagtggagtcaccattcagaggaggaagcaacctgggaaagggaagatgagttgaaagccgcccatccgcacctcttcgccagctcctccgaatctcagggccgagattccgtttaaggggggtaggtttgccacaccct

SEQ ID NO: 39685 - DNA, 1043 bp, Oryza sativa
ttctccttcctcccctgtcacaccctgaagtttcccccattttcttgctttaaaaattggttaaataaattgcccgaagaaattatcttaattaacctagagctaaatccctagttaataaatgcaattaataatcagaaatagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccacgctcggcctccttcctttgggccggcccgttcccctttcccctctctccgggacgctgacaggtggggcccacctgtcaggtcgtccccttcctccagccgctcgccccacgacggcaaccgccgccgaaaccgtccgcgccgccgccttctccgctccacgccgcgcccccactccgcgtccccacgtcgccgccctccccgccattcccgcccgcccgcacgcacgcccgcaaatgggcgggattcaatttgaatcccccccactctctctctctctccccccacgtcgtcggccaaatcggggggtttcccggccatgtccacccctctcgagcccctataaagcttccccgcatctccctctcccttttccccctttcgccgcgctctcccgtgcctcctaccgccgccgcgccgctcgacactagcgccgccgcttgctgccacctccggtcgcgcgccgcagccgctagagccgccgccgcgccaagccgccgccgcctttagcattgccgccgcgtgagccacctcggccgccgctcggtttccgctaaaccccaccggaacccggttctcctcgcacaccggtgccgccgccgcccgtccgcccctcctcatcgccaggtcgttgccgccaccttcatcctccgctccggccgccatactcgccggtgaggatcccccctcctccctctt

SEQ ID NO: 39686 - DNA, 4080 bp, Oryza sativa
tttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttataccatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttaccaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactatgggcatagctttagattggtgccaccgcaagggtgtcagttaattaaaatattctgaatggcgggctatgagtgcatggttttgctggtcgcacccatggcagttaaggaccggttcacgggaaaccctgggagacttaccgtgcttaccacaagcgggagtcggtaactgcttgatctgaagtatagctcgaccctttcctaggcaccggtggcgagggtgggcgtgatggagttgggtcggccgaggtgttcggttgtccagttgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaaccactgctttgaaatgcctgctttatgcaaaagaacccctagcttccttcggttatatcatgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacatcccctcccctccgctgggccggccgaaggccaaggcccagctaggccggccgcctccctcctcccacccgggacgccgacaggtgggccccacctgtcgggcccgtctcctacctcgcgcccgcgccgccgcgcccgcaatcgccgccgcgcccacgcctccgcctcctccgggccacgtcggccacacccgcgcgtgcgccgcacctcccacgcccacttccccctctctctcgtccgctcccgtgcccgagatggccgggattcgattttcgaatcccgcctctcctctcccactccccgcgttggccggcggaatctcgcccctaccggccacgtccgggactcccctcccctatttaagcttccccgtcgccccctctcactttttccccatttcgccgaactccctcgtgccccccatcgctcccgcgccgtgcaaccacccgccgccgccgcttccgttactccggttgccgctagccgccgctagggtcgccgccgcaccgcgccgtcaccgccgtcgggttcgcgaggccaaactccacctcgtccgccccttccccgtcgggattcgtcgccggaattcacatcccctcgcgctccggtgagttctacctctaccgccgccttcggccatggatgccggccgccgtggttcatctccctctctctaatctctctctcttccttccttagggcaccccgaagcccgtccgccggttgccgtcgtcctcccgtggctcgccgtcgccgttcgccgtcgtcttcctccgcgccggccaccctcggtgaggcgtcctctcccctctactcccctccctctccctcctagtaccgcgccgccgcttcaagtcatgcgccgtcgccttcggccgccgccgccgcctcccgtgccgccggtcgccgtcgccgctagccctggccggccggccggctttgatgccgagccgagcccggcggccgcctctatcgccaccgcccgatcggctcggggccgatctgggccgtcggtcccgtggactggcggtggaccacccacgtggtcccggtccacggtggaccggccccccctttgagccgctgaccagtgggacccgcctgtcggcgccgcccccctgatgacgtcagccctgggagttattgcgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagtctgtttgcaatgtttgccttgtatgtcgctagattccggttcttccgacgctccgatgtacttcgaaatagtcgccgaggttcctccagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccttgctcctttgttagctcgggttataacatgaatagacgttagactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgatgcatccaggcaagggtgggcgtgatggagtttggatgggccctgcgacggcctatgcggcttccggattcacctaggcatgagaggggattgcccgtcgcccgctggggatgggggtgaaacctgaggtgtggtgtgattggctagagagggttatgcgaagggtcctgtcacggcctctttccggtgtgtcgtggtggcatgtcggcgcacgaaaacgtgttgtggggctgtgtcttgtgggtacagttgtacacctctgatcagagtaaaactattcgaatagccatgcccgcggttatgggcggttaaccagattcaccgtgattagtctcaccctagtttagtcttttgaaattggatagtataggtggatggttgggcctgtcgcaacgtggtatagcgttggatggtggatgattaatattgattaattattacgactgttttcttctttaaatttctgtttataaatgctcgctttatgcaaatgaaccaccctagctctcctttgataattccctgcatcatacccctattccggtatgacttgctgagtacagtggatagtactcagtcttgctctatttttcccaaccccagcgtacgag

SEQ ID NO: 39687 - DNA, 2703 bp, Oryza sativa
cccccctcccccctcccccccgattcgcccaccatcttcatctccacctcccgctcaggctcggagagaagcgcccgcagcggcagcagtagaggaggtcgtcgcacggggggaggtgagtgcctaagtggagcgtcgaagcggatcgaggaggaggaggggcgagcttgggaggggaggagaacggacagactgagggagatggggaagagaacataccggttgctctgtgggtggatacgtggattaggaggatgctgctctggtggatggataaggacgacgggttgcaaagcactgtagcaaaagtattgtaccttaaaataatattcagggtaatgtatggagtatggagaacgctgtagcgattgatcgatctggaccattgatgaaaatgcatgcagattgtgtttagttttctttaaacttctaaaaattccgtcacatcaaatatttgatacatgtatagagcattaaatgtgaatgaaaaaaaccaattgcacattttgcatttaattgcgagactaatcttttgaggctaattacgtcatgatttgataatgtggtgctataataaatatttgctataataacggattaattaggtttaatagattcgtctcgcagtttacaggcggaatctgtaatttgttttgttattaatctacgtttgatacttcaagtggtgtgtgtccgtatacttagattgttttttaaaaagaacaaaaacacggccgcagtcgtcaggagcagttgcaattagagctgcacccaatctgaatcctcgcttaagctgcatattgcagctgttaggcattcacagtgcacagatgtcgcgttctgtcccaagcaaccacgttgaagattcatcgccacgcacacgcccgttgttcccaactgaaaaccacggagccaaatgaagctacacgttctttgttagaatttggcaggcatggggcgaagcacggggcaagcgacgcattgggagggggcgtggccccgcgcgacgcccctacacccgtgcaacggcagaagcggcagcatagggagaagaagagaagatggtacggcggtggcctagggcggagaagggaagatgttgacggcggaggaagaggcggcgacagatccagcacctaacctcattgtcatcgtcgttccgtgctgcctcgaagcgtagcagtgacaaatcatccatgtcgccagaactcccgttgcgccgtctgtcatggacgcaccgccgagccctgccgccccccgttcacgcgccgtccgccggtcggaggaggaggagaggtggactcccacccaccgcttgggccacaacaccgccgctccactccactcgctgttggtcgaaggagaggtggactcctgggcaccgcttgggccacgccgctagagctccgctccgctcgttgctggttggaggaggagaggtggattcctgttgccgcttgggccgctctatgctgctcaccgtctgtcgtaggagaaggaggagagatggagccccacccaccaccaatgccgcttaggccgcgttgccgccgctccgctccgcttggccatctcccttccactcgccttgctttctcatgtgagtcgacatatgattttggaaaccagatcgcacgcttgcaacacgagagttgacagcttaagaaagcacgcgtcaccactatgagattgagtaaatatgcaaaagtaatcttatctgtcatgattatcattagttttatgataaacttacctattttaaatatagattttttttgttaatcatacaaatttatgtccatctattcttacgtgaaagtaacctaatgcattcacggtttgttcctcccatggtacaatcgttacgctagcgtgttagaaacatcgttcatatcatacacgtacacgtggaataattgtccaaacaaaaagaaaaccgttgtgattattattgtcatattagaccgcttaaaaaatcattcagttaaacattatccaacgcggcattacccggtgcaacgtacggacattttgctaatgtgtgtatatatatatatatacactaatataaataggaggagttttgccttccaatcctaccggtgaaatcaaatccaacgacccgtgatcatctaccttacaatccaatggctcaaatcactccccaacgtcccacgcggccacgcaacgatccccttttagtttctgcgctctctccctctgaatcccctgatcccccgatcccatcccctttcccttgcgaaccctagcctcttcctctcaagcgccgccgcagtcgtgttgcctcccgatcattcgccgccagatcaccgtctttgctgtcctcttaggtgcagccgctacgcacacccacggtgcgcacttcctttccccggttccccagcccagtgctgtccccctcccttcaccgtgcaaaaccctaagcgccgccaccacaagcaggtaccgttgccgccaggagatcgccctcatgtcacctcgcttcgccagatcatcgacgcaccgcctcgccgtaccggtcggcgtcgactccgcacacgcttcaggtctaccacgataactctttctaggtagtcccagcatattgaaggtagtaccattatgaactttctcatgccatggctaactatcggcctatcattgtagcattatatatatctatatgtgttggggctgcaggaa

SEQ ID NO: 39688 - DNA, 10736 bp, Oryza sativa
tccacctgtgcaaaatttccaaatcctgatggtcaattggttaccatgcactatatatgaatcgatatggaatgatgcatgctttattgttgcagttaatttcaacagagtaaaacggaaggagcgatggattctctacgccttgcaagtgcaatatgaaatgctggggatacgacatttcagattcatgcttcaagtgatcaccatatgctgataagctgagagtatgctcaaatgctcagccagaccttctcttagaggtaattcaatcatggatactttctatttttctctgcaagttcacttgcaatatattagtaagaaaattatatatattgcaaagtataggagccattgtcatttttgttatatatggcttccatcacccccattgattactggccaagacatggtatatgttttttccatgtagattgagagggaaaatatattatgactcatgatgttttaaggtccgaattaacatttcaaattatactgtggcttctgactctgtagatcaaaattattgcagttgcattatgccattagatgatttcagaaattcctgaacattgcataattcactcaattgacttaacgttgcctctgctttagcttgtccatgccatgctttgtttggatagttccaaagatatatttgctattgatcagaatcaaaataaaactcacaaagtttagagcttgtgtgatatatgggagtcctctgtttatatctcttgagtgttcactctgatataatcatgcaaattggagggtatgtgtgtaagcgccagtttgattattgtatttacccaaaaataatgattgttgtatatttgcatattaggttgtgcaatgcatactctttgagatgttgcactgcaactgcacaaatcttgatctttttttgtgcctgtattttcaccaggtttcacttgatgaggaaatgagtttatagatgtgtagagaatctgaaaaagatatttgggaagagatggtaggtgcatttcagacaatggcaaggagccaaggaggtaatttctgttgtgcgttatgaattagaattagcgatctaatctgtactgcacgttttccatttcttgatgagaatgtgatcaaaacgactttattggaaataccaggttcagaggttgcttaacttgatgaacctattggaaagggtgacaaagatttcgacaggtttttacttgttttgagcttaatccatatgggaactgttacagtaaactgaaattcacatttgtaattcacatgtaaaccattgacatgacagtgaaaccactggccattttgctggtatagtgatattagggccatacatgaattatagttcagtctttttttataaactttggtgatgaagttcagatctcttcctgttactgtattgaagctgcaatcatttcaaaaatttcggaactcaattctttttctgatggtagcagtatacatgtcattttgctggttttttttctttttttcttttttgctttaaggggatcagggcaggacagaaagaacactatgaccatgtccccatggcccatgtccatgtacgcatcaagctcccaagtgataatctgattgcctgctctgatcctaggcgccggcggaatcaaccttgacccatcaatgatggtcatcccccattgacgatcacatggtccacagagatcatggtgtcttggacaccaccattatttctgacggtttaagctttgtctccacaattttttatctctgtttttgcttctgatggtttatacttcagagtttggaactgaatgctcatactctagatgaattggtcatgtacttgaaattttgcacatttggtactgaatctgcactcaaagtgggtttcttgatttggttaggtacattgtataagctaggttcgcattttgtacaattgattaaataatatggtttgtctatttgcgtagcttcacgctattctgtctgtaaatctacagagcaatatatttgattgaatttagcttagccttttcgtgcattgcacgtgcattgttactggccatccatggaattaaatgtgttgtagaaactggcaagtgtcaattcagagtgaccatttaggattccatggtgtgcatgctttcttgtggcatactggtcttaggagttcaaatagagttttagtgcatagattaaagtgagataaaagtttatgcctgaatatataatttggtcatcttaattcattttcaggaatgttaatatgtatttatgtttccttttttctcaaaaaataaaacccaccgcagagaatgtatggagcataaatatgttctttctaacagaagttttgagtacttaattttgtgcagctttcttaaactagctagccctagaatgatcctgtttgttgaattggctgtaaagatggagggtatctaggtaaaaccgtaaaagatagacaatttatcaaatgcatcgtctactctgattgtatattcgtaaactattgtcctttctagggagtaatttgggtaaattcagctgagggaataggaaaattctccttttccttcaaattattgtgttttacggcaatgagaaaataagatcaattgtattctcctgtaaggaattaatttgttcttctgtaagaaaagaatgctctgatagttattctctttactacttactgtatcacttctagctgacaatcatttaaatttagatcacaaatgtttgtttacggaagtagcagcagtgcaatgtatgaattttaggtggcaatttcgtaccttttgcgaatatttttttttacctttgctggtcagaaaattgtaattgaacacaaggtttttatagatatcactgaccaaattgtcatcttaggataacctataaaattttgttctccattcgtaattgtttgttagttatatattgtcaacatgtgccttgcacgtgaatgataactagtacttcgataatatatcacattttcaattaattttttacttttcaaacaaatacgagccattagacgtaaaattaaatagtgccaacagtcaatattaaaaggcaaccaagtttggatgaagaaagttattaaaagcaaaggttactgctaaatctccgtattggcaaaaaagggctgtgattcgtgacagactgatagataaagacaacaaacatgcagtgatatgtgcagagcatctggaataggagtgaaatttactccaccaagaatctttggagtttttcaagaacaagaatcaaacctagatgaccatgcaaattcatccagcaaactttttccttgcggttcatccaggtttaagttttatacttgatgtgaatgcttgtatttatggataacttttttagtggtaggcgatgtacccatttacaacgagatgtctgatgattttgtctatctcaagatatatcgaatcagctttttggaagtacttgtatatgtagggtttgcatgtgtattcatatgagtgagtatgtgcgtattaattatgaacacttgcatgtatgctgcggttcgaaaaaaaaacaatcacactctggaaaaccattaatttatttattttccgctgccgggagctcctcaccgtgacggcgtcatgacctgagcgagctcctcctttatctgtgtgcgcctgaccactcttcgagcacctgcgagcaaggcgcctaccagtcaaacactgttcaacttggcgcactgattgttcatgattgatgcagtgatccgggcagtgcgtattgacaggcaaagaacgtgctcccagataaagaattcatgtctaccaatatgatgcaaaatagtccagcagtcagtcgatgacatactatattgaattgcttagttttatactccatttcagttccgaggtgaagaagatgacaactccgatcagatctatcccagaacattgcttggtcgttttacttgcaagtgactcaacgaatgcatcgtgcggggcattttattaggctccgggttccggaattttcgataacgacgaggcaatcaaatgtatagtaatcccttcgtcccaagcaatttagaactggatgcaatatatattaatacaacgaatttagttatagccactgtctatatttattgtattgggatagatgtgtgtaaattcgttgtgttttatctagttctaggtttaggttattatgtattgcgacggagtactttgtaacataaagtcgcaacgcagagaggagttcatgattcggtagagaaacctgcaccgctgcacgcaccacggcaccaaccaatcaaccatggtcggctgcgtccacacctcgagtccccgactaccagccagcgtcaacgattttctaaactattcgcaagaagctggatcactttgcaaaacattgtatcgcaaaaaagggtctttatgggaacgtgatcctaaaaggggtctttatggaaaaatacggagtaaaaatacttaaaacagggatgtttctgcaaaagttccattatatgggccgtgtagcactgagaaaggatgggcttttcttgggcttaatgggctgcacatacttccaccgagaccgactccgtttcctcttcgcgtctccttcctcaccggcgaccatggccgccgccgctgccaccggcacaccgcgatggagctcctcctcttcttcgttcaatgcatttgcgtcaaggtcagtagcatcccctcccattcccttgaacccttgtcttctcctcgaccttcaagtcgcgtagcgccgtaaccagtaaccacccctcctctttgctccaatccaggaccccaccgccatcagagacctgcgctcttgtaatcctgtccctcttgggtctccaacccgctcacctatctccgccaccacgctccagtactgaggtataagttccaatccccccccaaacttgcaagaaaaaactgaatccggattgcttttgcttgcacattgcgatttggagagcgaacaagttatgccatatgttcaatttaaattggatgcatcattctatatggttacaaacttgctacgagttggcagatcgaatgcatgatggaagcttatgattagatctagaaacttgcacgcaccaaccacccttcaatagaaggatttaccctctttctagaaaagtggacaacattgcgtaaattccacatcacaacactataaacaaagggccttgttgtccagatacatatggataagtaagtgccagctctaaccccaaacatgtacacatttctaagcatcaatgcactaaacaaagggctttgatgtcaactttgaatgagccagaactgcccaaagaaaacctgcatcctgccaatacagcagcatatggaggtcatttggagcttaggagtacagaaaaacatcagaagcctgtgagcctgtgactaatgagatcactgggttgagtatacgtttcatggatagacagttgctcatctagctagtactgcttcaacctaaccaaactgcagtctgacatatgaaaaacgcatgttatttgaaaaccacaactgccgtctgacatatgaaaaacgcatgttatttgaagaccaggacgggcactcaaattgttgtacgtaatagaaacctgtatgattgggatgtgttaccaatgtctatacagctggcattctgagtaggatgtcactggtcacctaaactgtgcaaacatctgaagagcctgagatgagatctgggcatggatcaagctgaattggccacggttctcattcaatccccaaattgtgccacaatgacacctaggaagataaaatggtagacgcaaaagcacacaaaaatggaggtggaaaaagaactgaaagtgtcacacttctcacttggagagtctttgatctagtaatgcctaactcactaatccagagaggctgctctggagcagatcccaattgtatagagaggggtggcaacatggaagaaagaaagaaaaaggaaaacttctcaaaccctatacagttatctagtagaaacatgtaggagatctcaccactcaccatgcattgcaggagaaggatttcttcagcatgtgggcatcacgggaagtgatcaaaacaggatgaaatccccatacgcgcatcgcagatgcagccggcacattgatcatttgatctccaccggaagaacacacaaaagtttcttgtcatgtttccctgtcaaaagaaccaccttggttgcctcacattggaagaacggagtcctttcctctgccactcctgctgctgaagcatgatctcccggccggcgccaatctcttcatattcgcgccgtccggcaatgcccggccactgcggccgccgccgtccttgctgtgctccccgtgacaccgtcttgaggaccccgaagagcctgccaggaggccgctctccctggccaccatcagctcgtcttccaggctcgcctgcaggacatcggcaatggacatccggccttcacggtgcgtgtctgacaacgacgacggcgcccttgtgggcggcatcaaggcgccgtcttctctgatctcagctgtgccatttgcatcttccgacctccccggaccatccttcgcctcgtggttgcggccgccgttgccgacggcgacaccggtcaccacgttctgtggctcctcgcgcacatgctccgggttgtcaattgtcaggaccagctcgtggttgtctctcctatcctcccgtggaacgcgggcctccggctccggcgagaccatcccgacggtgacgaacgcgatgttgcagcggcagagcgggcagttggagtgggacttgagccaggtgtcgatgcacgggacgtggaaggcgtggctgcacttgggcagcagccggaggctctcgccttcgcggaactcgccgaggcagacggagcagtccgtgctgtccacgaagccgtcgccgcgcctgtacttgcacactgtgatcttgttgatcagcgtctcgtccatcccgtccgacagcgcgacgctccacggctcctggctcctggaattgtctccgccgtcggcgccgccgccgctgccgcggtgagcgctggagccaaggagtctgttccggagggagctgaaggtgccgcagtacttggatatgatggtgtagtagctgacgaggaggaaggcgctcgcgagcaccccgatgatggcgatgacgagcggcgagaaggttgggccggaggagtcgtcggagctggagccggtgatgtcgaaggccggcggcggtggcgggaagatgaagtagcaccactgcgggcagtacatgctgcagaggccctgggagcaatccctggttggctcatagggcacccatgtaggctgcgaaccgagatttggtgttgtagggggagaagaggccattgccgccatggatacacaagcacagcagcaacactagaggtctaaaggggagagtctaaagggatgaaggtgacaaagaagaaatcccaataaacaaagatgaacaaatctttactgctcaggccatacccagactgccatgttctagcaccggcagaggatcttcatgaatttccggtccaataattgtggcaagagatgagagaagcaagagaaggtaggtggctctgcttggacttcagtacaacccagttctttcgtggccctgggaaatgtgagatgagatgggaagagagcagcagccgtgaagaatcagagatcatgagatgagatgctgccacaccagctgctgctactaagagaaacgagagctaatctccaaagcagagagggagtgtgcttgcttggaaagcaaagcattttgggataggagagcctgaatgcttgatgaggaggagggaggtggcggtggttgggaattggggccttctttgcctttggtgccattgccaccactgctcctgctctctcgtccactaccccttttcttttcatttccctctgccggcgctgttatttcttttcctttgcctcgtttgtcccctttggaatataagaaaataaagtggatgtttggctgggataaagtaataaaaatatggagtgatgctggtacaaaaatgcagtgtgactgtgttccaaaatcccaagactaaacagtgaagggaataagaccattttggaaattgcttagatcgtcgaagaaactcagcaaccaagggtgtgtttagttctttgggtgtaaagtttttgaagtatacggacacacatttgaagtattaaatgtaaactaataacaaaataaattatagattccgcctgtaaactgtgacacgaatttattaagcctaattaattcgtcattagcaaatgtttactgtagcatcacattgtcaaatcatggcgtaattatgctcaaaagattcgtctcgcaatttacatacaaactgtgcaattgtttttttccccacgtttaatgccccatgcacgtgtccaaacatttgatgtgacgttttttgccaaattttttgggatctaaacaaggcccaagactattttagttccaaggtttttttagtccatggtgcactgacgatttcgttcaagttggttgtccactagtcaaaatgaaccgactaaagtgggaacccgagaatacggtctccgtcacgaaaaaaccaacttctgaatatgaacttagacggatacttgtccaaattcgtctttagaagttagttttttttttacggagatttacctcttcatatggcttgcacaataattattctacatcataagatgacatatagagtaatgctctacgtctagtttgaatgtcaatgtagtaaatattaaggggtcggtcattaaaaaaaagtaattttcttgttcctgtgaggtaaaatacatgcgacgaattatctaaaattccaaggtttagaattttccattacctgagagagtatatacggagtatatcttaacatttttgtctcccaatatcagtaggaaaacattaaatttagcttactcccaagagttattttcataaaggaaaggtatgaaagaatgcagtatgtttagtcctcctatcaacgactatatatgcacattagcgcatatctgagaatcttgagtcactctcacatcattcagctaaaatttctctggcttcaagtaagttaaaagacaacggcggccggtctaccaaaccggtcaccactcaccagcttctttctttacatttacttcttcttagacacttaatccttccttctgtcaactcaagtcattaatgtctttgcactggtacaactacacaatagcctggtcacctaatcacacttcctcttgagtaccatatacgaccatcatataccttgcttaattcagacaaagctcgcgactatagattttatttattttctgagtgcagttgataaaatggactgcattgctgtaggttgtattgcattagcactagaggcaactgtttttactcttggtaggaatcgaagtactttcagaataagagaaagaaaaaaaaagaaaaaaccttcgagattttatactggaaggcaggacaaagattcatgagcatatcaagttggcttgcgacgaaaaaataatttaatctgatggaccagatagtgaaggccgatctgttctaataggtgtgattccttttagttttggggcataaatacgtcgttgtcgtacaatggggtcggcattcggccatgtgtgacagcaacaaggtgtgtgcagttgacgatgggaaaaataagtggggaacatgcggtccaagggagctctgcagttccattcatttgaaaggtgaagaccacctaattgctgtcctctttgttggtaaaaatcggaggattaccaaatgactgtcggtgtttttatacgtactgggaataatatcttcagcaacaaacaatatgaatcaagtgaactgacaaagaaaacatatattcaactgcattggagaaatttaaaggggaacagagtaaattcatagcaggtggtttagggctttaggctaatatcatcaaaggtattatcatcatgtggaaacaacgagtgtacaactttgtagtaccacctaaaagttaatctgttggctgctcctccgattccctccatacccttttcttctttgatacctttctacaagccgaatttagttcgaagttgtcaagatttacagagatgccatgttctaatgcgggtgtgaaccatcatgagacaaaataacagaatagagcaactttaactgaactgaggctccgacggaacgaaagtagtatccaagattgatgagtgctatttcctttatattttcttatagacgaattgcgcaagtagaatcacatcacaactttcctatcccctttttgctatttctctatttcttttcatctggatacgtgtaagaaagcagattaatggaagaagatttgttggagaagaaagatgtagttagaattttggaccacaagaacatgaggcatggggtcatcctgtcttccttttctaaaagaatcagtaccactcttaccttgctaattacatagtaaagcaaaaaaaacacttgctgacatgtggatttactgaaagaaaacggcagcagagtagattaacctcatggaattcatcttggtagcaaagcttttctgctttgcattaatctggtccaccctggctcattacagtttgagggagcggccgctttacgttttgtaccagtgaacagtactgcagattt

SEQ ID NO: 39689 - DNA, 4411 bp, Oryza sativa
gtcatagggatactatttagggtttttcttctttagatgtctccaacaatactgtactacggcctatgggctatggccgtggatgaggaatacttctctgatcaattttttttgggtctgtatcaaaccaatgcttcagttccagtgttgctgtccataattcataccctgtccactgattattaagtactctcattagcacgaatctaaatcaagaatatatgaatgtaatgatgcaacagatgatttcgctcttcaatagcatctcaaagttgttgggaactaatttatggcttccaaagaaagaacaaaaacacaatctatggtacatctgatccaaagaaattaatacaactgaaccttgagtgatagactgttttctttcagaagacgatggtgtggaccgatctcaatggtttacaactttacataggatatgtcaatagcatcatggtaccgtaaggatgaaaaatagtgatcggatctacgacatgtggtatagttatatcaaagctttgctggaaaagcatggacgaggggtaactaaaattcagactttcctttgctttgatgagctgtaaaaggatggatccacttgctggacctcactttacatgataaaataaagctgggcactatgtaaagagagaaatgtggagctacatggcacatattatgccaatgcagaaactgctgggctcttctaaattatacactgtttgaaagcgaaatgagatcatgtaaatgatgttaccatgtagcagaagactggtggtgagtgtcagctaggaaatgcagatggtttgtcagaacatagacaatagtagcataaaaagatgtggcagtatgcatgaagcaaaggtccaataattacagtgaattggttgtaactagagaaatagacactgagactggattcgatgcaaacaaaggtaaagctgcaaaaagaagatcacacacacttgagttgggttatcctttcttgggcttatcggtgaagaaactgagttctgaatatcaggttggctacatcatttgcattctgcaagcacggcaatgttcctagcgcgaattacgtgtacttgggagtagtagttaacagtagttacatgggagcgttatttccacaaacactaactacgagaaagttattataccggcaaatggaggcataaatttgttgataagttgataacaaaggagcctatccttcagctgtctagtaaacattatcaggacacgtcaacaatacgctagtagcaaagctgagcaagttgtcaccccggcaaccataagcttaaagtcgttaggaacaaaagctaaaaataagtcctttaactatagagcataatcaagccacatggaagttgtgcttctggtgaagccgggcatattctgctctaaccgacaacgcgaaagaatacctctttggatggcaatatcaaaagttgctcgttgtaggacctcgtgtgtaaggaagataaacgcatgcacgcgtcgcgcagattttgttgttttattggtcaggtgatgctcgcgcttgcgccacatgtttggcaggcaagttcagcgaactgtcgaattctgaaacaatcagggcagctgcccgacggcatccatgatccatccatctgaactaataaatcaggcacacaccaccattggccggagacccggagtcccgtcctcatgccggcatcggaaatgaacgaggagaagcacaaaactcagatcgcaccgtgcgtgaagccttgggagttgggagtcagcggcgcacggcgctcggcgctccacccgcaggaggaggccgtgcgaaggaggtttgcttctcggtgcgcacggccacggagcgtaaaaagtggcgtccgtgccgccgcccgctcacgtgcactcgcgaccccgcgggcggctggcggctggctctgctcggcgtctttgcgccttgtcatactaggccgagtggaccgagtccacctccgagacgcgagcagcaaatggcccacggtttactcgggcccaaccgagaaatcctcggcaaaaatcctaggccgaaaggtgaggccccgtgaaatcaccaaacctgtcacctcaaatcgtcaatcgaaggaataagatcactgtaggttccttaatatgtcgttcagtctgatttttatcctcagtttgaaaaatgggatatgatacatccctcaacttataaaatcatataaacaagatccatcagcagtattgatcatagttttagctgatgggctcctacatggtgacgcctatgtggctcctttgactaggtcttcgtcccacgtggcattgacgtggcgcttacgcgacaattcgattacgacacacgtgggacccacatgttagttacacaaaaaaatggtggggcctatatggcccaacatgtcatctccctactccctcttctctctatatgaggacggagcaaccatctcctcgcaggcctcacgggactccccgcctcctcctgccttgcccccgttgccggcgggggaaaggagcggcgcgcggcaggtcgttgtggagcggcggagggccacatcggagctgaggggcagagcagtggcgggctgcaggtggctcttctcctcccactggccggtgccccgcaccgctccgcccggaaccgcgacttctctcccgcttggctctaccgttcctctcccgcctcgacgaggtggacgaccgcgacgatgtccttcttatccgctcgccccactccgcccgcggcccgtcgccactctgaccacccgctggccgctccgcccctctgctctgctcacgacccgccgccatgcgccgctcctttccccgccggcgataggggcgaggcagggagtccggcgaggccggcaaggaggtggctgatccgcccgcttccgcccctctgctccgggcgtatatagaggagaagagggagtagagagatgacatgtgggtcccacgtgtgttattattttttgtaaccgaattgtcacgtaagcgccacatcaatgccacgtgggatgcagacctagtcaaaggagctacataggcgccacatcaactaaaaccatggtcaacactgccgagggaatttgttcgcatgattttgtaagttgggaatgtgtcatatcggttttccgaactaaggacgaaaatcaaactagacgacaaattgagggacctagagtgaacttattcttcaatcgaatgacaggcccgtatttgggccgaaaggagaggcccggtgacacaactgcctggttgccctaccatagtctattcagtattccgtctgtctgcactctgcaggagttcatcaaaaaaaaaaaaaaaagagccgctaatgttccatcaaaaaggaaatctgttcacgcggtacttgagacatgaatgcatatggctaattggccggcatgcggcatcaattcgaagagacgctttgcagtttgaatggtgagcactgagcacggttgggaagtggatggtcaggaggatacgaagccctcttcaagacggaacagagtacggtgttaatgcagaaactctcaggtcagcctgctcttttaggtacttacggaattgtgctggttccagcatctcttagcgcaaacccgtgatggtggttgattgatttcgagcctaattctgttattctgtggggacctgattgttgtgtttgtctttgccgatatttgtagaagggaactttctgcaacttgcattttgcaatcctggggccttgtttggcttaatcccctgtgtagttgtcttttgtcgaaatcgatgatcaaacgaatcagagaaacaaaagaaaactctaagttagacttgctgggtaaagtctttcactgatttccttgaatgcctcttaaaatgcgagggtttggttccaacaagaagacctcttaggatgcgttctaaagagctcttttgctaggcttcttattcatttattaagagcacgcttaccaaactgctaaactatgaatatcgtgaataaagttttctttaaaaataaaaaaaatgtttttaaatttataatagttattaatactctgtacagattcatagtattaggatatgtcacattcatccaaaatctcttactccctccattccaaaatataaggcacaactacccttaacccaaagaccaagaaacaattattatcatctcctagtttaaatcaccctaataaatataatgcatgcatccaataaattctgatatatatatatatatatatatatatatatatatatatatatatatatatatatatatatatatatatatatatatatatatatatatatatataaaaaaaccgcacccaatccgtggtaaccgcggagaccgagaaaaaccgcacgagaccgcgcagaatttataaaaaattcaaat

SEQ ID NO: 39690 - DNA, 11712 bp, Oryza sativa
  unsure (1)..(11712): unsure at all n locations
tcaagcacatgatgcatgtaattattgagtgaatacccagataatagatcctgcgtccccaggtgccattgtatccttaaggtcaccattggatctagttgcaccgaccttaatggtatcaggctagtttgatgaaggacgaagggaaaagtgagggaagcagtaaagcaccaccctccctaaacattgctggtgcacactgagtcactgactggtcgtggttgactctatactgtggggcaccaggcaagcaacaagattgaaactaactggacggtatttggcagattgggcgatcagcggctatgggcaaagagtttaaggaggggagcatgatccctcatctacatcgtgctttgatggtcgacatgctttttgaactccacatgtgtctccgttgctaagaaagaagaggacactactagaaaaatgtttttttcaggctgccaaaaatgattttttccggcgggggaacgatccatttgtatgccgatgattttcgcagggcgacccagtcacccgcctgtgaaaatcatctcgacgaacaaaaaaaatatcgccaccaccccacccgcgcccctaccaatctccggctgatctagggttaggggaactgccgccgccgccgccgccgccctcccccagcctcactccggccggatctgggagggaggggaactgtcgccaccgccaccaccctcccccggcctccctccggccggatctgggagggaggggaggggaaccgcgccgaccccgccgcctcgctgttgccgtcgtcgacctcgcgcctcgccgtcgccgacccgccgcctccacgcgtttctaccgcccctgttgctggtcgctgagggagctgagggagaggagaggagagctgagaggagaggtgaggtgagacttagaaaaaatcgcggtgccatgtcgtgtctatttatatccatgccaatttccgcaggcggatcacataagaggtccgcttgcaaaagtaaagggtatttttgcatgcttacttttgcaggcgggcgcctgcgaaaaccggacaacgaatttcaaccaggtttgcattttttgtaggcggccatttcgctccgagggtaatgtctgcctgggaaaaaataccccatgtctgcaaaaatgttttttctagtagagggagacattagattttaaaccactagatgataaatttagggattaaaaatgcacttttagactttatcaacctagctgatagccgattgtaattttgacatcaaccagcatattttattctttgtgtttttcttttgaacaatataattaatcaaacaggaactaactatatatccctccaggcagagggtaatatgtatgcattatcgtcacaagacaaaattaagctataaccactaacaagatagggtcatgacctatggcgtactattattcatatctatctacatgatgcatcggctgcgatgatctcatcaattgaacccacccagttatacctcagccaaagggataaaatcgctccaaaaaacttggcaaggaaagccataagccccctgcgttcgcgaaagccataagcccccacccccaacttcttgcaacggaacatgcaagtacgatgcatctctgtcgctttcgttatctcgagcaaacgagacatacacgccgcgagtaatccaaatccaggatgggcaatggcatcgcgcgcgatgcaattgcaatgcacagtcacgattcacttcacccaaaagtcacgcgagaaacctaacccctacgcaaggtgaaagccggcgaatccacggcgactcgcactggccgtccgatgctgaaacggcccaccactcggcgctacgcatcacggtccatccactccagtcccgcagccctggtggcccacagggtcgggcccacgtgacggcgaggtcggtctaatccaacaggtccatgtcacggcggtgactaatcgatcaaagttagggagcaaatgacacaagggagaggattaaaaaactccaatagagagaaaagaaagtcatgggtggcatgggggcgttggatggtgggtggcaacgtcagggtggccatggcacacgctggtggaggcgttttccgtcacaatattccagcctccgatcgacgacagggcacactcgcgcgcacgaaatgctgtcgattgccgaatcgcaccggacggactggttgagcacttgtttgatctgccgggttggacaggaagcgagcagtccccccttgcaagttgcaacgacatatcaagatatcactgcatcgaccgagagcttcggtgagaaaaaaatcgcagcgaggtgcctagtgggaactcagctttgccgcgcgataaatgcgcgacgtcgattgggggggaggaacggcttcttctggacggacgggaacggctgcaccggtgcaaggaaaaaaagcagagttgggcggaggtagccgtcgccgtcgagggcggccgctttcggggacaaatggcgggtcaatcaagttaggcggcgtcgcacggcacggcacggctcagcatcggcgtccacgacggttggccgagggccgagtcgtgccaccgtatatgcccagtgactcaccgctccagcctccagaagataccgaccccctccgcgcggcatctttcacgcgcgcccgagaagtccaaacacgtgccgccctcccgtcctcccgggcgcccgtgtgaccccctcgtgcaccggcatttcaccgagcaaccacctcaccgtatcagcagcggccacggcgagcagcctcttcatgccgcgtctgtgctggggtacacctgcagaatgtcaaagacacaccgctctgcgagtgaattagtgatcgatgagtcactcgaccgaatgcagcattggaagcgatccaaccaaaaacccgtggcgattccggggtaatttggagcagcaactcttttttttttattacatgggtaatataatgcacatatgaatatcccactgtgtgactgtctcctaccccaccacaactcttgtacatctacaatatggaggttactactactgctactatatttttacacggttgcgaaacttagttgccgttaccgagtcgtaagcacccagcagtgcttggacttgactgggtactaactaggagtaactgaactgtaactaaaaccgaaactgaaaagtaacaaacaagctataatatgtatgtgacgtggcttactgctcttgcccttctccggcattacgccggccggcctccgggaagggaagcgccgggctcgccgccattccggggcacacggttattgtgtttggctatgtcatgtgtacagtacactatgttgatcaggcgcggacgcgtcgagactccctagaactcgacgatgaggctgccgaagggggaccggtgcgggacgcccttgcggcgcttgttgccggtgcggtagctggcggaggtcggcggcggggtcaacggcgtgaagctctgcacgacgctgctcttgtcgctgctgccgccgctggtgctcgtgcacgagtcctcggactcgtaccgcgcgtccttgagcgccgccctcttcttcttcttcttgccaccgtcgccgccgccgccgccgccgccgcacccgccgtgcttcttccttgggcggtatccaccggacgtacccacaatctgcagagaaaagaaaataaagacgccattgttggtgtctacgagcatgcgtcgcgccagaattgatggcgttggttggtgcgtgcgtaccttgcatccgagggagcagaagcggaaggagtcgaggaggctgcgctcgcagacctcgcaggtgttggtgacgcccttgccgggcctcggctgggggcgctcgttgaggaacaccacgcgggcgctgttgatgatgtacgtctgcacgccggtgatgtccagcaccttctgtatctccgacacccggatcacgtcgtggtacgacgacctccgtatctgctccatccacgacatggacggacaggcaacgcgtgagtctccacgatatagatcgatcgatcaagaagcacacgcattggattaacagactgacctggatggcgtggtggtcgcggtggtgggagaggcagagggagcagagcgcgccgttcatgcagtcgaggcagtacatgttgcactcgctcttgtgcgcgtcggcgtggatcctgcattgcacgaagaagctcgtcgacagcagcggcttcagccacggcggccaccgctggttctccacctcttcctcctcatacccccttcctccctgcacccccacattcaatccatcacaccccaatcaataaccaagaaacagagcaagagcaatcaatcagtcatcggcagctacttaccatgtcgcctctgttcttcagcgagaaaggggacgcatggtctatcgccattcccagtgcgaagcaatcgagagagagagaagaatgtggatggaagagacgagagaaaagagaggaagaggctcgaagcgaaagaaagcacttctgaatgtatgtagtgtgaagtcttttgtagaccaaggggggcaaaagacgaaaagtatctgcaaacaccggggttaagtaaactaatcggaggaagactcggggagagtatttgtgctcgttcttactcccaccgtctcaaaataagtacagttttacacatttgaccgttcgtcttatttgaaaattttgtatgattagtatttttattgctattagatgataaaacatagtactttatgtgtgactaaatatttttaaatttttcgcaaatttttcaaataagacggatggtctaatgttaggcatggatatccacggctgtacttattttgggacggaggtagtatcaactactcgtacatggcggatccgggccgtctcataagtcacaacccggcaagcacatatgaccgatcgaatggcagagcgtgtttccaaacagtggaatcctagcacagttcgaattgtctcctaccgcaatgtccctttcgcttgaaatttactaatcagagtgttgcattcacttgtgaaccttatcatcaacagcattatgatttactgatttctttttcgttacagtaacgattccgattgcaacttgcgacggggcgagacccaaaatccaccgtaaattgtcgtagagtaaagcagtgctatcagtttggatattttcttttcctacattttggaattatcacttgctagtgaatggatgctttctctaggagattctattgcacttgcgcatatgtttcagcttcccacatgaatggtggggaaaaaacattaggcgcacgtttctacccgaaaagtgaaaaggggaaaagttaccactaactacgccattaccaccacaaatactaatgtgcctgccacctttggcatcccacattagtcttccccaagtggatcaagagggggatcagatgcaaccttagccgtgcgtgcgtacgctgccatacactacgatatctttttggacggagcagagcacatcggcgagaagcctcgacggcctactggaatcaggatgccttttttctggtggcctactgcataatttcatttgccgttttgtaaagccatttcattttgccgttttgaaacctacaaaccggtagaaccatggcatcaataattcggcaggtgatgctacagattttctggcaatcgtagggcgttcggtttgtggtttggtcacccactcctgtaacgccatctgaaccattgtgcgtgctactgcatttcggcaattcctggctggtacttggaactgtgcacacagtcacacaccgaattgtactatatatcgattagattagcatctgagcacacgttttgtggactgttcgtccgaattttttttccaaccccagttcacctccattttcatgtgggaagaatcgtgtgtgggcccatgggatattgatgtgtgagatcatgtgaataatcagtaaccaggttaaagataaagtcagaaatacggcatattgattagtcttgcagcggttatacgtcgcatcgtctccttggagccagtcgtaatctcttagcagataatgacgaacaaattaagatttacatgttagtaagacgattacccgcagtatataatattagctgagtgggtccccaagtcgtagaaacgaacaagcaagcgttgacatgaatttttgtttcagcaatcaggtttcccatttgagttcagccagtctgctgcgatagacacagcggcgtagtacgttgcttcaacagttgaaccatcacgccgcccatgagtccatgacacatggccgtcaggttttctgttaacgattttctgcactcctggattcttggccgtccccttgattcacgggttcaagtaagcatttcgtcgagagatcgcgcataatctgcccaatgcgccaataattcagacgcagattttgacctaattatgttaccttgtacagttggccgaacttattaagacaaataaaatgagcactcctgtttctgaactgttggcagtcacctcaatccactgaatcttagtatagtgatgagcttatagaccacacacccctgatctgctttcagtgggttggcatattggcatctccagttcgggagacacctcaaaagcgagaggccagctctggcacaaaggccgaatttttcaaggcgtgccgcgtgcattgcatctcatctgctcttgatacagccattgccgcacagcgcttgtggctccagttccggagaggtgtttggataacctgactaaattttagccctatcacatcaaacactaatttagattattaaacatagactaattatacagatagaggttaatttgcgaggcgaatctattaaacctaattagtccttgatttgacaatatagtgttacggtaaatatgtactaatcatagattaattaggtttaatagatttgtctctcgaactagcctctatctatgtaattagtattgtaagtattctatatttaatattctaaattagtgacaaaagtcgggtatccaaacaccccccatattcctccggcgctaagtcattccgcaatcatctagagacaagaaaggtcttcgtcctctctctgcgtccaacccgaaggatccacctaaaaagacgagctttcatggctctaccgaattctggcacatggctgcatcagattacgttactactcctattacggacaccccgtgagagaggcaccgtgtcattgcgaagtgaaatgctgctccatttccatccccatttcgttcactagctgatcagaggctcttaacatttcggtatgtggctgtatgtgcagtgcagattctatgatatggtcatcagtttcagtactgtactgtatcgtacaggcaagggcaatcactcgatataaataggcttggaattttcaggcgttgcgtgctgctgcttcccatggcggctgccgagcaacgcggaaacggtcgcgcgaggacgacaaaaccgacgctttgttttaagcctgaaaatcattgggtggtgcaagtttatcacanatattttagtacagagtcgtaatcctagtgccggccgcattgcgttagcgtttcggcctggaggaattaaaaacaacctgggaagtggttttttctatgacatgcgcaccccgctgctgtggatggctgaggcttaaacaggcgaaccgaggtgacgggattcatgattgattgctccagaaattggtattctaccatggagttggcacctggttgacacctggattaggttggtcctgatctttggagtatctattcgttttttccctttttgggttttttaaatttattgtttttccttcctttacaggttgtaagactctttttcaatgttttgtagtgcacatttctttaatggaaatggagggtgtttgccctttgataaaaaaaaattgctgctttcttcgtggttagctgacacaatcacacaacggcgggtttgctttggttgctctcggctgcaggtaggaagaaatgaagcggatgtggtatactgatattctgagctctgccgtttgtttcagaattcatgcaacctgctgtaaacttgtgtgccgggggccttgcaggcttgcaaccacggtagatggaatgatgagtttggtcaatatttttttttcttttacaaagataacatgtcagtgatcaggtgtaaccgtgtaacacgcctaatctaaaaaagaatagagacgatacacctgatcgtgagcgatgttcacccttacggccttaccttcattaatgcctaaaaagattccgaaataagtcattcttcatgccatcggtaggctacaggttccttttatagtcgactagattcattgcagaaccaacaaacaaatctatacgacgagattgctacctggcggtcaatcgccaggggcgatcacgatcagattcggatcccctccctccacatgtttttatttttttttttcaccacattactttcctattttaataaatttatgcacctaaagtttgtacacctcaaatttacacatctaaagtttataaattaaaagtttatatatccgattcaaatttggattcaaatattttttatatatagtatttctatacatctaaagtttatagacccaaagtttataagtcaaaagtttatataccctattcaaatttgaatttgaaatgtatccgattcaaatttgaatttgaattcaaatattttttatatatagtatttctatacatctaaagtttatacacctaaagttcatagacccaaagtttataagtcaaaagtttacatgcccgattcaaatttgaatttgaattcaaatattagtttatagacccaaagtttataagttaaaagtttacatacccgtttcagttttgaatttgaattcaaatatttattgtgtaataagaagagaagaggaggagggagcgacggagcgtatagggaaggggcgggcgggtgatcacccacctattagccttaccctgtcttatatgcccatgaggcatgcccaacgcaggccataccctcggttgctatgtgggccaaagccacaaaaacgatctcatccccccaatggaagcaataccttcagatatacccttttcaaattaaagctgcacaatagattaattgcacaggtgcttcatgctacacaacgcggtgccacagcctaaacctagcctcagagcggcgcctcgcgtgagggtgcgcggagcgatcagagggttcgaacctcctcgcaggcgcgtggtcctcgccactttttggccccgcgtctgacatgtgcgcctaggggtacgctccacgtactcgcgttgggcatgccctgagttctcaaagcctcttttttcagtgttcacctctcgctaaacgctagtcggacggccacctactgactagcgactaggctgattaggtggcgactagacggattaggcgaattagacattttatctatctctttcacacaaaaatactgattctagacatttggtactcggtaaatataggcatttagacaaatatcataaatcatagttaagttcagaaatcatcaagtccatacaacgaattgacactgcacacgaagcattgggtttagtacaaatatatagggatagcgaacacatcagtatagccactgtacatgcacatcacaattcataaaccataactttatagatctgaggggctggagctaagagagaggaagaaaaaattatctagaactggaagaacagaggaggtaaggtggtggaggggagcctgatcccctgatggcctgatctagggttggcgtaggctgcttgagtggtgccgtgcttgactgcttcaatcggtgtgtttgtcaccttccattgatggcaaggatgaaggatgagatggagagcaggagcagcaaaggagggggaagaacgtggagcagcagaggaggagagggaataacgtagcggcgcggtggaaaatcgatgggcgcagcgacggagccgtctctcgtggcggtgtgaaaaaggggtaggcagggattgcgctctctctctaggctctcaaataaggcaacctaaatccccttttataccgagtcggtcccgcgtggcgcttctaaattttatcacgcccaaattttgatttctttcgcctagtcctgcctagacgcactgtcccgttgtctaattgcgcctaggcacagtcctgtccaggccgtccaggccgcctaggactgactagtaccgtctagacggtaaatcgactaattcactgcctagggtgtaaactggacaaattatcgtcgactagcgattaatcaccgtctagacatgctaggcggtcgtttaggcgaacattgcttttttcccatgtttcgccagccctggccatacatatctttttgccggttttttgctgggaataccgcgcacgtttatcattttgctggagtttaaaaaaaaaaacaggcgtcttctctaggcctcttcgacaaagccaaaagcaaatatcgcctcggtactcacacgtcctcaatccggactccacatgcgctcctgcatgctcttccttcgtgaagaaaaacaatcaattagatttctacgagtatcatctatctatctatctatctattatattattaaaacagccttaaaagaagacatcatgttcgctgtagggctataaattctcacattaatcagagaaaaagaaaagaagagtccaattagaaattcaattcaaaaatatctgaaatcggaattaaaataaagcaatattgaaagaagtgtccatataaaaacccaatacgagattaatcaaaattcaaaataaaaataaaataaaatacgaaattaggaaataaaacgagtctaaataggaatataatttaaaaataactgaaattagaaattaaaaataaggaatattgataaaagagtccatataataacccaatacgagattagttaatattcgaaataaaaataaaaataaaatctgaaaatagcaaaaataaaaggagagttcaagtaggaatacaatttaaaatcaactaaaattcagaattaaaaaaagcaatatttaaagaagaatccatataagaacccaatacgagattaattaaaattcagaataaaaaataaaataatatccaaaattagaaaaattaaaagagagtttaagtaggaatacaattttgaaacaactgaaattcaaaaatgaaaaataaaaatattaaaataacactatacggtattaaatattttttaaaaaaaattctgaaattagaaaaagaaaaagaaaaaagatttaaaatagaatacaatttataaataactaaaattggtgataaaaataaagattattaaaaaagagaccatctaaaacacacggtgagataaattaaataacaagcctataaaagagtagagtggtggcggttgattcgacatataaaaactgttagtaatacaccaaatagaatctttagaaatcccgtcaaatgctgccaatatactccttatgacccatctgccgcttaatctttattgtcattagcattttaataattgaacaaaactatcgttggaattcatattttactttcaagatgtcccaccaaccatcggtaggccgtgaagcaaacgggtaaggcggttgccgggacttttaggggctgcaggaat

SEQ ID NO: 39691 - DNA, 9648 bp, Oryza sativa
  unsure (1)..(9648): unsure at all n locations
catctttagtcccggtttttagtggaaccgagactattgtggatttcgggcgaccgaccaaagatggtttctccaccagtgtgtgtactctggttcatttttgtgccagttgtaaacgatgttggttcaaatgttcctgtcgaaaacaagatgaaatttaaagaaaacagtagtactatctatactgtgcctcatcctacatttaaagtgctgtttgtaactactactaattcacatatactaacagtactagcacttggggagtatttttcccctgaagtagctgtcgcatattctagtagctgtccctgaagtatcggtgaaaaaaaaatgagttttggtgataataatctcacaggattggcataaaacacgcaataaatgattgtcttgagccaccgtctttttggatagagcataacctgcatatggcatccaagtggttatttaagggatctgatactatgttgcctgacttgtctatcagtaacactaactttttgcgaccactccagctaatggagccagctaattcgtaaacattatactctcacaaatgctacacctagtgtttgtttgaattctaagtcatcaccgtaactggtatcgtctgagctaattaaatcatatactctaaatgaaaatgagtacacaaaggccttgtagacggcacacttaaccagttccaattcatccagatcctcactggcgtactgttcgctgctaatcagtaccaacctcttaatttcctgagcaataggtgaaaatgattgttacgattcactaaacaagaatgctgaaaacgcccttcttaagctatcattgaaggaggagtacatcgtttgattggaaaggctaagctactgtcgtagatctcgacttctctgaaatgaaccagtggagaggaacaagttgtttccatctttgcaagcatggttcttttcgtcccaactgccaactgaactgcgaaccattttctggggtctcaacatgtgaattctagtttggtctacagtaatgcaggtggggtatttgcgcaataagcatcttgcttgttctttgtacaattgtaatactattggaacatttgcacgatgtacggttgccccacacggagagatggaggatggttgctgccactggaaaaattattattccttccgttcccagaaccctccgtcttaaagacaagggatattagcttttacatggtctccaacattatacttcaaaagcttttctatattttggacaaagaaattactccctccgtttctaaatatttgtcaccgttgattttttagcacatgtttgaccattcgtcttattcaaaaacttttgtaaaatatataaaactatatgtatacatataactatatttaacaatgaattaaatgataagaaaataattaataattacttaaattttttgaataagacgaacggtcaaacatatttaaaaaagtcaacggcgtcaaatatttagaaatggagggagtactcgccaatggacactatttatatttatattacttaaagttttattgactatcttttttaaaaaaataaatacttaaaaataccgtattgttcaagtgtgttgcatcctaaccataattattattatttttatcgtagtctaaccttttttttagaagggtacaactcaggacgcacactaacacacactaggaatgtgcacgtttctaacgcacactaacacacactaggaggaaacatgcagtcccactgaacgcgcgcgcgtgtaccctatacctagtcgggaccaagcgaagtcagtccggggaaacggaaaaaacccctggtgagacacgcgatttgcgatcccaggatcaaacccgcgcgggctactcgctcacctggcgacgctagccaaccgagcaatggcgacgctagccaaccgagcaacgctcggttctccgtagtctaaccatttaaaaggtgtcgcttagctcactcctggtttggacggcccagctctctgaaaaggctgcaggactactcttgcctgtatcgtccgtacatacctcgaggcccaatataggccctttttcttaagcccagtaagcccaattccagaattccaaatcgcagtgctgcgttggaacttggaacttgaagggccgaagggggacgagcgatccagtgcgctgtcacgtgtcacgtgtgtgcttggcgctgacgagctgcgttgttcttgtgcaggtgggcaatttcatgcactacatcagccggttcctggccggcttcgccatcggcttctcgcaggtgtggcagatcagcctcgtcaccctcgccatcgtcccgctcatcgccatcgccggcggcatctacgcctacgtcaccatcggcctcatggcgcgcgtccgcaagtcctacgtcaaggccggcgagatcgccgaggaggtccgtccatcgatcgtgcccctctcaatggacttctcccagcacgaggacgtacgtacacgtactgatgacgccgccgtaggtgtggtgtgcaggtgatcggcaacgtgcggacggtgcaggcgttcgtcggcgaggagaaggcagtgaggacgtaccgggaggcgctgctgaggacgtacaagtacggcaagaggggcggcctcgccaagggtctcggcctcggctccatgcactcggtgctcttcctctcctgggcgctgctcatctggttcaccagcgtcgtcgtccacaagaacatctccaacggcggcgagtccttcaccaccatgctcaacgtcgtcatcgccggcctgtgagtctgcaaccctggcgtgtttgtgtcagcgaatgcacacgcccatggcgcccgtgcataatttggtcgcaatatgtgtcgtgcaggtcgctcgggcaggcggcgcccaacatatcgacgttcctccgggcgaggacagcggcgtacccgatcttccagatgatcgagaggaacaccgtcaacaaggcgagctccaaggccggccgcacgctgccgtcggtcgacggccacatccagttccgcgacgtgcggttcgcgtacccgtcacggccggacgtcgtcatcctcgacaggttcagcctggacttcccggcgggcaagatcgtcgcgctcgtcggcgggagtggctccggcaagagcaccgtggtctcgctcatcgagcggttctacgagcctctcacgggcgcggtactgctcgacggccacgacatcaaggacctcgacgtgaagtggctgcgccagcagattggcctcgtcaaccaggaacccgcgctgttcgccacgagcatccgggagaacatactctacggcaagggggacgccagcatggatgagatcaaccacgcggcgaagctgtcggaggcgatcaccttcatcaaccacctccccgaccggtacgagacgcaggtcggcgagcgcgggatacagctctccggcggacagaagcagcggatcgcgatctcgagggcgatactgaagaacccgtcgatactgctcctcgacgaggcgacgagcgcgctcgacgccgagtccgagaagagcgtgcaggaggcgctggaccgcgtcatggtcggccgcaccaccgtggtgatcgcgcaccggctgtccaccatccggaacgccgacacgatcgccgtcgtggacagcggcaggatcgtcgagaccggcacgcacgagcagctgatggcgaaccctcgcagcgcctacgcctcgctgatccagctgcaggaagcagctcagctccagaacaagcaatctttctccgacagcgccagcctcagccgaccactaaggtatgtgtacgtgaacgtgaacgtgacgacgtcgtgtcaagttccgaccggccaccgcgagctaacgaccatggcttttgcgtgctgctagctccaagtattcgagggagctatcgaggacgagcatgggtgggagcttccgctcagagaaggactcggttagccggtacggcaccgtggaggcgcacgacgaaggagggcacaagagcaagccggtgtcgatgaagaagctctactccatgatacggccggactggttcttcggcgtgtcgggcaccgtcagcgccttcgtcgccggctcgcagatgccgctgttcgcgctcggcgtcacacaggcgctcgtgtcctactacatggggtgggagaccacgaagcgggaggtgcgcaagatcgcggtgctcttctgctgcggggccgtgctcaccgtggtgttccacgcgatcgagcacctcagcttcggcatcatgggggagcggctcacgctgcgcgtccgggagaggatgttcgcggccatcctccggaacgagatcgggtggttcgacgacaccagccacacgagctcgatgctgtcgtcgcggctcgagacggacgccacgctcgtgcgcaccatcgtcgtcgaccgctccaccatcctgctgcagaacatcggcatgatcgtgacgtcgctcatcatcgccttcatcatcaactggcggatcactctcgtcgttctcgccacataccccctcatggtcagcggccacatcagcgaggtaagcacagaatctcgtcagatgatcctggctgattctcgatcaaattcacaatctgtgtgttgtgatgcgacagaaaatgttcatgaaaggctacgggggcaaccttggcaagtcgtatctgaaagccaacatgctggccgcggaggcagtgagcaacatccgaacggtggcggccttctgcgctgaggagaaggtgataaagctctacgccgacgagctgaaggagccagcgaagcagtcattccggcgaggccagggcgccgggctcttctacggagtttcccagttcttcctcttctcttcctacgcgttggctttatggttagtgctacacgaagtttggaacgcggtgaataattcagtccaaatttgtatcagtagtaagatttgaaagctttgatcgggattcaggtatggttcggagctgatgagcaaggagatggccagcttcaagtcggtgatgaagtcattcatggtgctgatcgtgacggcgctggccatgggggagacgctggcgatggcgccggacatcatcaaggggaaccagatggtgtcgtcggtgttcgagatcctggacaggaagaccgacgtcctgatcgacgccggcaacgacgtcaagagagtcgagggcgtgatcgagctgaggggcgtcgagttccggtacccggcgcggcccgaggtggtggtgttcaagggcctcgacctcctcatgaaggccggcaagagcatggcgctcgtcggcatgagcggctccggcaagagcaccgtgctctcgctcatcctccgcttctacgaccccatcgccgggaaagtcttgatcgacggtacgtatcgatctcacagcttccaaaatgaattgctctgcatatctcccgaacggaatccgaattctgaactcgtatggctttgatgcgattctttgcagggaaggacatcaggaaggtgaagctcaagtcgctgaggaagcacatcggcctggtgcagcaagagccggcgctgttcgcgacgaccatctacgacaacatcctctacgggaaagacggcgcgacggaggcggaggtggtcgacgcggcgaagctggcgaacgcgcactccttcatcagcgcgctgccggagggctaccggacgagagtcggggagcgcggcgtgcagcnnnnnnnnnnnnnnnnnnnnnnnnnnnnnnncgcgcgcgccatcgtgaaggacccggccatcctgctcctggacgaggcgacgagcgcgctggacgtggagtcggagcgcgtcgtgcagcaggcgctggaccgggtgatgaggaaccggaccaccgtgatggtggcgcaccggctgtcgacgatcaagaacgccgacgtcatctcggtgctgcaggacggcaagatcatcgagcagggtgctcaccaccagctcatcgagaacaggaacggcgcctaccacaagctcgtcagcttgcagcagcagcaacagcagcaggaccagatgcagaggcattgatcttgatcgatctcctgtgcttctgtatatttgctgtgtgcctccgcttcttcttggttgttaaggagtacagtacatggaatgaaacaaatcgctgcggtaagattcaattatttttccattgtaaaacgaggggttcacgattatgtacaagagaaagtattggatttgtttctctttttctgtacaagttaaataactgaatttagtagatacgcgattacatttacataagcagattcatggcaaatggtatgatatacgactcataatatagcaacatagtacggctctatttcaaaatatagcaatctaatatagaatataacaccttactagaatatcccatagtaggctcatacatttagggatagagatagttgtgatttaagaaacacaaactaacgtgccaggtcgggacagcacgaaagttccaattagaatttgggttttgctagttagctttcggggactgaaaacatttgatttttttggccgtttgatccagcgcgtgctgaaatattttgttatcggatccgaatccacttcccaaacgttgtctgcccgttggcgcagtttccgatttttgaagcggatttgtgactatcgaatcgcctcttgaactctgccaccgatgaggtaaattgatctgatctttatagttgaaggaacatttatatgtcattttacgattgaggaagaaaatcagagtggggctatagttgtgagacacataatagacttctttgttgtttaaatgtgaggtagatccggcccatataaactaccggtgatgttggggtgtactgataatggaataagttcgtctgaggtcccttaactttacaccgaatccgatttttgtccttgaaccctaaaaccagatacaaccagtccctaaactgtcaaaactagtgcaaatgaagtccctgggcggtttgaaaggcggttttagcttacgtggtgcctacgtggctagtttgactcggtcctcgtcccacgtggcattgatgtggtgtttacgtggcaattctatccccaaaaaataataaaaacggtggtcccacatgttagctgcacctaaaaaaattaaaaaggtgggcccacgtgggtcccacatgtcattcacacccccttcttcctcctctctccctagctcaccactcttcatccctctcctcgtcactgccatcggcagagctgcgtggctgcgggccgtgggtgaggcgtggctgaggggcgggaagctcactaccgccaacggtggtgatggccggcgggatcccctcctcatttttgccatccctcttgtccccattcccgcgccgactgccaccgccacacctccccgcatggccgcatctcctcctcctccagtggccaccgccgcacgccgccccttctctccatcagccgccgtaggaggagatacggggagcactgcgtcctattgctgagtggctctcccatggcgaggcgccagacgcatacggtgatgcgctggcggacggggatggcagcacggagggcggtgtcctccttggcgacaacggcggcgagctcggcgcggcggaagtcgctctgagtagtcgacgctgctgcacaggtcccaccacacgcgcgaccggtccatcacccacagcgggggagggagcagcgcgcggtggacggcctcctcctccggcggccaccgctgcacgccaccccttccccccgccagccaccgcccttctccctgccgccactgttggatctcggttgccgacgctgctttgggggggacccgccgctgcccgcgtcgatctgctccactcaccgtcgtcgccgaccccctcttattgccccggcttcctcctccagctcgccgctcttgtcggcggtggccggtctcgccgctccctctacattgcctcgttgctcgccgtgctaccagctcaacctcgccgcttcgctcctccaccccttcaccacttccaccgggcgtcctcaccatcgagaagagagaggagaagggagggggatgaagagagaggagctggggagaaaagaggaagaagaggggggtgtgaatgacatgtgggacccacttgagccccaccttttttatttctttttgggtgtagctgacatgtgggtccaccttttttattacttttccaagatataattgtcacgtagtcgccacgtcagccaaaaccgccttccaaaacgccgagggacattggttgcaccggttttgacagggtagggaccggctgtatctgattttggggtttaaggttgaaaatcggattcggtgtaaagttaagggacttttgatgaacttattctgctgataatcaataactcaagtcggcccacaattcctaaaaatgctgaggatagaaaggagggtgaaaaaggccgagggagatttccaacggaggatgagatgcttcaaaaggaataatggaatatgatgcttatagatgccactacggcaggcagcattagatgatgtatgtactgatgtttccctggttcacgactggattgcaccgctttcattttcgccttacgatagttccctactaattttacctatggcatattcctcacatgatgccgataatatgccacatagttcaacatccttagatattcacttataaaacgacgtcgcctacagggaatttgatctcgatggcaatcccagaattagcctcatccaatgagcttgtctatggactatgagcctaagaggaccaaagacaaaagaaaaaatcatttccttcgcttatttacatagaactatagaagtagcggaaattatgtggccatgaatcagatgggaagctacaacatggttgggcgtttgctcaactttgtctgcattttttttttcagaatttcaattgtggctaccgctagtaaatggcaagatcatgtcatgaactcatgatgcacagtccagttgcccattcaggctgtgtttagttcacaccaaaattgaaaatttggttgaaattggaacgatgtgacggaaaagttgaaagtttgtatgtgtaggaaagttttgatgtgatggaaaagttgaaagtttgaagaattattttagaactaaacacggcctcaatttggcagccaactcccatcgcccattagtacaatcctaacttttttttaattccaaattcaggacaataccttagtcccttctaccaattcgactaattcgcttgacatttttttcaccaagatctataataaaagcagtcccattccccacttaaactacgcgaccgatattcttatccctactttattattatattgttcaatacgttcacggagaattttatgaattttgtcaactcgaagggtcgtcattagtgtttctttactatttattttatttcggaagcaaggggggggaataatgtctagattctaaaggaaattagaagttcaatacctaattaatttaattatctcttccattccatgacaccgagaatacaaatattagagtacctatagctccttccttgtacgactcgttgaaaaacccgttgtcgaacttgattcatcgccctttgtttttcgaaacaaaggtgttaaaaca

SEQ ID NO: 39692 - DNA, 7107 bp, Oryza sativa
aacctccgtttgacggaaaatatagcgagtcggagtgtccaacgatggtctaacgagtttgggtctagggtttgggacgactgatgagggaaggagaaaaggttcctaagcttagagggatggtcataggagatgacggagccataggcttgacaacaagcgatgggctggtgatggcagtagggacaatgcggggcacatggttaggaggtgagggtgaaggcattgggagggaggagccgctggagacaggaaagatgacgacgaaggcactctccgtcgccagcttgagaaggaggaggccaggtgagcaggactcgttggcaccgtcgaggacgaccggcgatgtggtggcgtagaggaggtaggggaatcttcgggcagcggcgcacgagagtgaggaggaatggtagagagttatggttattagggcatcaatcaatggtctgatattcacatgatgtgtgtagaattttctgtcacattgtataggcagtcacgtgctaaaaagggacgtcctttttgcacactgctgatctgctgggtgaaatgagatctaccaaggggacaagagccgtagtgccatacaaaagctggtccactatattaacagaggtagtcaggtttcctcttgtttctgtccaacggtcggtagagttgaggcctgtggtgtctgacggaatggagattagtactactgactaccccctccgtccaaaaaaaagtccaatcctagctacgaacctggacatgtatcctggacacatgcgtgtccaggttcatagccaggatttggttttttttgggacagatatactgagttactactgtaagtaaaagaaggggccttgtttctgctgctagccagcttctccggccaattggttcaggtgatgcttcagtctcatgcgagaggaaccacttaaaatgatacagttctttgctcggagatctccagcctcataaaccaagtgattttcgagcagttcctatcaatttttgtctgcaatctctgcatccatgctcgcaaacagcagccacagaaaccgttacgtttgtctgcttatgccgtgcaaaggaaagaaacaacagccacaacaaagacacagtacacttgctacctgaaacgaaacaagctccgtccaagcaattctttacaggttcacgttccaatataaaagaaattatttacattcagctccattttcgtacacaaacaatagcttccaacaactgccaatcatgcagcaaaggcatcttattttattgcttgcaactactgtacctgattattcgtctgaaatctccctttctgaataaaaaatcacaacacttgccgccacgactaggccaatgccaatccaacagcagttgggataaactgcaagacgaagcaacagcaaagcctttgctcgaagggataatggcaacagattaccctggaaggcaggcttgaccacttgaccgttcgagagtttgaatcagaagttcagatttcagaggcacgctcctgtgatacaaaaccccgtgagcacagacatgttgtagttgcgtgcattcagttgaagcaaacacaaccgagtattcagctacctggcgtgcgttttgtttctgcgtctttaataagagccggtgaagcaaacacaaccgagtattcagctaggggggaaaaatgagcattacgctatcgactatggaggtgaattttacgcgtattcggaggggtaatctagagagaaacttatcacaaacaattggcgtgcgtgctcaaccgctgcctcttgtatgcgagggacatctcggcgaattgttcatgactcaccaaacttttgtgggtggccacgaaaagctccatgccactgaacccaaacgagcggcagagtcacggccggtgtttggtcgcagtataagtgtaaccccaccttgcttcaacagcacgcgtccgcccgaaccgatgaaaggggaatggaaatctgctagggaattgagctaaacactaaacaaaaggaggtttcctttaatattttttctctggttgttgtgcgggaaaaaaatcattttaagtaagaattggatagttttattaaaattagcccaaaaaacttcaaaaatccttgtgtcccaaggcccttttgaaacatatatgttttactcgattaacgcaataaattaatattttgagaaataaattttatagatactcctgaataaatggtctaacatagtactatctccatatcaaaatataagaatttttaaagtttaacacgattattaagaaaatatgtaaaatcaaatggtgattggttgagaaatgatggtaggtggagaaattgaacggcaaagggttatgattggttgagaagaaaatatcggtggagatgttattatattttagaacaaattttaaaggctaatagttattatattttgggacagatggagtagaagaattatcgtacttttagaagcatcgagcaaataatccgcgacaaaaatccaaaaagaaaactgaaaagagcaggggtcaaaaaaaatccatatattattttcctagtacaaaaactaatacaaaaccaaggaggagaagaaacatactgggtgtgtgcttcaagtcaccaaattcttggtggaaaatactgggttcgctgaaactaatactagtaggaagccgattacaaccaaacaaaatctgaatctagttttgctaaaagtcaccagccatacgaaacttgcaaacctcatccaaaaggaagtagagatagaaaacggtttcaccaagaaaactcataaaaaaagaggcggacaggagagagaaaacacagtgttgtgatttgtgaagtccggattaaaagggagactactgtgcctcctccgttttcctcttcttcccttctgcagctctcctcttcttcttcctcccaaacggccagcggcgcgcagcgtcacagattttacaggggaaagagaggaggagatggggagggaggagaggttcccggtgtgggaggcggcactgctcgccggcgtcgcggccgcctttgccacgggtctcgtcggcgtctacctctccatgcctcattcggactacagcttcctcaagctgcccaagaacctccaggagctccaaatcctcacgtaattcgaccgataccgtttctaactgttcagctggtctatgcatatgctgatactgcttgttcgatagaaacttgcttctctttttttttgtctcaaaagtttgcagtttttgtgcgtttttatgttttagaacctacctgtgaagaatcctaatttactagaacttacctgtaggaagaatcctattttttgtgttcaaaacttcaaatagaatgtaagtacgtaaattgcatcgtatatgttccgtacttttgccaaatataaagattttattcatcttcactgttgataccaatttcatcctgttcttccgcttgaactgcgttggtgcgttgctggatttcggaacgtaacggattattcttggataatggacttgtagtagcaaagctgtagtttttttttcctgcttatctgaataataaatccgtccactattgtgtgttttgcgggtgttttgagacagtcttcgttttggtctgtggatttctactgatttagagaggatattttctaaaggaaatttggaaagggtctcagtgattcctttgaacaagttacctttgtctagtagtactacacgaagtgctttgttgtaactgaaaatgaagcatcggtaaaagaaaaaacttttctgacggtgacggtaggaaatttgcaagagttctacagtagggcgtccacttttagtggagtggtagaacatggatttatgacctgattatccatgtccaagtatggcccatacacattgcagcctgtggtccccttaatccattgaaaagcataattaatcgcgtaattttcgcagccggtggagtatgaaatcctttcttctcggtatttactttctgcccagctgtaactgtcgtgcgttttgaacctggccattggtcagatcgagttccatcatgtgtgcctttttggtcactgcacgccataacaatgttttgttgacatctgaactctcttcagctatggccttctgttaggttaaacaccacttgccaaatagtaccattgttcagacttcactattcagataaacagataaacttgtgttcttgaatttgtctgaaactctacacatgttcaaccttacacagttacactgtttgatgtctcagtgggcaatggatgtttcaaattaaactgcttctaatgtttgtgtacgtttaatttgcagggatcatctcgaggactacacgagcgactacaccgtgcaggtgctggtgggctattgtgccgtgtacatcttcatgcagacgttcatgatcccaggaaccatattcatgtccctccttgccggagcactctttggccagcttggtggtgttgcccttgtggtctttgccgccacggctggagcttcttcatgctacttcctgtctaagctgattgggaaaccgttggtcttctcattgtggccggacaaacttgggttctttcagaagcaggtaacttcttaacctgcatcttagtcagctgatatcgcttaggattctccctgtgttctagttcatggcaatgttttttatatgttcgatatgcgacattttgattctttgattcgatatccgtcaagattctgtaactgactgatgctgtttgcttcttcttctcaggttgcaaaaaggagagagaagctgttgaattacatgcttttccttagagtaactccaacattgcccaatactttcatcaatttagcgtcgccgatagtggatgtgccctaccatattttcttcctggcaacctttattggactaatcccagctgcctatgtgactgtcagggtaaatcacctgcttcaaattcacatactattctagtttcttctcatgcatagctcatgctttattctttcttttctgaaatacaggctggaatagctttgggagacttgagctcattgagtgacctatatgataaacaatcaatagcactgttgttcttgattggggttgtttcggtgacaccgacattgttgggcaagaacgagaagcaacaaggcaaagggccagaaatggtagctagcagtagctgatcacttgcacgcgaactccttctcacctccccttctgtgtacatatgaagatcctgcatttggttgcttccatggcctttgtttggatcggtgcaacttatggccggccaaagggcaacagaacatggcaagggcccctctttctttctccacttgtggaaccctttgtgcatggtgctgcgaaagggacacctcactgtcacaacattatgattctggggaacaagatgggccaccagagctaaaatgacccatttgttctgtttaacatcttgtttagatcgaaggaacagctgatcttatcatcattgtatatgcactgctaaccagattcagtttttcatggaaccttgtcttagtgatctgtgaatctgtccatgaaatggtctgtttgggcgcggaagtgaacagccaaattgcatgtcattttcactcgtttgtgctatgccgcgatcataacgattttgagaggcgatcctttgtgagattctgttgccaaatgccatataatggcttcggtaggtgagtggtgcgcgcaggtgcgcgctctcgattgtcgattatgtgtttcgttcttgaattgggacctctccatcgttgcgatggaccacggctgttgggtgacaaactgacggggcaatccgtcagtcgcacacacgctcctagtcctatacacggatgcgtttggtggataattcgctgtagcttggctgaacccatttcccatcgaggacactttgaagaagaacggcaccggcccacacaaaactcctcagtttttagtctcttccctttgccactgtttttcacaaatgaagtgggactccgagtgcatgttccatacatataggtgaggcattccacatcagaaggcagcaaaaatgtacctcactatcaccatctagccggtcatacaggttatgacaagcagataaaatttgttggttctggatataaaacaaaatgcatgctaaactaacatgtacagctggaaaaaaaaaggcttcggcactcggaccatgctaccatttgattggaaccgggatgccgagcttctttttgccaagagggtgactccgaggacagcttccagaatcctgctctgcattgagttggctcaagcagtccacaatgccttttctccgagtggacggcatactccttactaatcgtgttacgttcttatctatgcaagggcccttcgtcgatttagatgctgattcaaccttagccttcttagcttttgatgtgaatttaaggtttccaagcagaggggtctcatcttctgcaaatggcacaagcagaaatgtcagcctcgtcaattttcaaaggataatcagcaaagcaatgtacagtagtaccatgtaagacaatgaacccgataaattagcagaaaagaaaaactaatgtaatcagcattggcagagcacagcaacagtatgtctatcaatgaatttaaaatctctctattagtggtacaccaatgatatgataactagacaataattcagtgtgcagttatagggtagtgcgtaagaacttctgttccgctgcagagaacttggtaacaaaagaaaatggaaccaagatgtaggacttaccgtcaccgaagtcctcaaactcaaacacattaaactcattatcatcagagaagaaacgcttgcgttttggcgaaggagttgagggtctgtccaaattggtaatgtcagcagcactaccaggacacctattagccacacaatcgtgatgagatgatatgcatggcacgatttcatcttttaggtcagccttgttgataccatcaatcgggcatcccttagctggctcctcaaggaaagatgttttgcattgactagtttcatctttctctaatttatcaccagaactgttggttgcttcaccagaggggctgcaggaat

SEQ ID NO: 39693 - DNA, 8627 bp, Oryza sativa
cacatctgctcttaatatatataactactgggcaaagccctggtagtatttttaatttaaaaaaaagtaatagcaagtaacttgtgacacatacatgggagtcattcattagatgccaagtgctcggtgaagaacgaacagaacaaacataatggccatagctaggtgaaccagaatgctcaacaacgccataaagatcatatttcagctccttctgcataaggtgggacaagtaaaacatcaaaacatgcctttggtaaagctattgctaaaaatagagatagtagaaaaactcacattgatgtcaggatcacaatggaatggcttcaaatcaagttctagtgggtacaccacatgtttgtcaatcttttcaacagatctatcaaggctggtgaaacgctttaaatgaatggcaacgacatctggtgatctatcaagcataagttgcttgttcttacaaacttttgcattacaatgttcacagttcagcttgtcctcagcatccccaattcgctccaacttggtaaaagattccaaggcatcaataaggttatcagcctgatcaatctccaggctaagatccaagaagggctcatatgtctccgagcagtgtccacactcacagcaagtcaactagatagacaggatgaattcagttgcaacttttaagtgccaagacaacaagcatgatgacaaagtaaaataccttgctttttagtcggcctccaaaaacctgcttaacaatactttcttcatcaaaagatgagggcttatcctttggcttgggatcagtggtgcacttatccaggttgtccagcaaacaacgtaggaactcatgtgcatcctcctgttgtcctggtctaaaatctgatgataattctgggtaatcttgtcaaggaactccaccactaatttgaagtaccagagacagatacaatagaagatatatatctcagcacaatattcagtgaatattaagatgtattgaaattgaaacagaactgaggaagcatataaatagaagttatgaaatcatataaggggtaaccttgaaattttcaggcataaacacccaatgattgtcaaaaatgcaagtcatattactgagcatgtgtgcacaaatgtggtaaaattaaactgcaaggaaaaatcgagagcaaaggatactccttaaattatctctgaacctcactggccttataacagatccagaccttcggattgattcatcaatatgttctttaagagcacagaatgaacagaaaccatctttatcatctgcaggagaccaacagttttttttttatcatgaaacaaaaatggcatgagataacacatttttcaggtagcaaaacattactgtcagaaactatccatacatgagcatggagcacagtgatcagtggaacgaagcctgagaaaaagtgggactgtatgggtgacacactgaagaattgagtttaggaagcatgtgttccccatattgccaagaccagatccctgcatatgaagaaattttaaaaataacaaaattattgaatatgtcattagcatacgtaagtcttagggttgaagatattgcataaaacataccaccaattgagattgagtgttgcgggaaaaggacaaagaaaattgttggccctccatgttgcaaggttcagcgccgctctgttaaacatttttatcaatccaatttgttcagtttaagaaagattaaaataatggcattagcataactgttttgaacataacagtctctaaaacataactttggctgttaatttggttataaacttataatataattttaagccatggtataagcatagtttctaaaatactgctggagacacattagcagctaatatttacaaagtttgactgcacgaaccccaaaacaattcattttattgtagggagtaataggtgtgattgtgaagccacttacgccggagttgcacagcttgctgtcaagaagggatgatgagtcttgcttagttttcccatcccagatatctatttcatcctgcagcaccaccaacaataatattagggagctctaggcacctggttatcacagtttatgtagaatagttggataagatatttcagttcaaggcttattgtgtgcaccattaaacatataactgggtcacatgcctacaaagggccagagaagatcaaatagatagaaaattacattggagctaggctgctctgtgctgaggggttcagactgcatatttgtatccccatctaacaaatccatgtcattctgaaaaaaaggaacaagaaaaaaaacagccaaaattagcaaatttttagatacaaccgactgtatagggatgtcatggtaatacatagctagctgcaacataaaaatcacttgggcacccaatcttttaatctaaaaaattagattacattaactttttatagtctaagctaacaattgaactcctgcagtccaaaaaattagggctgcacgatatcacacaacaaaacggtgccctacatgcaagtcttcaaattaagatagtaaaatggcaaaatactaagtaattagagtaccaattgtatttttcatgaagaaacataagagcacggagcacaaaatacaacaggcacgtagttccctagggatgatcagggaaacaaaccaccaaggcttatgcttcataccattgattgttattttccatgagatgttgcactaaagtgggttcattacctattaaaggacatgaacataacttgctttcttatctactgtatcagaaatgctctgagtgaaaattaataaacagtacttggtgaaaatcagcattaaggaacccaaacagactgactgggacaatcatattcttagaaaggttagcaaatacctcagactggggctgctcattttcaggccaaggtgcactcagcatgtatttatcatccatcgaatccaagttgctctgcgtatgagaagaagcatattaaattaactatgccaaaagcagagcgacaacaagctaatcgcaaaaaagaatagataagagtatacattgtgttcgttactcttaattgtgggggcacaaaccatatcccaggaatttgaatagctctgcaggcaaaaccaggaaaccgacaaagttaaaaaattagcagccacaaaaaaggcatgtaatgttgtttcaaagagaaatgataacacatgtaatcaaatatttgtacaaggaagtcaggttaacatcttacaacagagcgaatcggctggcacatggagaaaaatggttggtactgctcactttcagcatccccactttcagcaccagtttcaacctaagaactcaattgtcagaaataagccatgtatcgatgatccaaaactacagaccatttccttttgtaacaagtactagcagaaattggacaaaacagaaggtaaaaggcaggtcgaaattaccatcgtttcagtttgttgaactacactgcggaacgttgcacacaaacaaaatgggaaagcagcatgatagtcaccacgatttctgtcgtctactagccatgaatgaatgtcactagtgttgcccaataattatgtactaataaaaagtggtggtgaggcgctactcctacctgctaccagattcccagcacacgaatgccatgtaccctgcttaatattggggtagaaccacagcaataacccaatcgaaacgcaccacaaaactccaaaaccatctaaatcaaacacgtttggctaagatcgcatcctgagttgcaaaaatgagcagtaaacacaagtaatcgccacacgacaagccagcccgccgactaaaaccgcgttctgagtaaacccaaaaaaaaaaaacagcgaccagtcttaccacgcaaggtaccactggcaacggccgtaccagacgaaaccccaccccaagcaccccccccctccccccagaaactgcagaaaaacaagcaagcagaccggaggatctcacctgaacaggggcggcctccgcttcgctcacggccgcggcgccgttctggtccgccatgcgagggcgagggcgcgctagggttttcgctcgcggggaggggcggtaggtggcggtttggtgcgtgctcgcgcgcggctgctgaatcgatggagaggggaaggctttggttggtcgattggttgagatcggagactaatcgcagcagcggcgggggaaagcaaaaaaagtagggcaaatcgttgggtgggaaggaggaggaggaaggagggaaaggaagatttgggaggtgaggagggggcggaaatattttgggtttgaaacggaggcggggcggggtgcgcgttaaaactgacgacgcggcgggtgggagggaggaccggaggagaggagacggggaaaatgtgaaaaaacagaaactgagtagacggaggaaggaggcgggatggggagagtgtggttttcgcgtttcccgcctgtgggggggctagtgggggcctggattttcggcgcgctcccgcgtttccgtttcctgcgtcgcgtgggtcaacacactgcggatgcggcttccctgttccgaatccgatctgtgtcaaccaatcaacggcatgtgtcattttagtggtgggtcccacagtttcatattacagtcctttcgacttctctttagtcaaattattttatgtttccccgagtttattgaaaaatatattactctctcctttctaaattgatcatcctgtaataaaatccaaaacttctcaaattgatcaccatgtaattgcatgggcacgaattttattggaatacaattaatgcagtatgggataatgtgtgcatgttagggtgtaattggtatgggattttaatcgatgcatgcattatgggagaatgtgtgtacggtgtcttgattgatatgatttaaattatccttggtcttagtgtataaacttatatgatgatcaatttaggaacaagagagtagtatttttaaaaaaatataaacatattatcaaaatatattcaatactagatttaacaaaactaatttaagtttagtaggttgctaattttttttataaatttaattaaagttaagaaagtttaactagaaaataagtcaaaacgacgacttgggatatgaagtttagttttcctcttctctattttcgttgttcgagttaatatatcagtacctgtctctcttatggggctaaaggaaggggaaaaatcataatagattaaactcaatgaacattgtttcgtgaaaaaaaaacatgttgtttttaggtggagctcaaggtagctaatctcccatggggctagaagtccgccacgaatccatgatcaaccccgcatgttaagtggagtgttaaggattcgattagatggatatgtcttttaccttaaaagcagagttgttttccttttgttccctcttctaaccgtgcaccacattcgcacgcgtagtgtgcttaggtaaccaccggatgcaagtttttttcactaatattttttatagcctattactacttatatcgatctaacccgacacaagctatgaaacatatttctagtatggttctccaaactcaaataagtttagatctaaaattttctatgctaccttcaaatgaggggtgttctccttccaatccattccctactctcatcacgcaccgcactcgcacgcgtagtatacttaggtaatcattggatggatccaaagtttcatcactaatcttcttatagtcaatcaggcctgatctgttataacatactacctctgtttcataatgtaaatctttctaacattgtccatattcatatagatgttaatgatatataaatgtgggcaatactagaaagtcttacattatgaaatgggggaataccggtgatatgggcccgggggtatcacgtctagagggaggaggccgtcctcaaacccacgtggctctccgcgaggggggatcaagccctgggtggagcggtggctacccccacccagctagagggaggaggccgccctcaaacccacgtggctctccccgaggtgggtcgagcccggggtgttgtggcggctgccccctcccagcttggggtcgagtcgcccccaaacccacgtggctccccgcgaggggggatcaagcccggggtggagcggtggctaccctctcccagctagagggaggaggccgccctcaaacccacgtggctctccccgaggggggtcgagcccgggggttgcggcgactgccccttcccagcttggggttgggccgcccccaaacccacgtggctccccccgaggggggtcaagcccggggtggcgcggcggctgcccccctccaagctagagggaggaggccgccctcgcttggggtcgagctgccccgacccctccatgtatcagcccacgtgtacagggttaggtgggagcgcctaactgccacctaactgcatttaaagcggtctatgcaaccgcgccatgtcgcatttaatgcggcgtgctgcgcatctgaccggttgaataaccgatgggacggcgactgtgtacccccgccctgtcagtgtgtcaggcggtgagcggcgtgctctgtcccgtcccatcataatgatgaggggcttcacagcctcttaccccggtcagagttggtccaaccactctgaactgaccgggttcccgttttctggtgtgaacgagaacccggaagtcctcatccattaaatgacgaatgacaagggcgccctgcatgatttgatgggccccgcgcagcaaccgacgtgcagatagcttctgagctaaggcacaagacatgtaattaatatagagaatattttcccttctccctaggtagcactcgtagcacatgtggtatccccttagagtataaaaggaggaccatgcctagcgaggaagggggatcggacggaggatccctgagccaaagcttgtctaaccatagcttgcataccagagattcagggactttctaagcacagaagaatcatacacacaggagtagggtattacgcttcatagcggcccgaacctgtataaacctcttttgtctcatcgtcttggaggagcctccgagatcaagatcacacacagtttcgctcaccaaattctctaatctcaccagttgcccccggccgaactctcaaaggggggcctcacagcctctcgctaaagagggtcacccctcgacagggagtatgagtgtattactagtatggtataaaaagatgccggttcttcaaactttcaaaattttcgattcaaaagccagctgtaccagtcctaggtgacatttttttaattgaaaatatttgattaagttttgtggcatttcgatccggtatatagaatagcatcattttaccttgcataacgcttcaatacattttgcataacgcttcaatagcatcatattaatccatggcatttgttaggactcatgcgacagtttgctcatagttgcttttgcttgtatattatgatcgttagcatatataaatgaagatgttttcttcttcccattacatgacactcttcgaacagttttcttccttccagtttgaaagagaaaaacatcctgaaagcatcaccagcagcttcataaaattattggagccatcgttttgcggaataagcaaaacgacatatttgcaaataaacaaattgtgaataaaagatttatatactcgttcttagtgatctaaatacaaatgctgaaaaataaacttcaataaaaaacctcgaaagaagctccaactttaagtttgaaaattcaaattttgactgataagtgtaagtataagcgaaaagatgagaccctttcctcctggaagctgtgtttgttttagagggttggaaacccttccctcccgacacacaaaacaaaacgatacattaacacataattaattaagtagcattagctatttttttttgaaaaatatactaatatgattttagaagcaactacaattatgtataatgtttttccgaataacatactattacgagtatcatttagtagtttgatgtgcgtgtgaaagatacgaaaatagaagttagaaagcgccaaacaaatgtggcttcttactcccttcgtccctaaatatttgacgttattgacttttttaaatatgtttgaccgttcgtcttaatcaaaaacttttgtgaaatacgtaaaactatatgtatacatgaaagtatatttaacgatgaatcaaatgataggaaaaagaattaataattacttaaattttttgaataagatgaacggtcaaacatgtttaaaaaagtcaacagcgtcaaatatttagggacagaggaagtatttggtaatctcaggaacttaaggaataaaaaaacttatttaatacgccatccgtcccacgatataaaaagttttagagttaaagtaggtagatgtgaatgatagagagttgtgattagacgagtagtgaaggtaggtggaaaaaataaatggtggatggttgtgattggttggaaagagaatgttgatgaagaagttgttatattttgggataaatcctaagagataaaagttgttatattttggaacggagtgagtatatatctaactctctcaaatgggctgcaggaat

SEQ ID NO: 39694 - DNA, 18901 bp, Oryza sativa
cctgcaccccttttagcaaagttattaaaaaattatatacgtttagtttgttgctaaatttgttaaatatataaaaaatcctgcaaaaattttggcaataataccatcttgctaaaatttaataaggttattttgctacgatctgaaaatgccctactccctcggatcagaagtaaaccgagcaaatacagtgttgagctaattccttcttgcatgttttcatgggcctggttgccaattactagcagcatatactgcagattgcagatttgcagtaggccagaacggcccatgaataattccctgtggaccaggcccattgcatcggagccccacactctttccggtcacgggggtgacgccgcgagacgagcgggcgctcccaatgacacgaaaggacaggtgtccgggtcggatacacgtcatctcctccccctattatccatcaccaaagttgcaaaaaaattcaggggaatagaaaagcataggaaataaagtaaagggaggagaggacaaggaactccttccggctccgatcccacccactccggcggcctctcgctcggcctcgccctcgcctccgatcgattcgcccctcgtcttcctcctcccggatcccccaagccaagcccggggagccgggccgccgccaacgcgcgcggcggacacgaggaagggaaacaggcgacgacgagaagagaggatcagctgggggtgatgaattgttacgctgcatggacggagcaagcgagaagcctccccacaaggtacgcgtccccccgcgattccggttgtattattcccgcgcgcgcgcgagagagagagatcgagtgtttgagcttcagttcgtcagtctatggctggatttggttttggtcgtgccgcttgtatagaaggataagagagctgtgctgcggctgcgcgaaccagttgttttctattattggagtggccgatgacttgtatcttcgttcactgtggccaggaaaaaggtggataggccttcccaataatttgttggttggttctggaccaaaccttttttttctcctggggcattttgatactgtgattgatggctacaaatagtactggagctactgtggtattgctttgcccgcggtctcgctagtggacagcatatgattgtttggctggtggccagatttagtcatggtcaactgtgccgagtggccgaattccgtatggtggatttaggttcatcttcctcgcgcaaatgtttctaggttcttgattaatgcagcagcacaggatcgacatttaacctatggtctgtaatcggtgaattgagccttttagtacaaccctctcactgagggtttgagacgaagactggtgtttaggttcaatctgtggcaccattgtattgtaacggcccgtcaggtctccttgtcgaacaccaccctacaatattataggagtcctgttagctgtttcttttttaacctgaacttttgcagccatttggaaaatgctgatcaatgcattgctgatgtttgtttttgcttaaaccaatttccttaccttgatgtcctttattcatctaagacaaatgctgtgaattgcacaaactaggttctactttcttggcagatgcgttgctttgtctgtactattcttcacagcaaatgttatctactgacgaagtgaaggaattattattcaagcataaaacatctattaatagagtgtggccttgtgggtggttaaagggtgcaaaacaaccaaacaacttattactcagcatgcgatttagtgtatctttatttacaagacatcggggttgctaggcaattcaagcctgtatattgccacttgtatgcttcgctatggtatgaactcaatatgtgttattatatggtttttacaactctgttaatatgcaactcacctgcgctgtgagctatcatttgggcacttaatcttaataagtcatgctaatccaaaataaactcactttaccgcctatgtactcgtgacgtggactaccgtgccattcatattctgaaaagtgtccataatcaattatactatttcttgcacaggtacacttttttttaatacgtcttattcattatattcatttggaatagcaggactattacaaagttctggaggttgattacgatgcatccgatgacaccatcaaattgagttatagaagattagctttggtatgctgttattggacttctttcggggtacgcaaataataatacattaacacactgtaactgataattcatccacagatgtggcatccagacaagcataagggggataatgatgtcacagctaaatttcaggagatcaatgaagcctacacaggtattttccactctccattatgtaggcacagatgatcttattatcctcatttacttcctagagataaatttgggatctcaatatggatgtacttcctagagataaatgttatcgtcattgcctgattcacttttttttatgttccgttttttcagttctaagtgatccagctaagcgccttgaatacgacctttccggatgttatgagttaaatcgatatactttgcgtgtaaggtgtcttctataattggccttccatattcctcttctacacgctttgtgttgatttttcttgctgtctttccctcgcttttaggagtaccttacaaggtttaagggtatgatacttacctgcaatggtcttggcatagaccattcttcaaaatggtaaagcatttcatttgagcctgatgctaaatttgttttgcatattggttaagacttaagacttcatggcatgattcctaatagtagtgtgaacacttcgaatacagtatttatgatttcattttctagggcccggcatttgagggaattggagccccattgatctataggtacatcttatttgtccatgagcttcttcagtactttctttgaggccaattggatgcttagctgtttcttttaacacaactatggatacggcagggcatctctctgttctttgtaacacaacaatggattctgtcgtatactaatgtatttttgctgcaagaaatgcatgcacgcagtttccagatgtagttcttggcttctcaccgaaaaaagagcaacagtttcgtggtgtttaacttgacacaaatacaaattaagcctatcctttctcatgaacgcctgacagaagtagatgacagtaaaacataacctcacatattctgtacatttagtccatgcagtaatatagcatagaagagttctggtgttatcagttttatcacagatctgccatgatgaacatatgctgagattaaaatgtgcttagttcggatcactagttccagtttggtgtttgatctcgaaatctccattcaagtatgtgttactcgtatcaagggagcactggagaaattcttttgatgcatgttttgattatatagctagcaattttagcggtacgccctccattcaggcacatgggacaacgtccttatatctgagttgcagtatatattttgttgctggacatggttggctgcctgttattataaactggtaggattagcacggagggttgaagaactcaggattctttactccgttgttattttgggatggagtacttgtttgccatcagtggaaggaatgcaggatgaagctagaaagagatgcaaaattttttcccaacggaaagttctaccagttgagttttcctggccagtctttccttgctgtgctgaccttgcaatcatcctctctctctctctctctctctctcaagaaaaaaaaaatgcaatcatcaagcggttcctttctgatttaaagttctggcctgtaaagcgagttagcgtgtgacgctggtgtttataccgtaccagcatttggaattttttttatttttattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccttcaacgaaatttgcaggcggcccccttgccgccctccgctagggcgattttgtactgtgcggagggccgcctgcaaatgggcggcggggggcctggaattttgcaggcggcccccttgccgccctgggggagggcgattttatactgtgctttatatttttgtataaatataaatagttatcaaatctttttatattgaaaactatacaagattaaaatctccaagacaggtaaaatacaattttattattttttagggcctatttggaatgttaccgtacaaatattttgttagtgccaaaatataagcaagttttggcactaccaaatatttggtaaggtaaaattgtatttgatcatatttggtttgctgccaaaatgtaaaattgtagtgaagaatgttctacataatctcaaatctagattacgtattaccaatgaataggttttaatcgaaatcaaacacaagtactattcaaattaccaaaatattggtagggcatgtttttggtagcaatccaaataggcccttagtcttacgcatacaaaaaatcaccatcataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctacacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatctattgtacgaattgacatttccttacatcttcctatgtacatccattttgggatagttaagttaatgatagtactgaggagtgatgaaaagaatagttataattaccacggaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagttttttttatccatttgaacttcgaatagatgaagcatatctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgctagttgagacgctcaaggaatggcgcttccattttcgtgtgttgtgtgctagtggggaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtactgttgtggactgtgcgcgctactggatctgacactaccgtgaagcgccgaaagtgtgttgtcgtgagcataagttgttctagcacgatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagagtgtgcctctggagctcctccaagctgagagaagcctagtacgtcgtggtggtgtgcaccgtgcaagtcgtcgtcgtagaactggctagtaggaccagtcctaccggcgtgagacgaagaggccccagtatcgaagatcccggctgcaaatcctactgaacaaggaccatcagtttcatacaggtatttaatagtattaataaaaagtaaagtaccgtgtgggcgagggatcgacgctccgtgagaggaagaggtggcgaacgcccctgcggagctcgcggaagcgccggtcgtgcctgtgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtcctgctccgacggtaggcgcacgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcatgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtatggtgcgctgtccaccactggtcgacctatggcaaacctctcggctgtccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatcgaccgtgcgtagtggaccagccggaagtccacagcgtgcccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtgctgcagtgtcggagctatctccccacagggaaggtggaacgtgtgcgtctcaggtctccagcggtctaccagagcggtaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaataaaagtgtcaccatacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacatcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatgggtttgcgatgtaaaaaacttgggcactcagcgttgtgtaagatcctgagatcccgaacccatatatctcctcactccatgtatgaaagattgcttctttcctgaaataatttgagacgtacacattggaagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgtgtgaaatttctgatggacgaccctgacctccttctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttttggattttgagtgaatataatgaaatttcagagaggggggactgggctttataggggggaggcaaaaatcgccctccccagggcggcaagggggccgcctgcaaaattccatgccccctcgccgcccatttgcaggcggccccccgcacagtacaaaatcgccttagcggagggcggcaagggggccgcctgcaaattttgttgacggccatcgcccgagagcgaacggccgtctgccacgtcattttcgccgccctctgggatggcgatttttaaaaatcgccctcccagagggcggtaggcgactacttccgtcaatttttaaaatggaaaattatttttgtaaaacttttaataaaaaaaattaaaaataaaaaaaattcccagcttttgtctcccagctgaaataaatcgcactgttctatttagtcatggcacatgatctgcactagtagaccactagtgggcaatggtacctgctccacgcttggcccatggtttgtagggccttcgatatcgagtggaaacggaaggctgataggatcggacggtgcccgtgggctttttgccgtaccaccacagccttggatgagcaaggcaaatagctaaatactacgggggtggctaatgggcgatcgatcgctcgatccctatccccatatggcctatacactcctctcccccttcctccttcccttctcttcctactacaccataattttttttaaaaaaaacaaagttggaaaaatttatatatagaaatactatatataaaaaatatttgaattcaaattcaaatttgaaacgggtacgtaaacttttgacttataaactttgggtctataaactaatatttgaatttaaattcaaatttaaaacgggtatgtaaactttttgacttatgaactttgggtttataaactttatatgtatagaaatactatatataaaaaatatttgaattcaagttcaaatttgaaccagatataatttaaattcaaatttgaatcaggtatataaacttttgacttataaactttgggtctataaactttaggtgtataaatttactaaaattaaaaagtaatgcggtgaaaaaaaaaagaaaccacgtggaggacgggggataggactttcgaaatactactacctttgctcaacgtgttttctcctctctagtactcctggaaggagggtgtgcgtcgcgtgcacaaaagctgcatcggtccattttgcttgcagggagggatccaggaccagacgcccccggctgcggtcagtggtcactcgatgcatctaccgtggagcgtcagacatctatcgtggttctgtataatgtcgctgacacaatcatgcctttgtaccggattaacgaaaagaaaaaaaaaggagaaaaaataaagaacttaggagtatgagggtcagaagccactgtttccaccgaaacaaaacgcagccgcgtcgcgtcgatcaccccgcaagaatccagccgcggtgaggggagcgtcacttagccacatggacaatcggacacgcttgagatgacggggcgcctaccgatcgggagaggaggtggccggcggccgcgtcgttcgggatccagagggttccaaatctcggacgcttgcgccattgcaggggcgagaccgagccgagcgtgcgtgtcccacaagcgactgattggcgaacagctaccaacagtaacactactgctagcggtggcgatcgagcattcgagccctcgcattcgcgagaaatcacaatcttttcccagagattccacggacaaagcttcacctgttgcttaatgattaccgcatcagtactaacagttaccccgatttagacggggaatttttgaagcctcgacatatagagtagacactagagtagtatgctctactgatcaaacctcacgctaatactgctatttcttccaaggtagtcctactagtacgcttagtaccagactaatactagcgctgtcatgcttaattgctgcaggcaaacaagggatgggcctcacctgtcagtcagtacacggggtttccaccgtcactccaacctgaaagaaaaacaaagcacaaactacacattccgtcaatgtcgaaaaagagataaaaaaagaacgcctggtgcagtgcggatcaaatcagcgaccttaaaattcccaatttgatgtacacaggctacaacgttttcaagcacgctaaaaaggagcaaaagcaacgaagagaacaccactggcaggagcatatgcacacattacgcccaaatcacaggctttggagtttggtctaatttaatcataagattagcacgcgaagccacaaaaaggccaaaaggaaaaatctcctgtaatctcccccgtctagttaattaattaatttagtcctctaaagcagcacacatccctactgatcgctttttccggccatgccgagccatctcactcatcctcgctccggcatgctcgccgacgatctccggtgccggaacgccttgagcgggctcgggaagtgccacccccaccgcgccttcgccgccgcggccgccgcttttgcctccactaccgtcgcggagaccgagctcgacctcgcgagccccatccccccctcctcctcctcgtcctcctccgccgcagcagcaacgccgtccttggccgcgggcttccagaacggcggccacccccagaccctcgccttccgcctccccccgaccgcgccggcagtggctgatgcggtggaggccgccgcgagggaggaggacgcggcgacggaccgtgaccgcgcaatccggtgctcccgctcgatgagggtgtggacccggccgaccgcttcgccggacgccgacgaggaggaggacggggacgcgcacgtgcaggggcagggtcgcacgtgcgcgcagttggggcagaggcggaggagcctgtcgcggaggcagtgcgggcacaccccgccgccggatctcgccaccgggtgcttccggcaccgccactcgtcgccgccgccgccgccgccgacggcgaccgctgccttctcggccttcatccccctcagccccgcgcgtgctgttggttgctgcgtctctccctctcttaactccgctccgcgcttctcagagagagagaggaggcgttactcacaacgtcgctgtagaacggaatggaaatggaatagagcgagacggaggccataatgaaggcgccaccaccggagcttactactaacggcttgtggtttcgcgagcgcaccaaaccggcacgtactcccgagttatttacgagtgtgccatccgtagagctggcggctagcagctgaggaatatgaaaaagatcttctgcgaacaccgcactcgtacaaaacaatgtactcccataaaaaaccctactttgaggtactccctccggattcggatcctctgcagtaatgtagagggtcactatagctacactaatatgtgaggggaacagtgttctaatgcacaccacagtcacgatttactgtagctacaggggatgaatgtactgtagcacctctggttagtgctgtagcagatttactgtagcatctcatctgatccatccatcttctatcggacgcttcacagtactcctaatgccgggcactgtagctacctctgaaatttctcctctacagtagaggatccgaattgactccctccgtctcacgatataagagcaagtataatagtaggctataagccggctaaatgctgagatggaggagaaaagagaggagagagaggacaagcaggctataaacttacagccggcttgaacataagaactaataaactctgtgagaaagacaagtgggccctgtattaatcgtaaagagctaactattatatgagtaggctaagagaaggctacaaagaaccttatagccaacaggttggctatattattatctttgctctaagagattttgagtttttgcttccaacgtttgaccacttgtcttatttaattttttttgcaaatataaaaaacgaaaagttgtgcttaaaatactgtggataataaagtaagtcacaaataaaataaataataattttaaaaaaaattaaataagacgagtgatcaaacattgtaagcaaaaacacaaaattccttatattatgggacggagggagtatgacatgcttggagtaatactatgaattcgaagatttatgaaaattatatatgatgaattcgaagatttataaagtgtactactaatatgcaaatccattcacagtgtcgctggacgcagagaatcctggccaccgcgctgagagataaggctgccggcgcacgtgcggggtgggaatgaggcgtgtcggggtcagttacatgggccccgcatgtcggtcttttgtgacgggaccgaggctgtttgttcttttttctctttctccattctccatgcccgcccgtgtggtggactggtggacggacgactcgcggctttgcgaggcgcgcacgcgcggacctggcctcaccgcgccggtttttgcctggttgcagccgtacgggacgacgaggcatcgtgtccgtcgtacacggacgtacacgccgttgctagtcgcgtactactcgcgtggattgactagcgggcgtggcgcggtgtccactaccgcctggccctcggttgtggttgtacttgcacgtgtggctgacaacctccacggtgtggtgtagcgtgcgcgcgtcgttggctctgcgtctggggctttcgctagacgtcggccactcgtgcaaaccgtgcacgtttgcgacgagcgcgtgtacacgtacggtgcgcggttgcgtttcgaccagatattccatcgttccgcatcgtacatggaacatggaaaacgacgagagcaatttggctatcgacggcaacgggaacgggcacggacaaaattttgccatgttatttaattacagacccgggggaggaagcgcattgtttttctcccccataggaaggtaaaaaatgcaccgcctgcttcgacacctgtagtatatatttttcaccgtattgccaagttcgcaaggagtagaagcaaacatctttcgttctcagataatggcctatatatcgacttgctcttcagtgctggatcttgcctccaaaactatccagtttgctccgaaagggaataatcccaaatcttctcccgcaacacagtacaccggtacaccaccaaagagagtgtacactgtcgttgatgcggagggttcagtccaaaacgtcggcagagcggaagccacaaaatcttccctgcaatccgtcgtgccagaagcgcagattcagacttcacaaagaacaagaatgcgtccccaattaagccactcatcctttgtcacgactcaggagtcacgacaatttaagtaggaaaacggattcccttgttgacagcacatgagccactaggtcgatcaattcacatcatcagcaacgacactcattctatccttggaaaggaattctgccagttcaaagagacaagcatgcaaatccttaacatgttgcaggtaggcacagcaccagcaactaccaactaattaatcagccaaccaaacacaggcaaccaccggtggaggggtaggcacagtagcgcgcaggtgtcagcccatgggctgacgccgcggtatcatctgctattgtagagagcggcggcgtaggcacggtccccgcggtaatcctcgacgagggtaggtgcccggtgcaccgcgcggcacatggcgacagcgctatattcaaatccgcctagacggcgcagcgtccaggcgtcccggccgcggccggtcggcgtcaaatatccacgcgacggcgacggggatcgactagtcgaatccccggctggccggctccccatcattcccgatagttaatcaatcccctaatctccgcgtcacgttgctgcgtgttactaggtggtttaattagccggttaactaccgggggattccataattaggtagcgattagacaatcctttaattgttatcctctcgacattcctaacggtggctgatcatccttgatcaagttgcagacaaagaggccacaggccagggacaatctagcatattgggctggtataccctggatagcgaacgggaaaatttatcgacgagattctctgccgctgctaatccatgcctatgagcttcaagcacggatcgacgaaactgaagatgccgtattttacaagacgattttctgttgccaccgtggtctccagagttcaggtccctgtacagcaatagttccaaacacaggtccctgttaccctatacaacaatcgtcccaaacacatgccatttcgcgtgggtgttttgttacactagttaggtgtcggtgcgttgcaacggacaaaaacatatatcaattttaaattacaccacgtgaaattatgttaataatcattgcgtgcaattttgttgtaacaaaaaccttaatataaaatgaacaattttatatcacttttggtttcttctgtctggggatttatatttacctcttttagttctcggagcgcggaagattgttctaaaggaaggaactacaaccaggaaatagtgaaattaatcataatttgaaacacaatattttcacgttgccattcaacaaaatcagcagtgctgctctaatcgaaccttcacattctaggagtacacgcacgcttttccaattaacatttactccctccgtcctaaaataaaatataagaagttttagagttgaatatgattattaagaaagtaggtagaagtaagtggtggagggttgtaattggatgagtagtggaggtaggtgggaaaagtgaatagtgaaggtttgtaattgtttgggaagagaaagttgatggagaagttatgatattttggaacaggtcacgtttgtttaacggtagttccgagttcctcaaaaatttgaggatggaaaacttttagtaaagtggcatatacaggctcataagaaacatacctagcttttttttttgtcttcttataactagaaaaaataaagtgtatgacacccatagtagaaaaataaagtgctggacctccgtgtcgacgagttcgattgctgaaccggaaagactatatgtcttaaatagttgccttggtggtgaggttgatgtgctttcatgccatcggccagggatcgatccctatgcaccgcaccattttctccttttaggcattaaattgcaattgggccacaacaatccaagtgggccttacaaggccagcccatctgcctcttgaaccgccggttcaaaatagcccgcgtcaccggttttcgttcatccggtttgtaccggttcaactgcatgtgtggtctttgagttaaaccgaaccgatgagggtgctggttctggcttttttccggttcaaccgccggtctggttcggtttttttactaagatgacacctacacggcggtaggaattggattgctatctgctatgatcaccacctgtgaaagaaatgtagtgtaaaccacttagcgaaatggttcataggtgaacttaacaacacattcaacagaagtgcacatgtgaaagtgaaacatctaacgcatgagtaaaaatttcagacattatacagtatagtattttaagcacaataaatattttaaaacaatatgtgactttccatgttgtatcaatagtagcggcatcagaaataaaacacctaagagcataatgagcaggagatgcttccaggttgaagcactccctttcctaaaccacatattagatccttcccaatcctggtaatcatggacgaacataaaatcaaaattccataacgacagcgcctcatcaacccagaaatctccatgataatttgcacttggaagatgatagtattatggcaatccacaatatcagcacttgaaccataatatgaaaaaaaatattttaagtgcagtgttatcctgtgctatactgcacttaaatatggaaaaagaaatagcagaaccaaccaaccaacaaatccatatattttcttgtttgctatcgtcttcctgctcaatctagagatctcattttcagttttgacaagtaaaactaaaaaaaaacatatcatgtaatgttacgtgaacaa

SEQ ID NO: 39695 - DNA, 1935 bp, Oryza sativa
cagtagcgcatcatcgtcaacggagttgggcagcgcgagggggtggcggttagtggaatcggcagccggtgatggtgaggggatggatggtgtcggtggtggcggctgacgaatttgaaggtcgggtcggcgagggtggatagaggaggcagcgacgcataggcggagcagatcgaggcgacagtggtccggcggcggagaacggtggcgatgtggggtgccggtggcgcttgaggcagagtggatagcagcgcatcattgatggaggaggttgcgacgcgtgggctgaggtggtctggtgacggagtacaataacggcgaggaggagatcgggcgtggagcggagacgcacgacgaggcggagatcaggggttgagcggaggagacgtcctcccctcgatctgacaacgatggcgttgagagggcttccttgatccgacgacggtgacgctcgatccgatgatgcatgggcacggagaaggggagttggcgacatgcattgcaagccactgcaaaatgcgggtggtggggagctcggaatttggggagggggacgcgtggtgagagcgagtacaagagcaggctataagtcagttgtaaacacatgcggaagagagaagaaaagagatagaaggaaaacaggctgcagatttgtagccagctgcagcgtggaatccaatacgttgtgtgtgtatgagaggtgggaccatatattaatggtgtagtatatacttatatgtaactattgtataaatgagctattagattggctacagataaattggagttggtacttggctatactattaaacttgctctgagtgagaggtgagcggggcggtgcggttgtaacgccccgcaatgattagaggaaaaagaaaaggagagaaagaaaaggagcaagctagctagcagcccacaacagcaagcagcaggccggctagcccagcccaacagcagcccacaacaacagcagcagagtagtagtagcagcgcagcaggcagagcagcggctcgctacagtaccttcgcggtactgtagcaagtttaataccactcgctagtttgagaaggcagagagcagcttataaaggaggatagcccggggactgtgaactccgattccggaacgattgtgattgtgcaggtctatcagggtcggcttcaccatcatcattatagatttttttaagtagtaaatatacacagggtatctatctatctatccaagtgaaaagtgaatcctgctttgatcatataataagccacgtcatatgttgaataatgaccgtccgatgcaacacaaattcaatatgtaccgttagatatagtcatgctctgtaaaaaagatgggtcaacaatagccttccaagaatcaccgtcaaatccacatctcgctagaaacacctggagcaaagagtgaggtcttgactcttgacgagcacttcccgagaaaaaaatatgaattactccctccgtcccataatataagggattttaagtttttgcttgcactcatcttatttaaaaaattttggaattattatttatttttttttgacttactttatcatctaaagtactttaagcacaaaatttcatttttttatatttgcacaaattttttaataagacgagtggtcaaatagtgcagacaaacactcaaaatcccttatattatgggacggagggagtagctaggaaattagaaaaacatattccctccagacacaatcaatcatcctattatcaaaatgtcgatatggggtacccgtaaaccggatatagagggtattggggtacgctggtacgaggatctacgtagtacgacatcaagcaaataaaagacaatgattatactggttcaggtcccttgataggtaatagccctaatccagttgatataggattatatggtggaagtcacagattaca

SEQ ID NO: 39696 - DNA, 1182 bp, Oryza sativa
aatagtatgataaaatttcgttaggccccgacgatgggggttggttgaagaaagtgaagggattatggttgaggggaattagagtgttaagtttttatgtatcaattttaaatgggctttttgggtcttcattattgcaataggctacttttatagaagtaactcacatccaggatctctccggatcaccaacgggttaattctaatccgcgctgccatcgccggaattttgcgggccctctccccgctcaaccgcggatgagaattcttccttggccccagtcccaatagagaaattaccacccctacatatacctacatatattaagttctttcatgaaaattatgggcatttccgagaatacagtgaatacccactgcttctgccactcaacgatgacctaagttggtaaaatccgatggtgacatcagcggcagagctagaaaatctgcatgtgtacggtgagctaacgggagctcaaatatttttctagaataacatagcaatttttaaaatttaataaggattatggagctaggcataggagaaggagataaggatttttccagggtttatattattgtcggtaaccacgcggttatcgtggttactggccttaccgcggggtacggtaatagaaaaaccgcggtaacctccttaaattcaaataaattttaaaaataatttgaatttttaataaattctgcacggtttcgtgcggtttttcacggttaccgcggttaccacggattgggtgcggttttttaatatatatatatatatatatatatatatatatatatatatatcagaatttattggatgcatgcattatatttattagggtgatttaaactaggagatgataataattgtttcttggtctttgggttaagggtagttgtgccttatattttggaatggagggagtaagagattttggatgaatgtgacatatcctaatactatgaatctgtacagagtattaataactattataaatttaaaaacattttttttatttttaaagaaaactttattcacgatattcatagtttagcagtttggtaagcgtgctcttaataaatgaataagaagcctagcaaaagagctctttagaacgcatcctaagaggtcttcttgttggaaccaaaccctcgcattttaagaggcattcaagg

SEQ ID NO: 39697 - DNA, 1017 bp, Oryza sativa
aagatgtgatgttttggcatcgtagacttggacatgttggttttgatcatctcactagattaagtggtttggatcttgttcgtagtttgcctaaacttaagaaagatcttgatttggtttgcacaccgtgtcgtcatgctaagatggttgcttcttcacatgctcctattgtttcagtgatgacggatgcaccgggatagctattacatatggacactattggtccagctagagtgcaatctgttggaggaaagtggtatgtgtctgttatgttgacgatttttctcgatattcttaggttttctttatggcaattaaggacgaagcttttcaacactttcgtggtttatttcttcaattggatcttgaatttcctagttctttgaaaagaattcgaagtgataatggtggtgagtttaaaaatgcttcttttcaacaattttgcaacgaaagaggtcttgaacatgaattttcttctctcgtgttcctcaacaaaactcctagagaaccgtgttttggttaagatggctagaacaatgttggatgaatataaaattcctagaagattttgggctgaggcaattaacactgcatgctatatttcaaattgggttttcttaaggtcaaaacttggaaaaacttcttatgaacttcgatttggacgtcaacccaaagtttcacatttgcgtgtttttggttgcaagtgatttgtcttgaaatctggaaatttggataagtttgaggcatgttctaccaatggattgtttcttggttaccccacacacactcgtggctatcgtgtacttattttggagactaacaaaattgttgtgactagtccaggtactagacccgatattgtaggttcagtgggaggatggtcgtatttttaaagacgagagcgacgatgacgacgaggttggctcggccggtcagactgggcgccaggccggtcagaccgccggcacaccgccgatcagaccgacacaggtgttgcggtcagaccggccaggctcg

SEQ ID NO: 39698 - DNA, 8904 bp, Oryza sativa
ctgtgttggatcctgatgaagatggtgaagctgttgatcaaaaggagtatagaagtatgattgaatttttgttgtatctaactgcttctaggtcagacatacaatttgctgtgtgtttgtgtgcgcgctttcaagcttctcctcgtgcttcacatcgtcaagcggtcaagcgaataatgaggtatttgaatcatacacttgagtttggaatttggtattctacatcatcttcaaatatgcttaagtggatattccgatgctgattttgggggttgtagaattgataggaaaagtactagtggaacatgttattttcttggtacatcattgattgcatggttttctaggaaacaatctactgctgaatctaaatatgttgctactgctagatgttgttcacagattctttggcttttatatactttaaaatattatggtcttacttttgagaaagtacctctcttttgtgataatactagtgctattaacattgctaagaatcctgttcaacactcacgcacaaagcacattgatattcgttttcactttttgagggatcatgttgagaagggagatgttgaattgcagtttttggacataaagttgcaacttgctaatattttcactaaacctttggattcataatcattttgcttttcttcatgttgaattgggaataattcatccttttggcatgttttgagggggagtttatacctgatgattttatcaagcaaaaatatggcaatgagaaaattgaaaaagagagctttgtttatacatatggtattttcttgtgcatgctagcaatactttgaaggtttatttgtttttagcatagcttgtatgtattctagtcttttcatgagatttagattttgcttttaacggagatgatgcatgacatttaaattctacacttgaattaagcaaatatgcaatgttgatgctagcatatggtttgttttataaatgctctacatatatgctttattgaattgttattcctcaaatagctttaattgctcactgtgaaaagagaacaaaaatatgaaaaaaatgaataccgaatccttggaaacagtcttgacgacaaggacgtattcgatgtgagcaaaataatgggtgccaaatccctagaaacagtcttgacgacagagacgtacccggaataaaagagaaaaaaatatgagcaaaaaggctcaagaaaaaaaaaagttaaaaattctcttggttgttttgtgctaaaggtaattttagaaagagtgataaatgcaataggtatatgtgtttagtgtttattcttcaacctatgtgcttgttaagatgttgcattataaatcgcatgaaatcatgaattttgattgttgattcaagcttaattgtaaaatctttggttcatggttatactttaatgcatgcttgttatgttttagatgggttcatcttctttttattacaacacatgacttgatatgctatatgtatgctaagctcttgaacattaatgaacataattcttggagaagcaaatgagttgagaagagcatgttgtttttggtccgattgggaatttctttcttttcaaaagtaagagaagttttcttttgtattttcgagcacgatgtgtactttttgtatgaagtgtgctttttaccacatttgttttatttttccaaacaccaaaacatttttgatgggtttgccaatgtgttcatcaagggggagattgtaaaatcaaagatgtttttgattgttattctgtgatgaacaattggcattggagattattagttttgatatttgcaatttatttacgaagtggttttggagatgattggatttacaggtgagtaacaggtgttgttattttatgtgaccggttagaccggacagtgtgtgtcggtcagaccggcgtgtatcgcgcggtcagaccagcgcagcctgcggtctaaccggccaactctgtgtcggtttcggtttcaggttgtttgttcggatatccgtgattgtttcatgattatggcttctaaatggatactatgcgtatgtaatactgttgtttgctaataatgagtcaagttggagatagcttggtctcggaatatggtttctttgtttatttcatgtgtaggtgactcgatgcctcgggagagtatttgcggtaatggatcaggagtcggcttggggataagacgacgtccgtggtggtcagagatcatgcgggatacttaggctagagttgatggacgtggttggtgatgatttcatatggcatacgatagaggtattgtgtgtgtatgggatgcggagtcgaatttggaaggagtccaaatttggtatgagtggttatgtaaagtttgtttcttgtactagagggtttcctaaggtgtttaggacttctagtatgagtttggttcgtggctttaggctgcctaccttgggtataaaaagaggaggagcgtgaggcttcccggtatcgcttttgagatcaattgagagttgagagtttagttagggtttcatgtttagtcgaaatttttgtaaggagtgttgttggtgcactttgtaaacacagagagaatcaataaagtcgtcatccactttaagagttcttcgatttgtgtttcaccgagtttcggcggtctaaccggcggcgcaccggcagttagaccggcggggacacggcggtcagaccggcttcggcaacaggcgacaggagctaatcttggcggtcagaccggagatctaatcttggtcagaccgacggcaaccaggcagtcagaccggcaggacaacttcggtcagaccgcgatccgtcgaattcgaggataacttttatttccactaaaatttttcggtttttgggtataccaactattcacccttttctggttagcttagttcttatgatttaatcctacagttgctgcgtggatcaatgtacccaagtatcctgcatcttgatgagaaccaactaagctgactaactcctaccaaccaagttgcctatatataagagcaccactgcctcatagcaaaggtctatcaattgatcctcaccgcttacacaaagcagttgcaaaaactcccatgaaaaccaaaacaatgtaatatgccattcgacctctcaaatatcgtgggcatgaacatataggcatgcgaagcatcaggagccattctcacgacacattggttggaggtattacactcttggaaggttgttcgagtaatacaacgctgaaccttgtgaggttaacctggtcatgaggatggactctaaaaatatgtccagtcgcctgttatgcgaacagaggaacaagtactggcagcctagcaatgctggcatcttcgttgcttcgcatcacagcggcaggcggcagtggttcctctggtcaaacggggcagatcaaggatttggagccatcggggtcataacgtaatacatactttacggtactagcatttataagactagatgacaccatactttctagctaattatttgtggtttcttctcacaaaaattaagatataccaatgatgtaattgattaatgaaaaaaaagagagtgtaacttatggtatcttctcgagtataaagaaacatttttttttgcaaacttttatacatacataaagctcttattaaaaagacacggccattagggaatgatttaatatcaaataattagaaattagaaggggtgaggctttaaaccctggtcatctagcccaccaccttgtggagctagccggaacaccttgggtgtttctccataaagctcttatttgttctacacctaattattctacattgttaaagtataaactaaataaaaacaaagtaatgtagcatttcatctagctagattattaattgtttaacttgtcaaaactaagtaaatcaacgggctaggttaattccacctatatataaacagaactatactatacgagaagtgaattaagcaactgttgcacgtgcaatactaacaacagcaaaattgttctggctttccctacaacaaaatacggagtatattgtttactagctgttagtgcgtgggctagagtaaattagttagtctgccggggtcagtgagctttaatcgatggtgtcattggctaaaaacacagaggattatgttgtatttgtaagataccatcggtgtcacctgataccgatagatatactgtacatccgccctcagacctgtagttgactatggcttcccttaattacttttctcgcttcccttaattacttaacaacgggagaatgctacagagagaacatgtagcataaacagaaagatcgtgctgtatttgagagcactgtgactccatgcttgtctgactagaatcttcagacgaatccattcatgcgaaatttgatcgagttgtgttgttcctcctgttgttgtttggaccatattcgagagactaatatatatccaaggaatgtttgaaatttgaacgtcatcgagcacgcgtctacgccatcaagctttggggtgccgctgcgttcgcccccctcgggtcgcagtgccgctgcctgtggtccacacctccactggttgttgcagtgctgagaggcgccctcctcagcatttctacatcaccagtggacttcttgccgctacatcgacatggagctgtagctgtgttgtcctctcggaccgtagcttcgccgctttcgtcgtcttcatcgccgttcgcgcatcgacaacctcgtcgtccgcactggtcatcgtcggccgctcagggtcttcttcatcgacttcgagcatcgccgccgcatctccaagctgccactgtcgccactctaggccggtggtccagctacctctacatggctaccgacatcgccgtccaggccattggtcccgctacatcaccttctacttcgtccaacatgattcatcgccagcgtcgccgtatcttcctcgactacacttcgctcttctccagcaactgtgtgctgctccggcaattctccctctacgctgttctcgcgccgcgaccgtctcggaggccttccctgctagtctcctccgacattagcgtatgattcatggtggtctcctgtctcgccgcacggtattggcaacactgttgcgtgcgttcgtcccgagttgtccccgggtctggcaaaccctgtgtgacgtctcgtccttcacggttcgactacatcggctcttcggcgtcatcttcctcaacgactaccgtgattgtgtcaccgtcttcgtctccagtgcgtcctcacgcaccttagtccacgacgcccctcccgtgcgtccacgaccactctgcggcgccccatgcgcgtcctgcggctcgactatctcgacatcagcttcctgacttcggctacattgaccacggctactgtacgcacggctacctcgaccatggctccctcgcaaccttcgctttggctatgtcgactatggcacaaagggttatcatccgtattgagcactcttgccggtttcttctctactccaagtgcccgcactgctcacgcttggactgcggggggatgttagagtatatggtagttagagccacattaggataggattggtttgtttggattcctttcatatctgtaatccttctttatctcttccctatgtactcctatatatatcagccccctgaggctcaatacagtggtccaatattcgcagtatcctctcttcctatactatccaacaacatgcacctcagaggaacagaatgataactaggacttcaacttagctcactcgttctaggaacctatgcaaatggttgtcacattctccggatgtctctcagtcctatgcgtgtctcatactgattattgccataattaacataattacataagctgcttataatttacacgttttaggttcactggagaggcgaaagagcaagtagcctagtggttatagtgacctgagtagcactctaatatcctgagttcaaatctccgtatgagtgaatttcagattaggttgtttccgggctaaattcgggaaagtctcaatgatgcaatttattacataattagatacaaattaattagtagagagagcacttaggccctgtttgattcagcttaggattattataatctggattattaggagtaacctcaaacaaacaagtagattattatgctatattattataatctataagccagattagtataatctaataatcttctctggaagagctttttctagattattgagtggctaaagacccgctactcttagatgcttccaataatccaaagaaacaaacaactgcaacttaggccatgtttgattcagcttaggattattataatcttgcttattaggagtaagcgaaacaaacaagtagattattatagcagattattataatctataaaccatattattataatctaataagcttctctaaagaaacttttttcagattattgagtggctaaagacccactacctctacatacttgagaaaaattacccacctatgccatcaaccgaacagatagctgagggcattatagactttagcctttcaaacccaataatccatgcctccaataatccagacaaacaaacaactcacagcttattttatatcagcttattataatccagcttatagcaatctggtttaataatctagattataataatcataaactgaaacaaacagggccttattctatatcagcgtattataatccagcttagagtgatccgatttaataatctagattacaataatcttaagctgaaacaaacagggccttagtacaaccaagattccaaatttatatatgtaagggaaagtctcaatgatgcaatttatcacatacttagatacaaattaacaagtagagagagcacttggtacaactaagactccaaatttacatatgtacagggaaaacatatcatagatctcgcttccctgttatatgcagggaaagtctcaatgatgtaatttattacatacttacatacaaattaacaaacacatatcattgatctcgctttcctgttatatgtgtgatctatataatactttttgaaaagaaaaacacataatcaacaagcagtcctacaatttaaatttaatagtaacaaatatagcttttcaaccaactaccttagcatggtttatatgcaatatgcggagcaactcataatgccatgctatatgataaatggaacccaatgaggtaatgtgggattagtcctttctaatcatatccaatgagagggtttggcggttgtatgtattctttttacatgtaacacgtaagtacctacgtattagagataagaggagtgattagccggaatgatcaggaggggtgattagcaagatttttcaagtctaatccaatggtcatatatcgatttaactgaaaaatcgagggaaatcactaccagggagcgggaagctaccgtgtgccaataactcttggtaacacagcgaaaaaacacgggaacagagcttcccgagagcagactgtcgggaacagacactcagcagcctcacacctttaccgtgcaatatttcacgtgagactacgcttgtacactcggtatgacaagaaaatttactgggtgaaagcactttcttggtaacaatgtattgaccggcacaggatgggttgcgaaaacggaatgggggtgttaccgagaggtactaactcacgggaaggaataaaatattaccatgtgttgtagtcaaacacacggtaccattagataacttaccgagagctattaacactaggtaacattgaatacttgattctaggaatttcataaattcattgtcgtactacactgaaacgcagcaacaagcaaacatgaaaggcagagcgcaaggatacatcacaggaacatgtcatgtgaacattagctgcaaattctcccagtattaataggaacatcatggtacaataataaaatattaatagatctacaaactggctgcacatgatgcaatagaaatatatgattctcaattcttacaacctctcgcaatgagacaatatatagacaaatgctagtggccgactaaccaaatgtgtgctttgacagcacaaatcaactctttagtgttttgccatgattgttatatgcctgaaattataaaaaaaaaacatgtttagtgccaaataagattacaacacaactagattatttagaggacactacgtacttgtggatagttcacaaaataaattttcatttgggacttgggaggcaggttataataattttgcagtgtgatctccaattaagtgaagtgtgtaccttagaaatattcgtcaaacaagatatttctatggatgaatcagaacagtaggattttgcagtcattgtcatcatgttgaacagatgatccattgagaatcttcaactccttgtcattgcaaatttcttcagtattcctgctagtggcaaccttctcaaaatcattgtcaagttcttgaccaaggcactgtttattatgaaaatattgagtttcggaactaaagttatcaagtaattaattggtttgtattactattctagagtttcagaactgaagctagctagatttcctaatatgatatgaggatatgcatggtctacagccaccagtaggctaagcagtgacatttgtatcgagggacatgattgtgcattgtccgcacttgatcaacaaagtatatggatgtgaaatttaagatttcatcaagaatgtatggttctgatatggatgaaaaataaactattctttttgccgtaataatattttttagtcggaaattatctcagctgcgttcttttgatgactgagaaataataattgagtattaactaagaaataggatgagctagaattcaga

SEQ ID NO: 39699 - DNA, 18497 bp, Oryza sativa
ccgcctacacctccgctccccttcctcaccgcctcgaccgcaaccaaccgatgaccccgtggtcatgctccatgccatctacgccgccgacgccgacgtcggcggtctccatctttcgtgccaacccgccgtccaagccgctcccgttcttccaggcagcgaaggcgcgcccgcacggtggagtcgttggtgggcatggccatggcgaaggcgcggcacggtggtcatcggaggtggaggcgatggcggcggcggtcgggataggtgcgggggcccgcggaggtggggctgggatgggggcgatgggaggaggcacggggaggggagccatgggaggggtccccgcaggggcctgtggtctgtggttctccatggaggagagctcacgcgaaggcggatggtggccgccagcgagagctgatggtgatggagggaggaagaagatgagaggagggtaatttggcccaagatagtattttagcgtgtaaccatttgttgatagtggcattttatcgaattcattttgcagagtggcacaatgtcaattttctcggagaatggagaagagaagggggagcggttcatgggtagggttttgcggtgctatttgggccaactttctactgggccagtctgttcccgatggtgaatagacacaaacactcgaaaatttactgtgcagccaaaaatcgtggcacatcatccgcctgcgccaacggaaatcgtcaggcgccaaagaaattccgcgtgccgtccaccccgccaacggaaatttcgcgcgccgtccaccccgccaacggaaatttcgcgtgccgtccacccgccaacggaaattttgcgcgccaagccaaaatagtccgcccgtgccacggtaaaaatggtgggtcccatggttaccaagtttattaggtaggtactcggtattttttgttagcttcccgagtttttctcgaatacactcggtattcttgtttttttaccgagttccaacaaaaactcacggtaacttactgtggcactcgatagcttcacactctctggtagtgaatgtgtgttttttctcaaaatctttgtgatttcgaggctttgtttatttaaaagatagttgtgatggtttaatactgatttaagtaaaaatcggtggacaaatatttttattaaaattagtctaaaataatgtgtacacaatataaaataatgggtatcaactttgtttttaaatattgtagagccaatttatttgcatctgtttgtaaagagtgatatgataatatattaaatgtttgtaaagtaactattttataaaaaatattatcactaataataattattattattattgtctcaactatatacgtggaaaaagaaaaaaggaaggtcaatgtttcaatatttgtacgttttcctactgaagggaaggaaagactatataagagttttggtcgatttgttttaagaaatctaatctaactatttatagtattggaactaccgatttaagtgaaaatcgaaagatatatgtttttttctctgattttctaggtttttctttaatttattagagcgctaactgacggcttaagagcgttttgaggaagtttaatagatttttagtatataatagatggtgtttattttgagtgtgtgcttcttcttaatggtacagaattaactttttctataaatttattaaatatcaacccatgccaagaacagtccatttaatcaggatgtaaataataatgtgttatcaacaataatgcgaagccacaagtccattctcttgctgctctatattttaatatgaagcaaataaactaactagtttgtaccaactatacattcgttcaatcaagaagaactgcccatatatgtaagagagagcctcagtctcataggtcacaaagttctatcaagtgaccccctccacttgcacaaaccaaaaactcccataaaaacctaaacagtgcatatgccattcaatctctcaaatatcagctgcatgagcataggcatatgaagcatcaggagccactatcaggatacatcaataggagatactgcacccgagatgtgcagcatgcgaacagcacacggctgaagcttgcgaggttcaccatgttctgaggatgggctgagtgtggaagtatactcacctattatgcaaactgaatagatttcctctatagcctagcgattgtggcctcttcttctgctttgcatcgcagtggcagtgaacttcgccttgtttgcatccggtgatggatggtcctctgatcagccctccaatcgaatggccgtcctctttcttgtcacagcgaggaacagcagaagagcgtagggagaacgtggaacatgaacagcaagactctgttgcataagtgcatgtttgttgaactggaactgtatacgaaggcattcgtatgaaatttgattgagttgtgctcctccaaaacagttcaaacaatattctgctagagattaacatccagggaacgttgaattcatatattattagtctttccatgcaaatcagagactctggtgttcagtccagtggctcgaaatgccaatcaactacagatcaccatgctcctatatgtttctagagaagcatgatacactgatagaaaccaaatacatgacacaagtttgttctgctggattcaaagactttttatctgccatttgctatttctgtcatgtttgatagttccaatgtcttgtggttgaattaataagccagttatggatcaggcaactgcaactgcaagaatgagaattgatggatgaatgtcccatacacaattaacacattaactgagacaccaactctcagaaccttttgaagtctgccttcaggttttaatgatccttgagaaggtagtactacaataccacacatgtttaaattgtggtgccatcctagttcaaaatctcaaatattcatatactctctccgtttcagattataagacgttttaactttcgtcaaagtcaagctgtttaaagtttgaccgattttgtagaaaaaagtagtaacattttcaacctatgacaaatttattatgaaaatatattcaattattgatttgatgaaaccaatttagtagataaatatcactgtatttgtctataaacttagtcaaactttaagcaatttgactttgaccaaagttaaaacgtcttgtaaccagaaacagagggagtatataccaaataatgttggaaagcgtaatacctgcccacaccacatcgaggatgtaaaaaaaaaactcttccatttgttattattaattcaatcaatcgggtgcattttttatgtattagcaagctagtttgttaaaaggaaaaaatatctaaggtaattatcatgaatatacaatgtgtgtctatgcttatataagagcggcaaaggtgaatacgctcaaggctcaaactcacgtgaggtagtgatctatcccactgtaccataaacagagcagatgtcccttgttccagcatagagatgtttgctatatatcgtttatacatgtctaatgcatattagactgtgtagtatcaggagtaattggtacaaaggcttcctcaacatttttcttgattaaatatatggttgaagcatcatgtgagagcagtgttaaggcactccggattgtaggcacatcaagccatggccaacgcaggccgtagccccgtttgctaagtgggctaaggctacacaagggaccttatttctccaatgaagacaatacccacaggtgtgtcctgttcaatgaaaagctgcacaaccgagaggcctcaagctgcacaacgtgagccacggctcgaaccctagccttagatcggcgcctcgcacagggggcgtggcgtatgtaggaggttcgcgcgctttttgacctcgcgtccaacgtgggaggctagaggtacatgccacgtcttcgcgttggctatggcgtaaagaaaaaagagtgccagcagactgacgtcgtgtacctatagaccatcaattgatctagaaatgcttgggtatgctaggtgaaaatattctacttcatatagttattcgacaactgttgatagaacaatatggaatatagtattatttaaatatatatatataatagaattttagtatttggggagtcatttttcttaatgtacttaggagaaggatatgtagctatttacattgccatggaaggctccaatgtcgcaaacatccaggaaattaatatccaaggaatgttggattcattgaaaatttcccttgcaaactagatccgctcgatgttcagtccattgactcaaattgtcaatcatctatagagatcactgagctctcctctaccttaatttctacagatgcatggcactgacacaaactaggaattttcatactaaatttgaatatagtccgacctgcctgctttctcagaatttaagtgagctgacatgttacaaatttgcatgcgagattctaccatagtaccatactcaccatcagttaaataaatgtttgagctaggtttccaagcaaaatcccattaaatatgaattaacaatgttttttcatttgttactgaggaggagagacatgcaggcctgtgtgtgtatgagcagacgccctttgggccatgaggactttcaggtccagaagttgcggcccagatttacttgagcgacggccactaatttgcaatatggcagggataactcctgcacaatctgcgtggcacatcgttgatcggacggcgtacgatgatctctcccaatcacttgcaacatttcaagactgggtataagtaaaccatgcaacaaacagttctgcatccacagatcatgtaagcttgctgtgatggttaaaagaacatgcacaattgggtgggtgttctaccgtacggtggttttttttgtttgttgatcctgtaaacaattgtaggattgtgaggtaccgggagagttccgctcaccatatttacacgccaacgttataaatgggcatttgggtgcaagctgctcaacagattccattcatgtgtataaattcagcagtagaaacttcatggcatattggtattaccaagcgaatgagcatatgcaaacgtttcacaccgataccacacaaatcgggtgcatgagcaaacgggaaagcatcaatggaagcaagaaaattactaggatttgagggaccaagaaggatctccaggcccaaaactgctaactcacaaggcaagaactcctgcgcaatctgcaccacaaatcatcgatcggatggcggatggtgatctgtcccattcacttgaaacatttcaagactggatataagtaaaccaagaaatagagtaacaaacagctatctctccaagcacagagatcttgtaagctcgcttcgagattcacagaaagcatgcacaactgggtgggcgacctacatactcctcgagtaaagcaaatttgcttgtccttgataaaaccctttgaaggggaatattgcttttcatttgtttataccggaggcgggtataggattgtgaggcatcaggatcattcagtccaccaagtttacatgcctacatcagaaataggcatttcggtgcaagttgatcgcgagaggatgttcatgtgtaaatttggcaagggcaacttccacttgtactacaaaccctcttatctcagaagatatataagattgatctcccacaccacaccacagcactagactcgagcaccgcaaagcgtgcatcctactactcatcgtcctagatgagactcccctgatgttgtgcagtttacaattgtgccactgacatggggcccacatgtcagtcgcacaactgcaggctgcacaaagtcggaggatctgtttcccatcatctttgtggttaagcaacgccgtgctcatcattgttgtcaaggacctctgccacatcttcggctattaagctacatctcattactgccctgttgtgggtggtacaaccaatttatattgtcagaagaaaatgcattatataggtttgcaccatttgatcaagtgcatcgtacattaagccagcaatatacatcaactaaatgaagaacaagttgcatataagtaaaccacagagaagagtcactactagaaaaaacatttttcccgacgttacagtacaacgaatctagatatggatttattgtactatgtaatttctcatctttgttaggttggttttttattttttttattgttttttttacggagggagtaaataatatcttgtatgggagttgtaaataatagccaaacctaaccttggagaattagttaaatttggcccttttgactttggagtgccacattccgcctgaaccccacacccggattccgccgtcagccaaaaccctcgccgccgccgccggctgcatgcgtggtacctcggcaccggagaactcccctgtcctcctggccgtccgcgcgtagcctccgctctccgacgcagcgcccgcccgcccgcccgcccgcccgagcaccggcggcccttcgtttctccggcacctccgccgccgcgcgacgtcggttggtattccggaaacggcatctttacttcccaatcttaatttttatctcaaagagatctctcctcccgttgccgtgtaaatctcttgctcgcagtgttgcgatcttattgagtttttgtttttgttttctttaggagggatcgcaacaggaggccagaacacaagaattctgctggattaggtatttgtttttttttccccaaatcggattgcacgcttttgcagattatgcgtgtcgatttttgttatgataatgtaggtgttttttcttgctgctgtttgatacatatttgtcccagtaggcaaaataatgtggttaaattgtgcaattaaccaatctatatgtccatttatattcccaacttggcagatgacatgcatgtattttcccccaatctgcaggttattctcattgtggtctatgtacatctcaggttttgtttgggagaatattactttgtaagaccgtcagagagtgaataatggacctttgattcctctgtttttttttgagtgactgaaccatccatgtcatgtttttatggtaactgttttcttttatacgacatttgtttatatgacattgtggcctgtaggacagactattaggaagctccttcaaacaggtcgcactaaagttttggatgttgtgtggctaattaattgttatgtttggcataaaaccgataaatagtcaatattgagttgagtgatagcatcatgcacctcctgctttgttgaacagccagtgctttttcttcttgtatcacatcttattagttttcatgtttagttaattgagttgtggagatggattgctactttctaaaataacttgaccttcctcttctcccttgatttgtcttgtttttagaactgatgtttctatccagtctcttactctggtcctaccacaatatatgccacacttgaactgggaaaaataatttaggaggtgattatttctagttcatgttctgtttagcatgtcctttatgaaagatgaggtaattagttttccttaatattttgacattaaatttgcacaagtgagctagatcttatcattgtaaagaacaggtttatgttcttctatgattaacgagaatgtcatgtagaaattgtgcaagaacttcttgttacaaatggcatagcctttttttttccagaagccttactgtgaaaagaactgaaaaccagtatcaagactccaacagcgtctactttggtttgagagtgacgtttccggtgtaattgatcttgcatcaagttctatatttatatttaacgctgattcctttcaataaaatgtcacagttagcttttgaaaagaagaaatagcagattctgttccatataattgtaccttttggtctactttttatctgacaaatcttttccctgaatctgttgtctggagttacttaagacccatatgcatttgttccaagtgcatcacatttgttttccaccactggaatcagactaaattcattttgaccttactgttcaagttcgcatgttttgctagtgtaacaaaaaaaattgctgagatcattcttttttccaaaaaaaacggggtgtgagttggcagaggggaggggtgcatcacaggttttaatcaacagtaggcagatagttttttgccaactcagtgggcagttttatgcttgcctcgactgattcttgacttctcgatgggagcagcattttggtcactctccatggcccttgtggaaatgggaaatgattctttagtttgccctttcagctctagaaaatagatcctaactcaatacaattcaacgccaaaggaattaataagttatttgaactatttcattagtactgtattacaatttcttatcatttgtagtactacctccgtttcaggttataagactttctaccattgtccacattcatatagatgttaatgaatctagtacacatatatgtctagattcattaacgtatatatgaatgtgggcattgctagtaagtgtaataatatgaaacggacgaagtaaatctgattgtttacatgatttgaaatcttatttttacaacatatgtttctgcagggttgttgctctcctccaagtggcatccaacggaacagtaaatgaaattagagctgaacaagatatctcttgggtgtattcttatttatctgttgggaacttcaaccaaataggttctcagaattggcttcaaagttcaaacccatgtgctttctgctcgtttgacatacccactatatacatttcacaccattccactcatttgcaatggggcctcacccacctagtagttattcagataaaaaaacttgccaaaatgtcccaccagaaaaacccagctccacgagtttctgccatccacaatttccgcagcacttactttcacatccagcatatgcaatgaatttccctttcccgccgtttcctcactatcctccatactcgcaaaatttccaatatgctgttccaccacaatatgctccatactcattaccgccacctgatggagctatgccatcaccatatgtaccagctacagttatgccatccaaggcaccctctgatcaaggcaccccacattcagtaactggtccaggacaacaagatgatgacgatgctgaacctgagaggactgctaggcgactagcatggacagaagaggaagacattagattggtaagcattcctcttcctttttctatttctaatttttggacattgcaaatggtatcctaacatctccgtgctggaactacagataagcacttggttgattaactacaagactgacaagtactgggataaggttgcagcagaatacaacagtgcaacccccggagctcggagaagggaagtgaagcatttgaagaaccgctggcagaggatgatcaataaggtggcacatttcaatgattgttggtgccgggtcatggcaaaatatcctagtggccagtcagagggcatgcaacagatggacaaaacttggctgatgtataataaggaagcacatgtgatgtatctcgaagaagcgaagcataagttcacctttggccattgctggaacgctgtttgggaccaacccaagtggaaagaatacatctcttctttctccgcaaaaagagtgatgcgatctgagtccggtggttacgtgtcatcttcggaagactctgaagatatgcaagaaggaaaatgcttagtggatcctctggacatgcttcccaagaaccatgaagatatgacagaagtccagccgtctgtctcaaatcaaaagaagcaattagaactattgacagctgatgcgtcgtggcctattgaatttcagcttgggaggcaccaattgatgactggaacatcaaaattgaacgaacatcagcagggggtggcagtgagggatgaaatgcttgaaaaagaatcgggcccacaagattttgaggtgctagacaatgagagagtggcaagggaagatgaacctaaaaaagaaacacagcctcatcaaggtttcaaggcgcgaaaggtcaatcggaaacgtaaaggcaaggcatcatcttcttcatgtgaggtgcaggaagacatcaaacatgcattatatcttcagaccatgcttaacaatgatcgtgagaaaatgtcagaggtacagctccgcctctcgaaagagcagcttgaattggccagaataaagcaggatgaagcgaatgtaaagaaagaaacagcactttacatgaaatacacagagctgttgctggcagacacttcaaggtttgatgagtttcagaaggcagagtatgagaaagcattgaagcatataggagggatactatttagcaaggatgtcaattagtgccctcgcaacaatttatcttaagcatgcatttctgtgcaaatatcatcccaacaactagtaatagatcgttttgttctacttaactgaaggattgcctccactaacacctgtgtctgtgttaggtttaatcatctctagcaagatttaacagagattagtactgattgaatcgtggaagtgatggatcaatatgtatttagctattagtggcttatctaatttgcaactgacctgtgcaaagaatgaactagtggcttgtcttggagtgatggttgaaggcaaattgcaaatacttgaaagttaacccaagcaggtcttacattgttctctgccaccgaaaactcgcacgccctacattgctgtgttggagttatcacttgctagaacatattgggatgcaatcacccgtcaattgttcagtcatcgcctcaaatggatgcttctctacactctatcacacagtttttcccgttgcatctcatgccaacagcagaaaaaaattgcttctcgactgcacaaaagcaataggtctgacagcttttatcttatttcagataatgttttatggtggcttgattaattctgtggttctacacctatgtgactattgtgctatttattttagggtatgcatatgaaatatatgtaggtgtcacatcgttagaaggattggattctgtggttctacaactgtgactattgtgctatttattttagggtatgtatatgaaatatatgtaggtcagtaggtgtcacttcgtttttttttttttttttttagaaaatggtgtcacttcgttagaaggattggtttgaatgaatacaaagtagctaggtggtttaatgtgttaattttgacgaacatttacacccatccagtgccatcagtagcatctgaagtccagtagatgagctctgcctgaagcccctaaaaagagtcattttgaagttttgaagggaggtttttcctatacactatccaacccacaaagagcaaaacacattttccttcgagtacataatgaattaagcgaaccaaatttcctacgagaataccgcttcacaacttgttcaagcagataaatctctgaatgctgaaatccattatgcattgttcagccggaaaaagaacaataatgagattactcctgtacagtctcttgcatataaacctctattattttaatacactgtagtaggagcctcttctgctgtttctcgtaaaaaaataatcagatgtactgctcaataacaagagaaattgccttcttacagttttttggccctaatgatggagtcatgaagtcgtcaacttctggtgcatagaggaccattcatacatagcctcatttgattgtctagcatcctttggaacacaggatttttttttttaattttcaaacaaggaatagaaaaatgcaggattgaggtgccatgacttgttgaatgccatacgaattgtacagaatgctgtttgtatgcctcacggaaaaaaaatacaggaaatttaataagatttatatgttgatttattagagagagaagggagtaagatagagaagaagtgcattggagttctcgaggggatttgtaaggcaagaccatatgttagaattcctccaaactgtggaggaatttttactatccttaaaaattattttgaaccaatttcacaatatttattgatctctcctaggaatttctcgtttggatcgaattcctctagttttccaatggagtcccttcaatccaaagtagcccttagccattcttgtataaactgtgatctcctgatgtctcccaagtcgaaaacaacaactacatgtatataagtattgcagagctgtaattcttgagataaatcttttggattcacatcgttttaagctgaaagagtgggaaaataacactccaacttgattttagagagagcacaagatgccaaaatggcagattggggatgcaaatagtgtaaataatagagaatgatggaattcgttgaactgatatattgagtgtctcaagataggtatatatagagggtaattttaccatccttaagaaggtaccatgaggttctgtaaaatttagtaccgcgagatacaaaaatttagtgtaaaatttaactaactcccgccagccgctctcctttcccccgccgggattctcaatgagttccccaccggctacctgtcattgttgtgcgtgttgtcaccgacccatctgatttggattcggagtcatcaccaactctccatttggttaaggtaatgtggcagatggttagggtaaactttaggaaggctagcaagattatttatttccctaatcgattaattaccgtcctagcttaaggttttaaggatgtgctatagctagctgccatagaatagagaaagacatgtctgaagtttatgttatttgctatcgattagagaaacacatgattgtttgaatggtatttgatctttgctatcgactacaacaataaagtttgctatcgaagacataaaaacaataatcagctttcttgagtataacctggagttttggcaactattaatcagctactaatggcatgagcacactgtctccaaatttagtctctttagattgttcagactaacaagtgaacataatgacaatatgttctgattttgatttgtcgctaccttatggtgtgagcagttagaagcaaaataattggttttgtcatatagttaagcttcaaattgtgcatataagaataattagatctgattactcgtagcaatatatgaagcatggcgtgatgggctggattggtgtgcaaatggagattctgtaattcaggctattgatgaattgaataggcaaaggaaaagaatatcagttcgagtactataatgtattcatatgtggagtgtctaaatgcaatactgtaactgaaacctgttgtcatgtcagttttgggctctccatcttgatccaatatgcacaatagtgtccagatactgtgtacccatctgtgcaaggaaaacgttagggagtcttcttctttagctagattttctattttccctaatagattatgtacctagtttaaggatttgctaatttctatcaattagagaaagaaaggatgtctcgtggagagaatgcgtgcaggtgatctaactcctatataattgttgtatttagcaccattatatatcttgaatgtattatgaagagatgagtttgtctaccttaagaaagttttgtttttaccttgttctttcaaatattcagttaggagtgcatcctgatgtaattcatttttaatcacattttctcaacctgcagaatctgaagattagaacctcatcaccatttgccataatccattcaagcagagcagttgctatgaagtcgatacttggacatgctgtcctgaattttgttgttctatgatggcttccagaaattgcaagagcacattattgatttttggttttttttagatctgtaagcaagtggtattgggatatggtgttttgtttggtataattgagttggtactttcaagttccttatagctgcactttgagcatgcccttaaactgtcatttactgtatactcttgccatcaccaatctgaattggtcagcaagcttgtgagtggggctgtgcaatcagcatgcaaacagattaattgattaattttgagccctttgctccgactggctgtcatttttttatttttgttccatgatagtgttcaatgattttttctgaaatgttataatattttaaaatttgtggcatcaagtgctgatcttaacatactttgcagctagttaagatggaggacacaatcattagatgtgctgccagatgatctagtttagtattttgtatgtttgatcaggagttggaacagaacaaagaacatattttttatcccaacttcataatgtactaactgatataaatgacaggtatatatacttgatataaatagtaggattgttgtgtgattgaaatcatgcaatcttttaacaagaacaaagatgcagaaattgtttatggttagagctgttgacactaaggatcagaagttgtattaccacacatttcagattcataatcagcagatgtatctaatgtctagccattacatatggtgaataataagatatgtcattgaactatattgcaacaatgaaccaatgggcattaccattcttatggtcaggtttagctgaacaggactcctcaacacaagaaatgatcacttcctaacttttattgctattcattcctcctcacattactagaggcgcaccattggtgcacctcatcttctagtggtatttgatacatcataaaacatattgttactataataaaaacctcatatagaggcactttcgttgagacgttttctaaattgcttctaagatcagaagttttatagtgtagagacactttataaattgcctagaaaatttttactctagagacattttcagctcagtttattggattttatctcgtagaggcattctttcggtactgtaaaatgcgcctgatatgtaaaggtattttcttgtgacattttaaactatgtaaagatactttttaaaatgacaatgtgtactaaacgactgaatataaataactaaagacacaaacatgcaactaatgacatggaattgagttggttagtgcattgaggataaaaaaaatgatttgtccaggagatcttgagttcaaggtttgacagaagcaatgagactattttattctcctcttttggactagtttcatatgtttgtggtacaatttaatgtctcaagaaaatgcctataccatcttatagttaccataagacacttattagacattttttaaaatgcatctcctcttttggactagtttcatatgtttgtggtacaatttaatgtctcaagaaaatgcctataccatcttatagttaccataaaacacttattagacattttttaaaatgcctctacagtattgtaaaggcatttgaaaaatgtctctacagtacttagaaaaatatctctataaagcatttttcttgtagtaatgactcaaaatatttcctcggatttcaagaaatgttccatgcagcatagcacaacaaacttaaatgatagaaaaacaacaccgaaagtcctcttttggactggtttcatatgtttgtggtataatttaatgtctctagaaaatgcctctaccatcttatagttaccataagacacttattagacattttttaaaatgcctctacactattgtaaaagcatttgaaaaatttctctacagtactagaaaaatgtctctacaaagtatttttcttgtagtaatgactcaaaatatttcctcagatttcaagaaatgttccatacagcagatcataacaaacttaaatgatagaaaaacaacactgacagtttttaacagtactgttaatgagtacaagcttgacttagtaaagttcgttacataagttttgcttttcacggcatccaaaatttattaaatgcataacactatcaaccataaagtactagacaacacaagatggttagatcaaaccatatcaatgagatcggactcgaaagatccaagcaatcgaatcctgagcttcaggactggccattcaccaataagcttagtgagaatgggcaacaaaactgacacaacgcaaattgcaatggccaaccatggaaggtgaggggccaaaactgtatataaaccagttgcgaatgcggtagtggttgcaaaatatgcaaaccacatgagcttcttagtaaaagatctgtagtaaagcaagaactgaagatcctcccaccttgctatgatgcatacgaaggcaacagtaagtgacgtgcacattgcctaggtgtcagatatcaagaatgcctgaaatgcaagctttctacccatgttaggaagcccctcacttccagcattattactgtgtcctccaggcaaggtaaaagcagcggcgaaggtgattgttgcaaggaggattgctactaaagaagtgttgcttgtgtatgtttgagtcaatgtccttatatccttccttgctttctcagttacttgatctttgattgtttttataagattatagatttcacctttgtcttccgggtcagctttcaacatacgcatggagacttcactctgcattaatttattacaaagttatgtatggccatggtagtaatatgattgatagtcatggaactatacacacaattttggtgcttgcccacttcccttgacctttgtgtttcaatttatgtctgccacaaatgtttgcaaatttaaaataaaactaaacaatttgaagtgtccttgaattactgatgatcgatgtaattcctataccatgttgaatataacagaactagttttagaatccagaaatgaactaaagccagaagctggaaaacatatctttttccaaattctcagaaactagcaaccaaccagctgcttctagtattaagctccttaaacagacctaagtcgatggctctacctgtggtttgagagtgtgctacgtgttagcagcagttgcctgctcatttggtgagtgataacgcaccattttggtaattaatgtcaatatagttaatgagtagtaatgtctgctagttaagaaaagggaattgtgctcatacataatggtgggtggggtgtgtaaatagggacaataacttgtaaatctgttgtcccggtgcagcaacttgtccattcaaatccggtgcacaacaaatccatacgagcaaaggccaactcaaaccccgatgcgcacaaccccctgttttttttttcgaaatatacaatctcttgtttttaagagattctatacccgtcatcgaaaacttatcattattgtggtcagtgacgggttataactcccgtcagatgaactcatatcagcgtatgatcactaattaagtcttctacagcttatccctggtaagtaattttatcaaacgggttacttttcaggacatgtttaggttgtagccaaaataaactttaccaagtttttagcaatgctaaaattttagcaagatgataatattagtaaaattttggcaggatttcttatgtattgactatggcaacaaattaaacgtatctatttttttaagtaactttgtaaaaaaaatggtatgattgaaaatgtcattaaagtgaacaggcccttaatcaatgagagaagtcacctatgatggatgacctgtcacgaaggctcatttctgtaacagtgagtgtatttttctccacttgtgaataaatttctctcataatattcttctatatatatttggtcagttatttctctacttcctgcacataagctaattaagtcttctacggtggtgctcggcatgatatactgacatgttgtactacagaaaacgtttttctggaccagactcccagtaggttccaaacggcccgtaagtgccagcttatgcaaaaatcgatttctccagacggatcttttaaggggaccgtaagcaaaaaaaaaaaaaagatttttttttatacggtcctcttaaggagtaacatgcaaaaatctattttttttctcttatgctctctctttccctcctcaccacttcaaaatttttcacccctctcctctctccctctcctgatatttctctcctctcctctcctcgtgttctaactcctctcctcctccaaatcagcgtgggcggtagcaggcggcgacgccgatggggaggccggccattaggtgtggcggcgggtgatggcgagggtgcgacagcgggcggctgcgcggcctccatgacagcgggcggcgccctcgggagggccggatccaccgccctcaggtgcggctacggccttcgcgacggcgggcggtgacggtggacggcgagggtggcggatccggtggtttcgccttcgagaagagggggggggaggatctgccacccttgggtgcggctgtgaccttggcgatggtgggcggcgacggtggatgatgacggcagcggcgctcttggggaggggggggtgggggt

SEQ ID NO: 39700 - DNA, 21050 bp, Oryza sativa
  unsure (1)..(21050): unsure at all n locations
cgatggctatggcggctgcaggcttgacggccagaggtcgcggatcgacgacggctgtgagcgacggcggctgcggggaacgacggcggcctaggcagcatggatctggcatggccagtggcgggcggctgtggtggcaggatctggcgtggcaggcggtgtgcggctagggtttctgcctttttttgaatttatatttttttggcgaaaatatttttgcatacggctggcttaggtgcctgcatgcaaaaatcctattttggcaagcggttgcctaacccgcatgggaaaataacgattttggcaaaccttttcacgcatacgggtcggccaaccgcatgcgaacatcgaagaaaaagtaggtttagtcactgctaaatgatgattatacctctccgcatctattttcttagacaataatacccattcatgtttatagtactgctaactgggatggttgtataaatagatctgcacctttcgatcaaatgagatcaacggttaagattgctttatagtactggtaggtaggaatgtagtgggactcttttctctttaacgactgaaaattataccttgcaaattgcttaaataggagatatttttcaacattatagcatcgtttactattttttaatatattagaatagaaatcgatgacatatatatagacgctatatatgttgtggagagcatatgcgtacgtacccagttgagcgtcttagcatggtcggcggcatcatttggtacccagattggggggttaccgttgctgtcgagcactgtgacatcctgggctttacattgcagtaaaagagcgacgatcttcggatggcacttccggattgcataatgaagggcagtttcaccgtttctgtctcgcatgttaatgagtttccgcagctcctttgactgcaaaacaaattccacaaactttatgtgacctttttgtacagctatgtggagacatgtggtgccatcgttttcaactagaaatggagcatctggacaatgtttaagaatctccatagcaacaccaacatggccctggtatgcggcactaccaagaagagggataccacttgtgctgattatatatcctaaagagaaatcatgttccaacaatacttttagcacgtcaatcttgttctcaagcacaccaaattgcattggattaacccgtgcgctgttctcttctcttgccaatttaggacgagtctcaataatctttttggcgatatctgagaaaaaaatgtgaaggcatggataatattaatggttaacaagcacatatagctagatcgatacatatagctagatcgatgagggtctcaccagtattgttatttctaaaggcagcatgcagagcattgtatccggaggttccaccgtgagcagaatcaggaacctccaacagtttatcgaacacatcggtgaaattcctcatcaccgcgatgaacatgggcgattcatcgtgtttgttaacagctttcgtcaaggcaggctctttttctatcagctcgaatgcaagcttcctgtgtcccctgcggatggtgtggtgcagcgcgttgcatccttgcttgtcttgcctcaccatcgcctccctcgtatcaagatcgtcatggcggcggcagtagtaactgagaagaaaagaagctaaagcgacattgccgctttttacggtggcgagcaacggcgtctcgccatccgcgtttacagtgcagaggagggacgggttcagcatcaagatatccttgcagaattcctcgtggccatgggccgatgctatgtggaggcaggtgttcccctgcactgtccttccaagcagaaggcttgggtcatgcagagccggcttcacacccgatgtggctgctttcagcagacctctgtccatcactggcgaatctgcggttgctttgctgtctggaatctgcatgcaagtaataaatgaatatgatgctttcctgttaacgacaaaatttggtaggcccatgagagaattatcacatcgtcaacagtcggattactgctatattcggttaaggaaattaatctattaaaggaagcttatgcagaagtagttcaagaggatgcgacatgacaaattatctattaattaggaataatttgttcattaccttttatctttagaaaagtgtgttcagtgtcctataaggattttatattttccttttattttttaggaaagtttttttcttgtcctacaaaggactagtatctccctgttgtcgaagcgacaaccgcgtacgtcgaaggacgtggttactcaacagtgttggaaaaagtaaatgtagtattttgagatttttctttgggatccccacttcacatgtccctacggggctatttataatcctattacaggttcccccattagggtttaggctttacaggggaatttacatggctgcccttatgaaagggacgtttgattgggtatacagtgtaatttggatacatgggcctctaatgggccaattggcgaacaggcctaagcggctgggatggccccttgggcctcttcaaagttgggcttgttatggcgaagcccccatccttcagcatacacccttcgcccaatgatgcatttggtcttgccagataccaacgcgattcttcagccttcgccatctctacttcatagtcttcgccatgggacttcgcccagatgatcttatcgtcatgggcctgaatcctcacaggttgcatggtttcggtaggtctggtcgaagggtctcatgacataccaccaacaagcccctcacgggcaagggtgagttatgagcttcggccgagaccgtgcaaaccatgtggtatggcatgaggcgccccctttcgaccgacgctcctgccgaaacctatactggagtcctgcaagaaatgtgtatactttgtgcatatgtacttttacggttagtaaattttcctatctttcgccttttgcaaacagcgaagccgttctctttttgtgggccgcaatgaacagtgacgggcttccctcatgggcttagcactgtgcggctcaatgaatgggaatttaccatttcgcaaagagagaatccattatttaccactgactttatcacacgtctacgatttgccactgactttatcatgttctacaatatgccatcgacttttgcttaacttctacaatttaccatcgccgtccggttagtctccgttagtactgtacaaatttttcaaaatgaccaaaatacccctgggagaaaaggtttcaaaatttggataaaaattatgaaatatcatatttcaagtttttggtcaaattttggatgtttacaatcttatgtttataatataatattttgataattttatccaaattttggaagtttttgtcataggggtattttggtcatttcgacaaatttgtacagtactaacggtggctaaccgaacggtgatggtaaatcgtagaagttaagcaaaagtcgatggcatattgtagaacgtgacaaagtcagtggcaaatcgtagacgtgcgacaaagtcagtggcatataatggattatctctttcgcgaacccttgtgacacgtggcggcttacaattgggtgggaaggcgaaccgacgcctgggtgggttatatatccccccaccctttttcaccgccacgcccctgtcattttcaccgcgagcattctctttctccgctctctcacttcacggcgttcttgagtcactaggcctttcgaccgttcctttttttttctccacaagcggcagatttcgccaccgctcgcacttttcgccatggcccctcgcaacccgaacccatcttacgtgacgggccctgatctcggcaggatcgatgatgacgccaccgcctatctcggggtttcgcttgtagacgaggatgagttgatgaagctggtcacctccggcgtgctggcggagaagcaggccttcgccttaggaaaggctgtggtgccgaagcccggcgacaaccggacggtggtcttcgctgtgttcttcgaagcgggccttcggtttccgtgcaacgtgttgttgcctgagattcttcgcttttttcaggtggagctcccccaactgagcccatcggctctcgtccggattgccatcttcgactaggcgtgccggcccgctggtttcgaatcgagcgccgggctcttcggtgctattttttacgccaccataaactcgaagacggtggtcactcccccagggacgaaaaagacggcgttcgagatcatgaacttcaatgttcgccccgagcgctctgatctatgcccgatcaacggcaccatgtccaagtgggatcgccactggatatcgaagtggttttaccaatccatccccttcgaggctgggtccgagtcggcgaaagctctccgatggcgtcgcagggcgatcgcgccgaataggaagcccaaggtcactgtcgatggtgccatggaagcccggttcgccctgcttcgcaaaatctgctcccgccttagctgccgtgacctggtggaagagttctgtatgcttcggatcttccctctctcccagacgtggcaagtcgaggtgagcccagacgaggaggtcgatggcttgccgaagctcgtcatgccagagggggcaaacagtgagtttttgctttcctatatgtgtctgtattttgctctttcctcctattcggcgcctaataagataacacgtttcgtttttgcagtgttaactcttgctcaggccgacaccgaagctcggaagatgatcggtgatgtgtcggtcaccgaatacagccagctacttacacggcaggcggccgaccgggcgaaccgagtgtacgatggcaatcttcctccccgggcgaagccgtataaggccaacggtgatgaagggacttccatgaagcggacacgcaggcaagttaaactggctccccggagcgaagggcccctgccactaccaacttcgacgccgatgatgaggacactgtcgatgaccatgacggcgaagaggaaggggaagaggacgagacggaggttgcggacgagcccgccgacaaccgcaccgagacgcgtgggtacaccccaactccaagcctcgaccatgtcaaaactgggtggagtcgaacagctcccccctccgccgaaaggatttggagggggcgaaggcgctggtttcgtttgtggcgggcaaggtggcgaagaggggtttggttaaaaagacctctaaaaaaatggggctcgtcgatgtcgctcgcgttttcagcgacgacgacgagtcttcggacgagacccctacttcgcctgctggtcagagcctgggttttcgaccgctcctggtgctgcggtcggtgttggcggggtgggagggagtgttgcccttgggacttcagcatctgctgaccgggtcgtgaaggttgcggccaggctcttcggaagccctgtgcgcaaaccggtggcctcgccgctcgccgtccagaagtggaaaaagacggttgccgaaacatcggcttcagagtattcccttgcggcgccacacttcgcccccggtgacttcgagactcgggcggaccttatccccttcgtcaagggggtaagtaatctcgtttctctggctgggagcccgagcctattcttcgagctgaacgagttcgacgagggctgttccgccatcaagagtttagctgttcgggtatgctattcatatttctttccttttagctgttgtttcgggtatgccattcatcttcgccctctttctctttgtcgaaatagattcttgcggctcattgttcgaccgaacgaaccgtgcgggctcgtcttgacggttttaaaggccgttttcgagctaaggacgacgaactgggtcgcaagagccttgaaatggagagcctcgccaacaccctcaaggaggcgaaggctgaaaacaagcggctccaagctgagcttgagaaagggagcgaggcaaaggccgagatcgagcgtctcaaggccgaggttaagaaggagcaagctcattccgccccctgaccgactactataatctcaccgagccgaagatggaggctctttgccaagaggtcagcaaggcagaggaaaccgcttcaacggaggcgcagcggttcacgcaggatatgtcgaaagccactgaatctgccaagaccgtgtgccgtacgcttcgccttgcccttactgacatgggggcgagggtgcgaggagtccctggcgaagatgcttctgccttcaccttctcggagtggacacaacaggctggtggtgcggtctccgattgcgccactgcgtacggcgattgttgtgcgcgtgtgtcggcggcctttacaatgggcctgttgcagtagaacggtagcgaacacatcgtcgagctccccaagtttgtgaagggggattgggaggtcaactctcaggacatttcgctcacacttcgtggctggcgcaaatagttctggcaaaaagaacgccgatccaccgccaaggtgcgcctgctcgaacacttggcaaaggcagaggaggcggagcagggcgaagagccagcggccgaagaaggcggaatggatgtgggcggtggggcggacgtcagccaaaatcaccccgaggtgtgaggctctccacccgttctttagattttttgtagatttctcttggcgcttgccgcggtgggcgaatgatgtaaatttggccggtggccctacccctttcgtattgtagccgaaaatggccctttttaatatatgagatagatgaaccaagtcttagtaaattatcatgtttcttcggctttgatatgtatgctttcattattctgcgcacaaaaaagagacgacgtttttcgcccactttatgtgctccgcctcgtcttaaccatgtgctttgccattggccttcttatgttttcttagcagggttttcgccgaaaggtgtatgttcggcctccttttggggattggcggaacaagaatgtgagaaattcgtcacggttaaaaacctgccgaagattaagtattcctgtcgcgagatgataataaacgccaaaagcgggcacaccccgggtgaaccctggacgactacgatcatgtccatgtggaacgtcaggaggacatggcccgcttttggcgaaatcaccgaaggactgatcgctaggaagcgatcgcccagcgccactatggcttagtttgtgtttcgcccccttctcctcttagggtagtgtataatattagtagtgatgacgaaccaagttcgccaaatcacacctttgggagtggagggtgttttgggggcgaagatataattttcttgtaagctaggctgtaaagcccgttactttctttcacctatagcatgttgtatggcatgtattctttgatattttttgaagttaataaagatgtgtttcatttccttttcgctattgttcgcatagtcacctttcgtgctttcgttaggtcgaaacatgtcggcccccttgcgtatattagcgaaataggtctgctgactttttagctttcgacttccgctttcgatctgtggtattccgcgctaaaagaagcgcttgtgttttcacataactcgagtattgcggtgttcggttacttatttcccgaaacaagctgtcgcggtttcaacgttcggtgagcgatgcttcggccgatttctttcgccccccggtgctttcgctgatcaggcgtttgccttagggtttttccacgatttatcattcacataagtaaaaaggcgaaagacacaaggattttatactggttcaggcctccaggttggataatagccctacatccattttttttgtcattttcctctttttttggtatttttgtgccgaagggcttacataacgagagttgccgaaaggcctatacaatagtatgtacatttttacaagttggcgaatggggtgccaccctttctagatatagaaacgcttaagagaagcagtgttccaggagtggtcgaactcttcgccttccagcatcgccaagcgaaaggagcccgtcctggacctgtgtttgatgaggtatggcccctcccacttcgattcaagctttccgaccaccactgggttcgccttcttccttaggacgagatggccaggcaaaagctgcatcggtcgaactttcttgttgtaagttgccaaggtgcttgtagcgtacttgcacatgtgttctattgcttcgactcttatcccttcaaggagttcgagcaacaactcgtgcgcatcttcgcctccaaagaacatcacccttggcgaattagctcctagttctattagggtcattgcttcgtcgccatagagaagcatgaacgggctgaacttggttggcctagtgggggtcatccgaagggcccagagaacagatagcatttcgtctagccatttaccctttgccgccccctcaagccttttcttgagcgccatttgcacgttcggccgccccatttgactgtgggtgcgcgaccgaagcgaacctgatttccaggtttatcccctcgcacatctctctgaacttgtcagagtcgaattgcttgccattgtcagtgatgaattccttcggcactccgaaatgacaaacaatgttcttccatacaaatttctgtactgctaccaaagtgatcgcaccaagtggttcggcttcgatccaacgggagaaatattcgattgctacaattgcaaacttgtacccatttcgcgctaccgggaaagggccgattatgtttagcccccatatggcggaaggctagaccggagcgataggttgcagctcatactggggtgctgcctggcttcggctatgccgctgacagctttcgcacttcttggcttgctcaacacagactttcagcacagtgggccaatacaccccctggcgaaacactttggaggcgaccgttcttgcggcctggtgcgcaccgcacagcccctggtgtattttcttcgccatttcctcgccttcaacgaaggagatgcagcgaagaaagggttggagcacccctgagcgatacaattgccctgagatcagcttgtatcttgtggctctgagctgtaggagcttcgcttctgcttcgtcctctggagccaaccgttcttaaggtacttcacgaacggtgttcgccagtcctttgggtcctcgcccagttctgcctggtcgattgccatgatgtccaggctctcagtaggcacacttggtgcgtacaaagacctcaaaaaagatgcccggtgaatgtgggcctccacaagcaacagacttcgccagggcgtctgcttcctcgttctggcctctaggtaagtgttcgaccgttatgccggtgaaacacttttccatagatcgacttgcctccagatacctcttcattccttcttcttttgcctcaaaagatttgtcaacgtggcttgccactagtttggagtctattcggatgagcaagcgccgaaccnnnnnnnnnnnnnnnnnnnnnnnnnnnnncagtacgacgtctgccgtgttgttggtcgtgttgaactacagccttatggcataccgaatcggcacgccccttggcaaaatgagtactgccgcggcacccgcccccttttgtgaccacgaaccgtcggagtacattacccaaggttgttcgacaggcttgggttcaggggtgaatgccggcgtccattcggccacgaagtcagctaggacttgggacttgatagcagtgcgggcgacaaaatgcagatcgaagggagataactccgccgcccacttgctgagccgggggaagtcgtctttcgggcacaccttgttgaggtctgtgaaatcaacgcacatgcgctatttgccgtttgacttccgcaccagtaccaggttcgccaactactcagggtggtcgatctcccggatcaccccggccttgagcagcttttgcacttcggcttttgctacttcttggcgatcggcggacatcttgcgcaacttctgtttccttggtttggtgttcggcttgaccgccagatgatgcatgatgagatctgtcgaaacacctcccaccttatcgggtcccaaggcaaagatgtcaatgtttttcttgagcacctccaggatgttttcaacttccctttcgcccatatcgcccccaagcgaaacaaatcttgtgtgattggcatcgtcgatctgcaccttgatcaccttgccatgaggggcgggtgctttgtacggtcatgcggttcggcctgtacattgtgcactgccctgctaattgcggccaaatcgccctatgatgtagccgaaggctgaagcccctgaccacgatgacgcctgccggactaggcatcttgagcttgagatagttgtggtttgagatggctttgaacttgttcaaggttgcacggccgaagatggcgttgtagttgtatgggatgtcgacgacgtcgaagagtatttgctcttcgcgcttgttctcgttcgtgccgaacgccaccgccagttgtacttgtcccaggacttgaactgcttcaccaccgaaaccacgaagccaggctgctgcttgagtgagggctagggtgggcaagcccattatggcgtaagcttcggcgaaaataacatcggccgagcttcctccgtcaaccagaatttgccggacttcgaagcccgctacttcggccaagatcaccaaggggtcttgatgcgggaacaacactccttcggcatcttccggcccgaaagagatttgctgattcaagtaccgtggagccccttcgtcggccgaagcaatgttgtgcaccattcgcagctacatcttcttctgcagttttgacggctaagctggcgagtcagcccttgtaatcacttggattactctgcgcttcatgtcttggcgctattcggccgggggtacttgttcttgagcagcctcgcgaggtgcttcgacagctgctccttgttgaggccttggatcttgagcgttgccacgctgtcgaatgtttcagcattgctcgatggtgtacgaagaacgtccatggtaagcgcagtagaggtcttttccgaccttcttgcgaacaggctgttgatggctgcccgcttgttgggcgtcgaactccttgcggagggcttagacttcttcgacagccatcacggtcttgcctgcgcggtcagttctgaatttcctccaagtcatgggggcttgacttggcctcggcggctgtccttggttcatcagctgaggttggcgaacggtgagaggagccggttcggcgacctgtgcttgtacttgggcttgagcagcagcgatggaggccttatcgtactcggcttggattgcttgccatcgcttagaatcctcttcgccccttgcgtacccatcaatgatacgaagcaggtgctcaagtgtctgcggctccttgttggcgatttttcttttgagttcgccttcgagcagcccggccgaagcagcgttgatgacagacgcttcggttatgtcctgaacttagcatcgggcttacgagaaacaacgcatgtactcccttatcgattcccccggcctctggcgaatgccgagtagatgttgctgcgtcttcggctcctcataggtgccttgaaagttaataacaaaaacatcgcgcaattgctcccatgagtaaatgctattggctggtaaattaaagtaccaagaacgggcgatgccatctagagcgagatggattacctttgccttggtgttttcgtcgccgtgagcggcttcgattgcggactcatagatggacagaaattccttcgggtccgttttgcccgagtaccgcggaacaggtgggaacttaaactggggtgggattggatgaatcttgattcccctgctcagcggtagccccttctcaccccctggcttgttcggcaccagctgcggatatggtgtggtgaagggtgaagtcatgacttgcgcatgaggttgggccatcgtgttcggttgcccggtcccgaacggcgacgcttggggaaccgccatggataggtcgaacgtacgctgtgtccaagccatggcgacctggttcggcgcttgattggttccgaagcttggtgccgtcgcctgtggttggacggtcggtgcttgaatggcagtgttggggtcgaactgcggtccttggctccaaggcgaagcccctggaccaggctggttcgacggtagccaactgggtgcaccctgacttgcattcccttccggtcagatcgaaggggttgtacttgaaatattgtggggttagttgagctggtgaaggaaagcttgaaactgcgcttgccaggctgaaaccccttccaccatcgcctgtgatgtctgtgccagtagcggaggatgcacttgggcagcaaccggccgaacttgtgcttgtacgtgaggggatgggtgtatggttacggctgaaggctgtcaggcgaagcacgctggcgcttgcatgacttgcagcggaaagacctggatcggcgcttgcggatagacttgaggtgggttatagcctgccgagtactagagaatgggtgctgatgcagccttagcttgtcgggccgcttcgtacgcctgctgctgcccttccatctgacgaagcatgtcctgaagtcgtgccatgttctgacgcatggcctccatgtcagcttcggcctgcgcgtcgaggttggggttgacttgtgcagcggcgagcgcggtcgaagtcggagcctgctgtggcgaagcagcttggggcgccacctgttggctcgttgaaaggatctccgccctggtctggagcacccttgctgttgcagccgtgttcggcgcctgccccgtcgaagcggcaggagccgaaggtggtggttgcagcgcaggtgccgaagccgatggtgccacgccagcttcaacgtcgggcgccgaaggctctactacctcttcggcggccatctcgcctcttgcttcacactccattcgcctagcaaccttctcctttgcgacattcttcggtggcattcgctcttagtggtttcactcagaggtccccatggtcggcgccagctgttgtcgaagcgacaaccgcgtacatcgaaggacgtggttactcaacagtgttggaaaaagtacatgtattattttgagatctttctttgggttccccacttcacatgtccctaggggctatttataatcctattaaaggttcccccattaggatttaggctttacaggggaatttacatggctgcccttatgaaagggacgtttgattgggtatacattgtaatttggatacatgggcctctaatgggccaattggcgaacaggcctgagcggctgggatggcccctttggcctcttcaaagttgggcttgttatggcgaagaccccatccttcggcatacacccttcgcccaatgatgcatttggtcttgccggataccagcgcgattcttcggccttcgcgatttctacttcatagtcttcgccatgggacttcgcccaaatgatcttagcgtcctgggcctgaatcctcgctggttgcatggtttcggtaggtctggtcgaagggactcatgacataccgcgaacactccccatgggtataaatatgtacacccaggtcattgtaaattatctccacgatcaataatactactctaagcgcatcgccaccctctttaccgaggtttttacttatcctccagtggaatttggcacctgacacggggctgcattagttcagttcgatctctagcgaagggataagtccaacgttccaccggcctaggcaattgtctcgtctacgtcggcatcgttcaaggctgcatcagtacattcgacctcttgaattgctctagtttggatgatatatttgcctacctatttatcagatgtctctgttaatctagtcttagcatatcaatttagctctattggctgcttctcgttttagggtttctgccggcatcggctaaattgtgttgctagattagattaacttagacatctaccacccttaaaatcagccataggcttgattgtccagatattatgtttcttttcatatttagtgttgcatcaactaaatttgatctattaagtcatgcttagaatcgtaatatctagcatgcttgttgactgccaataagggtttcatcggggctttagccgatgaggtatctggacgttgtatcggcttacaaggattacatacaatttggatttagccgattgcaataaagatttcactgttcaatctaatcttatggattttatgacatcggacctctagccgatgtatgctttatcctttggatcagtacttatcctatcatatcattattagccgattggtttctattggattatatgactgttatactgtattatcatcagccgattgcattatatcattatttactcaagtatcattatctacattggacatatagccgacatctcaaaactctatcgctatcggctagtatcggcatcggctggaatcactccatcggcttgtcaaccgatcagctcattgatcttcaatttgtatgttttgtcagttgcagggtcaaactgactatcacgcccgtatctcaccaagatttagacctgcactagagctaagcagatcttccatacctatattttttcgtgtcaacagtaccatctgggatggctcgtttttccgttccaatccaattcgtatcagtctgggtatcctgaacttttttacacgtactattttgctaaaaagacaaactctgaacacattagatttttttagcaaagtagtactactcaatcacttgtaataattacaagttaaacacttgtaaagttaaaaaatctaatcttaaggatggacgggtatttttttttaccagctgaagttaggattagttttttttttatggaggggtatttttttttttacttcagtttcatgggatggagcggtaggtaggagaaggttttaagagctacttcctccgttaaaaaaaccaacgttttaacatagtgatgggacattatacagtaccatgaatctgggtattctcatgtctagattcattatactgtattatgtcccatcgctacctacgttgggtttttttggacggaggggtataaggcaaggtgataaatgatactccctccatattttaatatatccctccatattttaatatatgacgccgttgactttttgaccaacgtttgaccattcgttttattcaaaatttttatgaaaatctgaaaatatttatgtcatgcttagtgaatatttgatgataaatcaagtcacaataaaataaattataataatgtaaattttttaataaaacgaatggtcaaacgttagacaaaacgttaaaatatggagttagtataaggcaaggtgacaaatgatgagatagctgatcagaagtggcaacgcgagcagtttttttttgtcaggagaggtttggtcgttgtctagccagtcgggtcaagcgcaatgaatgagcacgattgcacgaacgatggatgcgaacgtgcaggaggttggatgtggattagcggtacatgtcagctgggaaaactctaaacttttgtttgggtgtcattaattggttaccactctccccgactaaaaatataagcatttttatatttttgatacagtctttgagatgctacttggactaacaatatttacaagtaagatgttttaaacaatatttttttttgctttgattcctagtttactataatttcaccgtagtgttacagtcagaagtgcagtaatgtcctatatgttttacagtagcgtgacgtgttactgtacttttacgataattatacttcacgaatatagtaaaatgttatgagtttcctaataatatatatgttttgttttatggtggtagtgaaagagattagaatcgatcactatattcctttctcacaaagtaagataaaaaaacaaacaataatccttaaaacaaatatcatcattggatgtattggtaagaataacttggtatatactgtgagatcatagttcaaatcttgaattcactaatttatttttttaattttctataaaagagaaaaaaagaaaaaagggagagggaggaggaagggcatgggagagcagagggaggcgcacaccaggaggagagggggtatatataaactattataaaaatattataaaaattgaagatgtttctgctaaaattttagtacgtcatccgcattttagttgattttctaatatttatctttatctctaatctatcttaatacctaatacctaataaaaaaataagcaaggattccatgcatttgatttcatatgtcgtctctacgtgtctaaaccattgtcgtgtgcctccagccgccgccgtgccgcccgagccgaaccctaacacagccgccacatcgatctacctccacatgcattttctcctctaattaattaaaaaaatggattctccactcctcaatcatcctttcccccatgatttccccctttcaatttggctttaattcactagatttcaactcagtttaatggtagtgaatgatgctcggccggtgatttttccccggttgtttttatcctctgagttttgtggattcgctgcgtttttaggaaaaattgaaagaagagatcaagttgatcaaaagccctcaatcaatttgggagaccgagaaaggaagatcggcttcggcactgtacaggcacgaaactttcttccggaagttaagacaggcagacagagcgaagaggggtaggaggcagcgcggtttcaattataatatatagcgatactaattcttagtaactattgtatcactggaaaaaaacacatttacccgttgtaacacacgaacatttttttagtgtctatacacatatatacacatatgtatatgtatatatatgtgtgtctatgtgtgtgtatgtatatatatatatgtatatatatatatatatatatattaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatgtatatatatgtgtgtgtaagtataagcatttttagcatagtaacaagtcaaacatttttaactttgactatgttaacgaccaaatttggtaagatatgaattaggttcgacgttggaatcgaagcggattcggcggattcggcaaagagttagatttgaagaacagcgtatgcgtcggctgtgaaggcatcggctggagtctgaatcggctgagatggatcggacagaggataaccgatacagccgatagagttggtatagccgattctgataaagatggcttcgaggctattcctagaatcaattaacgtgcttcataaggattgccacgatggagaaaaagcttttagaaagtcaattgtagctattaataaggatatctcatgtaaattctttagagatatgtttgggcaaaagtctgccgcaaagacttatggtatcttagagtttgttagagataagaatcgtgtccggcaaggacatatcttgtaatctcggatataaatatgacccgagcctatgtaatcaaataacacacattcaataacactttcggcgcatcgccacccttttattctatttcgacgagttcttgctttcgggttgagctgcattgattcgatcttcaactagaggtaaacttgtcaaggcggtttgcgttctcgggattagtgcttccatctttatgacactctaatcttgtttatgtaattcgtcgagttatcatatatactttacaatctttgttagttgtgctatataacttgtcatcggctagttcttgctgttaagaagtaaccgatagggctatgttttgttgttaacttggattgtatcgggtatctaccatctcttagaagttttcatcatcttgtttagatcctacagttatctttatgcttaatgctgcatcggttaagtttgagttcgatctattaagttctatctataattgtgatatctagcctgttttataataattaatagagatagtatcggggtttcagccgatcttacctgatttagctactttatatcctatatgttcgattgatatgctaaatctgccatttatattaagatcttattgcattaaggtatattaggcttcttgtttgatatattctgcttgttctaatatcttagtatagagtggtatcggagtattagctggtacatgctagatctttttgatcggctatgctataaacatctatataattaatactttagtatatatttcgacttaagtgatttatactgtctcggcacagcgaccgatctatcccaatcacttagtttaaatatgtatcgaagtagagattatatgttattaatatctatagccgatcgagtagatttagtcttatttcattcattaatgactgccgatcgattcagatatgacatcggctcagagataaatgatatatcatcggcaactagccgatcagctatcgtctatagatttaaccgtgtttttcttatctttctttcttattgattgcaagatcaaatcaactggcacgcttacgaatctaaaggcgagattttgaacctgcacaggagttaaacagatcttccaggccagtgtatgtttttcgcatcaacagactattaatagaaaaaaaataaaaaaggtcaatcatataaaattgatgtttctagatttatcattagacaagctatcataatatgcaaatctttttatttaaaatattttatttttattgatatagttggtcaaagtagcatatcgaagatcgtgtcagagtccaaaagttgttatattttgagacagagggagtatataataccgcttataataaataatgtatagttagatgtaggatggtggttataggcagaatgtggagaaatttgaattcgaagtggttgatatgacaagtagcactatcatagtgataactattttactataacttttaaatactataaagatactaacaattataggatggtggaagtacatacccagatgtggtcgatgtcatcgtcctttctgctagctaaagcttcagttaaaaccgaggtggccgtctgaccgtcattgttaagcagtgtgacgtctatgccttggtgaagcaataaagcagaaattatcctcgaattaagcttctctgctgcgagatgcagagcagttcgtccgtatttatcttggatgttaacgagatgccgtagttgttctgaccccagaacaaaccgaacaaactctatgcgatcagagtatgcagctgcgtgaagacacgtccagcctgtttcgctgcagtatggagtatctggacaatgcttaagaagctctcgagcaacagcaacatggccgttacgtccggcggtacaaagaagactactgccttctctgttcattagataccctacagaaatagttttagttgatcccattcactttttttcactatgtgattggtatccctcttattttaatactaacgcatggtattttctctcatagaataacatacatgttttctcaatgtattattcaaatatattaaaatgacaacataattttaaattttgtactaactttacgaaactactaatgtgtaatatttatattgtattttacatacatgttagttattaattatttttaatattaaattttagttatttgtaaattatattcctatatggactctagattcgtctttcaatatttctttgttttaattctgaatttttgttatctgtaaattgtatttctatatactccctcttttccacaaagagacaaattctagcatcccaatgcatcactaaaggagaggataaatgtccaaactaccccttaatattagtaaattagtattggtgggtaggtaggtaaggggtattaaaggaataaaattttttgatttgtgaaccgagagtagataagaaggtagaggtagatttattttcggacaaagtttgaattgtagaagttgatttattttgggacgtagggagttgactctaggctcttcttccaataatatttttttaattctgaatttttattatttctaattatatttctatgtggacttaaactcatctttcaatattcattaatttttaatttcgaattttacttctaaattgtattgctatattactttatactcttcttcccatgtttcttttcaattttgaattttatttatttgtaaattgtatttttatacgaactctaaactctacttttaattttattatgtttattccgaattttagttacttttaaattcctatatggactctatgctctgcttctgttattccttatttttaattccgaatttctattattccttaattgtatttctatatgaactctgtactctacttataatattccttatttttaatttcgaatttctattatttcttaattgtatttctatatggactctattatcctcttccaatatttcttattttttaattccgaatttcaactctttctaaattgtatttctatatgggctctgtttttctttctctcctattaatatgagaatttctaggataagccaacaagaagatcaaaacattcaaatgaactgtttattatgcagtcgcatcacatataa

SEQ ID NO: 39701 - DNA, 2021 bp, Oryza sativa
ttaggagtatataagctaaaacaaataagtagattattatgatagattattataatctataagccagattagtataatctaatatactaatctataagccaaattagtataatataatagattagtataatctataagccagattaatataatatgaaaattatggttggattttttttccgttcgtacaagtttaaaattttcatattttttctccataattctaatgaatttttaaggcgttttatgttaggaaacaattcacctacacaattagttggcttgtagtccaaaatatcaacaatagtttgcagctaatttctttcttttttgtatgtttgtttgtttttgttcaaaacaatatttatttgaaataagagtaaaaatatattagtatgtgtagtgtgcctataaattttgaaatgtttttaataaagtttatgggcgattgtgatcaacttagctacttcaggtagagcactaggtcatatgcccactaggcaaggacacaatgtgcaacgtgcaaagactggaaagagatctttagaggcttttttagaacaaaagatagacctgatggtctattatcatagcaaaatattttttattaaaaatagttcaaaatagtgggttataaattagtttatatagatcataaattgctaatttaatggtacaaaataaaaggtgcacctaactaagaattataattgttaatataatgggtaaaataatatgattttataaattttcttttttaaacattgtggagctaatttagttacgtatatatgataatatatacaatctatgtttataaagtcaacttaaaattattttcactaataataattgtgatctcatctattcagggagaaaagagggaaggagaccgaagcggatgtattttttaatgataaatgtaatttatgttttttatctttttatgtttttaaattatactacctcaatgctaggaaaatacaacaagaggtgaactcactctttgctcaacttaacccaaattttagtgagagttttatactacctaaatgctctacctttatattgctatggtttatatctgaaggcatcatcactacgccaagaaggataggttaccttgagaacgttctcaagggttacaatatcattttccaataagaagttagagtaattttacttaaggctgtgcaggagctgaagggctgtgcgcgaacccgagaaaactttttgcattctcatttatgttagccttgattacttggatgtggtttcttatgttcacactaagctaggagggatgttcctagtataaataccactctactttatccattagacaacttttgttcaattaaaacctcatgtactagatgggtaccccacgtgttgctgcaggagaattgtgtgataatatagtatatatgagttctaaaattttcttttttccctactatatgattttttcatgtgtttatttttttacctttatcagttatccataggttataaataattgggttgtatggtatgccttttggggggggagagatgtaatttatacccttgataaatcatccaaagcctaaaaacaatttagataatgcgaagaggtgcaatttacacccttgatgaatcatccaatgtgacggagcgtggggctcctcaccgggagaccgcacgggcccccctttgccggttcggccgggggctcagggtgagatcccaagctctctgtgtatgtggaaagatcgcgacctattgaaagagcatgaagcacaagcgatgtatacaggttcgggccgctgagaagcgtaacaccctactcctgtgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttccaaactggacttttcttctcttcataaatgg

SEQ ID NO: 39702 - DNA, 19493 bp, Oryza sativa
aagctctcgtcttgacgggatggggcgaagcgtgcgtcagaccgcctgtcgccacctaacccgcgattgaccggtctgtgactggtcacagaccggataaacgagtggagtgcactgtatttcgtgcggcgtgacacgtttagccgagccgcaataaatgcggttaggtgagccctgctgtgctcacctaacccatgcacgcggagtagaacccgcgaggggtcggggcgcctcggccctcgggggcgaggcaggagtggtccgacccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcgcatcggtaatggtaacttggctgtcaataatgggcggtctcttcaagactgtcacctcacctgagcagcgcccaaatctgggcgagccgatttgcttcgcctggagatatggtaacgtcgcttcggtcggcgagcgtaattaacgcgcgcacgatacgatctatctcggctgccacaaccgcaagccgctcgggaggaggccgcccgggctcgccaagccgaagaagccgctcgggaggaggccgcccgggctcgccaggctgaggcgatggcgacttccgaggcagctcgcgatgaggccgcgggcgcgtcgcttgggcccacctcctcgggcgatgcccaggcgacagcttctaggatggctcgcgacgaggccgcgggcgcatcgcttgggcccactccttcgggcgacgcccaggaccaaacaggtccgggggacatccccgaggccggcacgtccattggcgggccgagccgcgcggcatcttctccaaggcagctcttccccacgccttccgtcgccccgctgagcgcagagccccttctgcaggccttagccgccgccaacaccgcggtgttggatggattaagcgcccaggtggaggccctgcaggcggagcgtgcggagctcgacgccgcatgggcgcgtgtcgaggaggggcggcgctcggtggaggccatggtggaagcaggccgcaaagcacaccgccggcacgtctcagatcttgaagcccgtaagacggcgctggcggagatcgcccgagaggtggaggaggagcggggggctgccctcatcgccaccactgtgatgaacgaggcgcaggactccctccgccttcaacacgggagctgggaggcggagctaaagaaaaagctcgacgccgcccaggaggtccttgatgccgccgctgcccgagagcagcgagcaacggagaccgaagcggcgctccggcggcgtgaagaggccctcgaggcacgcgccatggcgctggaggagcgcgcctgcgtcgcggagaaggacctggcggaccgcgaggccgccgtcacctcccgggaggcaacgctggcggcgcacgagtctgcctgcgccgaagaggagtccgcactccgcctccgcgaggacgcgcttaccgagcgagagcgagctctcgaagaggccgaggccgaggcgcaacggttggcggacagcctgtccctccgtgaggcagcgctgacggagcaggcgcgccgcaacttggaatccgtccgcgccgagagagccacgctggagcagcgggctgccgacctcgaggcgcgggaaaaggagctggacgcgagggcacgcatcggcggggcggctgcgggcgaaagcgacttagccgcccgcctcgcagatgccgaacacatcgtcaccgacatgcagcgcgcgctagattcatccgccggggaagccgaggccctccgcttggcgggcgagatagggcccggcatgctttgggatgcagtctcccgtctggatcgcgccggtcggcaggcgggcctctggaagggccaaacgatgaagtactccaccaacttgggaggcctcgctcagcacctctcaaagatggccggagctctccagcagctccccgaggagctcgagaagatcatcaagtcatcctcgagggacctcgctcaaggagcggtggagcttgtcctggccagctaccaggccagggaccccaacttctctccgtggatggcgctggatgagttccctcccgggaccgaggacgacgcgcgcgtgcgggtcagggatgccgccgaccacatcgtccacagtttcgaggggtcggcccctcagctcgcgttcgcccccaactccgacgaggagggcgacgccagcggtgctgacgaccgtgacgacgaggccggcgacccgggcgcatcggattgagcccccaggcccccgctaatctccagtttttttccttttctttcttctaaggccttcaggcctcttttttgtatagatcaacttaatctgcaatcaaaaatgatgaaaattttctttgtgttaattttattttgctatgcaaatgagatgaggatgatctgtgccgtggtcctcttttgtgtcttagcttgatttaaggactcgtgcccaagtcccagccctcgaaaggcgcgggtcggggctagtgcctggggagatccacatgtcgaggctggccaggccgggaacgtggtgaccgagggttatgggtgacccgattgtgggtttttgccgattcccccccggagttcaccacgccccagggcacggctcggttctgggccccgtttggcgattttagctgaccgaaccgagcccccgagggcaaggttgagcacgagtgattttatttcaagtcaaaattcttcaaaaaggaaaaaacggcacagatacagcccttaggaaattgaaactgcttttattgaaatactgaaataagagaaaagagaatgtgcatgtgtggcagcccccggccaaccctgcactcccgaggggggggtgcggggttggcccgagcccgaaacctgacgcccgacccccccctcaggggtagaagcgacgaaggtgttcgatgttccatgggttaggcaactcagtgccgtcgcccgtggccagccgtatggagcccggccgggggacgccgatcactcgatacggaccctcccacattggtgagagcttgctcaatccagcacgcctttggacgcggcgtaagacgaggtcgtcgacgcagagtgatcgggcccgaacgtggcgctgatggtagcgccgcaggctctgctggtagcgtgcggctcggagggccgcacgccgccttcgttcttccaagtagccgaggtcatctctgcgaagctgatcttgatcagcctcgcagtacatggtggcccgaggagacctcagggtgagctcggatgggagaaccgcttctgcgccgtagacgaggaaaaaaggcgtctctccggttgctcggcttggtgtggttcggttcgcccagagcaccgctggcaactcctcgatccatgaatcgccgtgcttcttgagaatattgaaggtcttggttttaaggcctttgaggatttctgcattggcgcgctccacttgaccattgcttctggggtgggcaggtgaggcgaagcagagcttgatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttagtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccggaccaggtcgaccgcgtcattgagagctgtcggccaatagaatccttgacgaaaggccttgccaaccaaggtgcgcgaggcggaatgggctccgcactcgccttcatggatatcagcaagaagctcaacgccttgttcccgtggaatgcacttcaggaggattccattagccgcgcgccgatagagggtcccttctaccagcacgtagcgtttggatatgcgatggacgcgttcactcccttcgcggtcctcgggtagagtcttatctgtgaggtatgcttggatctcagcgatccaagcaatcaatctaagggagcttggagcgctcccttcgggtcccgaggcctggactccgacgggcctcgggggccggtcaggcacacccgtctcccctagggggtcaggtcgcgccgacggctgggtaagcctttcttcaaaggcgcccggtggggtctgggctcgcgaggacgcgagccgtgagagttcgtcggcaatcatgttatcccgtctgggcacatgccgaagctctatcccgtcaaaatggcgctccatacgccgcacttggcgtacgtaagcgtccatctgcgggtcagagcaccggtactccttacagacttggttaacaactagctgggagtcgcctaacaccaggaggcggcggatccccagtccagctgccactctgagtccggcaaggagtccctcgtactctgccatattattggtcgctcgaaagtcgaggcggaccaggtatttcaggacgtctccagtcggggaggtcaacgtgacccccgcaccggcgccctgaagagacagggagccgtcaaactgcatcacccagtggccggtgtgtggcggctgcgaggggtccgagttgacctcggggattgagacaggctctggagccggggtccactctgccacaaaatcggcgagggcctggctcttgatagcgtggcgtggttcaaaatgcaaatcgaactcagaaagttcgatcgcccattttaccacccgtcctgtaccctctcgattatgcaagatttggccgagggggtatgacgtaaccaccgtaactcgatgcgcttgaaaataatggcgcagtttcctcgaggccatcagaacagcgtaaagcattttctgggcctgagggtatcgggtcttggcgtcccggagggcctcactaacaaagtagacaggccgctgcacctttcggtggggccgatcctctttgctaggggccgtatccccggggcgctcttcgtccaagtggcctctcggggcgcactcgtcttctgtgccgatgacctcggggtcggaggatgacaggggcggccttcccacagtggcctcggggccgtcctgtgggtcgggggctcctggcgtcgtcggacaagcgggcgaagggccgactccggtcgtcaggggccttaggccaccgttcggctcgggggcctcttctccctgctctttcccgggtcgagtcagcacagggttagcctcggggtcaaagggcgataggtgcggccttcccgcagtggcctcggggccttcctgagggtcgggggcacccagcaccgtctgacgagcgggcagagcgccgactccggtcgttaggggccttaggccactattcggctcgggggcctctcctccctgctcactcccgggcctagtcagcacagggtgagagtgcgcggaatgaggattgtcctcatcgcgctccacaaccaacgatgcactaactacttggggggtcgccgctaagtagagcagcaggggctcgtttggctccggggcgaccagaactgggggagagctgagatacactttcaactgagtgagagcacgttcagcctcctccgtccaagtaaacggcccggagcgtttgaggagtttaaataagggtagcgccttctctcccagcctcgatatgaaacgacttagggcggccatgcaaccggtaacgcattgcacatccctaagcttgctgggggggcgcatccgctctatagctcgtatcttcttggggttggcctcgatgcctcgggcagagaccaagaacccgagaagcttgcccgcaggtacaccaaacacgcacttatcggggttcaattttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaaaggcattgtcgtataacaataagttcctacgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgagcatatccgccggtctatatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcatcgcacgtgactatccgctgcctcggggcggcgggggcagatgagccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccataaacttcaccaacgcgggcctccccaggaccacgttgtagggcagactgaggtccgccacatcgaagtttacccgctccgtgcggaaattggcaggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctcctcgggcaacgcacggtgggtggtcggtctggtcgaaagtgagagcaacctccgaccaccgcgcccggcgcgtcgccttatgagtaggggccgcggccagaagctctcgcttcatagccttgaggctccggcgagaaacatgagcacacgctcctccattgacagtggcaatggtggccccaggctcttggaaacctaggtcatcatcgccatcatcgatgtcctcggcgggggccttctgcttagcctcacttcgccgatggccggaaggaaccgccggggacttgccttcccggcgctcctgcctcctctcctcctcccactttcttgtccgctcagccaaatttttgactgcgcgacagtccgcaaggtcatggagggaggtattgtggacggtgcaccacttgccggtggggcgctccctgctgggagcactggcctccttctttttgtcgctcacaggcctcccctttcgggtggcccgcgaagcgccctcgacagcgaggacatgaccctcgtcgtcggaacggactgtcctcttcttcctcctcctgtcacgccgccctgtctgagcggcggatccgggggcggccgaagcagccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattacggacttgacagaaccgctgaatgtacgatcgaagtgactcgtcgtcccttcgctgtacagcgtgcaagtccgcttcctcaccggggcgcggatatgtgccctggaagttcatggtgaactgttggcacaaatcctcccaggagtggaccgacgcggggggcaggttcattagccaaccccgcgcctgtcccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccttccgttgcgtgggcagcacttcggtcattacgccggcgctcgatgctggcgcgggcgtcctgctccccacgcagatcttcccgggtcgaaggagtcgatgaaggagtggcagccgaacggcgaacagcggctgccgctcgtcgtgccctccgtcttgacgacgcggagccggtggtagcagcaccagaggtcttggtggcggaggatcgcccaccagcgtctaggcgctgccgcgccgtcatgaccaatttggccacgtcgtccagccatcgttgggctggagactccgggtcatgggcgacaggcgggtgacgtaggagcgcgcccgcagcttggagcgcgccctggggcgtgctgccgtcaccatagacgaggaggcgacgctccccatctcgccgccctttcccagctcctgtggatgccgaagtcgcggacccttcagccctcttgggtgccttctcccgcccaggactttggcgtggaggaggcggtggagtacgagctcgacggcgtgggttcggctccccgtcgtcgccactcacactgggagagaggtcgggcacctttgcttgctcagccatgaggctgaacaggaaaggcttggtgcacacgaaagagcgcaagagctcagaagacacacgctgagccccctacctggcgcgccagatgacggagcgcggggctcctcaccgggagaccgcacgggcccccctttgccggttcggccgggggctcagggtgagatcccaagctctctgtgtatgtggaaagatcgcgacctatcgaaagagcatgaagcacaagcgatgtatacaggttcgggccgctgagaagcgtaacaccctactcctatgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttctaaactggacttttcttctcttcataaatggacggagatttgcacggttgtcctccgaacatccttctgacgggacggcacacacctacctccacttctgccggaggcaggcgcgtcgtgggaacgtggctgtgtgctgacgacatgagcagtgtcagaccgatcacaaatcggtcattcttgtccaccacgcgtcagcttagcaacgtgcatgtttgcccttcttcacacaacatcttgcctgtaatggttaggatgaagcctggcatatatcgaccggggctaacgtgccatctctgggatgtaacacgctaactccagctggggacgagtgcctagaagctctcgtcttgacgggatggggcgaagcgtgcgtcagaccgcctgtcgccacctaacccgcgatttgaccggtctgtgactggtcacagaccggataaacgagtggagtgcactgtatttcgtgcggcgtgacacgtttagccgagccgcaataaatgcggttaggtgagccctgctgggctcacctaacccatgcacgcggagtagaacccgcgaggggtcggggcgcctcggccctcgggggcgaggcaggagtggtccgacccccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacacaatggctaaaaataattgagatgatgcggcttcaagagagaagagagaaataacattaactacacttagtggggatgaactttatagatatactaggtgattccctgcgctttactgcaagaattactaagtaatttctaacatatatatctttcaacaatcgagcaagaagtaagtatgatgttaattattaacaacaaataaaactgattttttttcaagccatatttgaagagaaataaatttaatagactttgtagaggattatagatgaaatttatgttgttggccaaaatttgtatcgcaagaagcggaagacaggggaaaaagaaatgaaaagttaggatttattagtagtaaacatgaaacaaactaaataatatcttcgctttgatacagaatatatggatgtatgtatgttaagtattataaaaaatgatggatatatttgttgaaatattatggaaatgatgagagaggtgatgattggatctatttgcattctgatttgtagaattaaataaagtatggatgatattgcatgtttgtatgaactatttgataattagttgttgctagtgaatgataaggtagcatgtttgcatgttgagctttatacttagtgggctttaactttataaaaagcatagatgagagacgattgttgaagattgcataagtgtcttaccccctcttgtgtggattagtcctggattatggttctgtgattgcttggtttgatgggtcggaatccaagaggattcggatcgttctcaccctcaccacttggtcgcatccaacccttgcaggtataaagctagttatcctcttgtgcacggtttacaccggtgctctttggttcaaaacctactaccgtgaagatcgagcctccccttgcgggtgtgtttgtatcagttacctagttctacttggataagaggatactcaatgatataaatacaagactccctagaaggaaagagacacgaggacaaatttagacaaacccaatgtggacatgagggatctagagatatattcaatttcgtcgagttcatgtttgaggaataagactgcacaagtcgtcgatcacatgtgagagctccatgctgctagatcgatagggactagattaggtcaactcaaatgttgtactcgtgtgagactaatatataaaggcaacaatgactccggtcaacaggagaagagctattacctgtcagttaaggggtccgaacctatataaaaatcgatatattctgtctcttattcctcaatcttgtgcataccctagcactaacaatcctcatactctacaaataccatagatagatatagctcgtcgacaagtgatatacgctctataggtttgtctcaaaaagcttctgattcgcccacgagacagatggttaacttcaaatcaatccaaattgacctagaggttggtctgatctctaaattggctccgttagtggattttgggtgtgttcgctagaacaagttcccatccggaacagtgatcatggaaaatagagcaatccattagcgcatgattaattaagtatttgctttttttacaaaaatggattaatttgattttttaagcaactttcgtatagaaactttttgtaaaaaaaaaacaccggttagcagtttgaaaagcgtgcgcgtggaaaatgagggagaggggttgggaaaagggtcatctgaacacagcctttgtcctatcccaaaccccatattgatttagagttctctagatcgagatggttggtgactctattaacatcgtaaatctttagctgatgggtaataaattaaggagtacttatagtatttttagagcatagatgggtaacttatagtcttcccacttcttcttgatagaaggacgttcgctacactacttaaaaaacaatgttcttgtacagggacccatttagattgcagataactagtcgcgtctgcgaaaatcatcctccatttttgtgtgcggttctgtgtgaaaaccacatgcaaaaatcaattttcgcaggtgggcctcctaatagacccgcacggaaaaatactcattccctatgaacctgttcaaaaaaaaaatcaaatttcctttctcctctccccccccctccatcttctccacactttcctctcctccgctcaatattctcctcacttccgctaagctagcaccacgcggctgcgtggacctcgcatcctgcaggccacaccaccggcgccagcgccactttctccttcttctctggctccgacctctttgcctccttcggctccggcagcggcgggcttggcggtaggcaaccgggagcggcgggctcgatggcgtgcgcacggtggcgagcgaccggcccctgcccggatccggcggaggcacctgcccccaacccggatctggcggcggtagccgtcccctgccaggatgcggcggcagtggtggccggcacggcggtaacggcgggtgggcgggctcggacggtggggaggcggcggatccggcaacagcgatgacgacaacgacgaggacgaccacgaggagggtggcggcagcaactttagggttagggtttttttttggattttttttcggtttttcatttttacgtgcgggcaacataaccaccgtgtgcgggtgcgccacccgcacgcaaaaatagcaatttttgcaggcacttcgttacagacgggtggaagatccgcacgcgaaaatcactttcgaccgcacgggaaattcgttattggactagtgctaactcctccgtgtagacggtcacctatgcaaatcaacacatctgctgacgaatccaatgctgattggtattggtataggtttgaaggcaaaacctgattggtatagtaaaaacgtagatatgtatactcgtccatacgaacatacacagatacaccctacccgcatgaatacatgagcatctacaaaatatcgggccagcatatctcgaaattgatgatgtttttaagaaacaaaatacaaatgcaggcacatatactcatccctataaacatacacaggtatataccctacccctatgagcacctccgaaataccggaccaacatattttaaaattgatgacgtcaccacggatatcttgctatcgacggtagatcacctaccactacgactgaaaaaataattacccgtaaatgctaataagtttaggactacgactgaaaaaataattagccgtaaatgctaataagtttaggacttgaacatgggtggcctggattagctgtaaagaaactaaccaattgagaaattgcacagctacatctatataaaattttcaaaaaatttttatatgtaattttcttttaatagatattaaatagtaatcttggttgccttaggattttaacaatcgaaccttatcatcatggagtttcacgcgctcaagtgtaccacgtctacaccttttgttagaccggtcaatctctatctctatctctacttatctacaattataaaaattaagagaatttttactgtccagcagaatttttggtaccgcgtggtactgcaatcgtaaccgtccattcagccagatcaaacgacccacaattgtcggtaccgcgagttacgggaatccggtgcggggtacctccccctttgttcacgtgtatggaactggtggaagggcagaattggattttcgcgtggttagtcaatttttgtagagacggtacaagtccccaacccggtaatctgtctcttcccgatccccttccgtcatccctagcagcggcgcagccaatctcgccggacttcgcttcctccctcactgcaaccagccgtcgccaacctgcccattcccaacttgcccttcctatagccggtccaggtctggccgccgccgacttctgggagtcgttctatccctggatgacgacaacctcaatgcgccaacaagaagaggtgaccatggcgacgagctcagcgtggcgaatatggcctcggcagctcgtccgccgacgccatcgcaagcctttgttcgtggaatcgccatcgctgtggtatgcattggatcgcgagcactagcaaccctagaaggaggggacagaaagaagaaaaaacgaagctagatattgagatggctgaaaggcttttggccatggatcgcacaagcaagaagaaattgggcaagcaaagaaaagagatcgaagaatttcagaagtttgtttgtgggatcactagttgtaatagtgtccattttattcaagatagttgacaatttgttcaatgaccgctgatgttaattttgtttaagatgaaacagtaagtttaaggtctacaacgaaagaacagtttacacatcagagcaagaaactacaaactttcagaacatctacttcttttttactattattacattcatactttcagcaaaatcaagtaggttcattacatatatcaaaagacaaggaactaggtccagaacttggcacacaacataaatcaaactcagcctctcccatcaacatagcagattcttccaatgaatatagcagcaaagcaatgtccagcaggaaagaaatacttcatctctctcatacatcttccataaagaaactcagggtatcgtgatcctgtgccggagactgcgtaggtgccagcagccgagatgcataggggacggaggggaggggacaagttgtggccatggacaaaggacgagctgccgcaccgcacaggggcagccgagaggcgtaggggaggaggggaccgaggggaggggaaaagctgcggccaaaggaggagccgccacaccgcatcggaggccggaagaggacggcacttggacaccgcgtcggagtagggcgaaaggattgcggcggtgacgcggcgtagacttcagatgcggatgcaacgcgtggcaggagactgagtcctcgcgagattaagtgtaacatcctaaaaatcctcgataataaaaatcactaaaattttaaactttttaaaactttgcatcatgatggatgttatggttgatattgcttgccaaactataaatcatctcaatggaaaaatcaaagtaaagacgcgcatctaaataataattacaatttacatgaataccttgttatgcaaataagttcaaccaatgtgctattgtattaataatggacccattgaatattttaattaattttaggactatcaaaaccccccaattatttaagttaattttggaataatccaatatagagtaatatcatttggtagagatatgaataaataaataaaaatgcaaattaaaatatttgtatttgggatgatgggaagcaaattcatttggggactaatgaataaccaaataaatattcaaatcaaatgtttgaattcttgaatccaaaatagatagagttacaactcaattccaagccattttgcagattagcccttcctttttccttatcctttctcttctcttcctttttcttttcctggcgctactgttcattgcgcgccaggtgttcgatctgtgcctaacccgaccgaacacccgacgccgccctctccaaccgctgccgtgccgcgcgcctgctttccgactcgtgcgccgcactagtcgtgcccgtgcgccgcaccgcgtcatgccacgccgcgtgggcccgccgccgaccaagccgccaaaagcccgcgccaaaggctgcgccgccacgggtgcccgcgtcatcccgtcccctcacacgtcgccctcgggatggagtgataacggccgccacgacaaccccgcgtcaccctagggcatagcccggcgccccctatccaagtcgttatctctgtccgtcgccgtcgctcttgtcaccgtcgcgtcgccatcctgtcgcaccccaccgagaccgctggataatagggggggttcctcccacagctaatgatccctctcctgggaccctatcgtctaggcaatcatgccggcccaaggcattgaatcgaacctaggagagatcgaaacatggctgagtcatcgagtgatcttatccaataggaatcgccctccctctcgctgttataagctcgcctttagctcgaccttatccaaaatcgaaccctcattcgtctcccctttcccggagttcttgctccatcccagagaaaacaaaatcgcgccgccgccgggtgtcgaacacctggtgggcgggggttgcgccgccgccgcagggcctctcggccggtgtgggtggcggggtgtgttgaggaggtgtgcccgtgccgttgctgctgttggagggagccgggagccgctacgcgagggagtacgagcatcgaacacttgcgaccgtcgccgaccgccgtctgcccctgtttcgaccgcaccgcgccactcgccgtcgaacttcgccgttccgccacttcgtggtaagccctcgcgcctgtagtcccgcctggtcacctagaaaccaacggccccctcgatttggggtgtgcgccgccgtaaccgtgccgactccggccgccgccgcgccatggccgagctcaccgtggggggacttcgttccaatacaacctaggctagatttttgcttctatatactccatgtggaccctagatggttgaatcgttgttggttgcgctcacattggtcctcatcgtgccgccgccgattttgggatctcggcgccgtcgcgcgccgtcgcgccgtgcgccggacggtcgccgcgcttcgccgccgccgccggcgggcatccggtgatgcgccgccgctagccccaccgtgcgccgagccgttccggctcgggccgtcgtaccgtcgcgcgccgctcctctgcttcgtcgcgagcacgaggaagaagacgacgggagagagagaaggcacgagagagggagagattatgacatgtggaccccacttcattagtgtacagtaatccctaaaactaatgatattattatgaacctatgacatgtaggcccggatgcttagaaatctaattaaattaggttttaagtgaatgtctcaatgacatgcgggtcccacaggagattcaacagggggccggacccacctgtcaatgacacaataggatttcctttaaaaaaataaaaaccagaaataaaatagggggatggcccacatgtcagccactgtaataatgcccctctcggctgcacagtgccatttcacaattgtttgaattaattcaaaattgaatctttaaacaagcataactcactcatcttaactcggaattgaatgaaacttgaacctaaattcatctaaaatcaagatctatctggtgataacattttctcaatatgctttgtactgtttgaattttggtgaatttatttgaattctaattgagttcaaatccgatctttcgcacgtaaatttagattccgagggaattgttgagtcgattgaggagcagggatagcaagactgcgatcaaggcaagtcatcactaatctttgagcatgttgaacctattgcgaaaattatgttgatttaaataaaattacatgctatacatatgtgaatatgaatgccctacttgttaaatatgccatgccttgatattgattatctgtatgaccattgtaaaccctgctaacgtgtgtacttagtcgatattgaacaaatgcttagtcatgctaattagaatcatgcattctcatatttatcaagtgctatatgcttgggcaactaccttaaggaaggtagttgagatgcggcatgtggaggcatgggcaccacattgccatgacaaggataacatgaattgtgaaaagagaaacaaaactaaacactgttttcgaccggggcggctggggtacttgggtggtgtccagaaaaggctagtgccgtccctggtcagttaaggaccgagccgtaaagttaagcatgaaacgaccctcgtacaaccgtacttctcgtatgggtatagacctagcggagtacgtagccgagcgaaggcagtatccctgcatagtggttattcttggtgtgtgggagtcagggcctacgatgggacagccattggtggggccgcgaggggcgagtgcctatagtggtgccgccatcggtaggactgccatgtgtaaatttaatttaactaaaacttaatgcatgtgtgagtcttcccttcccgggagcgccagaactcctctcactgctagaaactcatgacacctagagtgcatgaggatgcaagttcatggagtgcatgaggatgcaagttcatggagcgggtactgccaacgtgaggttattgaaaggttttgccttggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcaggacatgtattacacttggctagactctaaattcttaaattgaatgagatgggatatgcatgatgattttatactggtggatcatcttctcgagagacgagaaggagtaaaccccagaaaaccattacagccagtaacgggaagccatctttgggaagacaatggatggtgaaaagaaccgttgctgtgtaataaatactggaattaaaactggactagtctatgctagataataagcttgtgaaaagaattgtgaaactagctttatgcaaataaaccaacggccatactttgaatatcactatctgacggagctcgtggctcctcaccgggagaccgcgcaggcccccctttgccggttcggccgggggcttagggtgagatctcaagctctctctgtatgtggaaagattgtctgctagcaagggaacgcgagacacggcgatgtatacaggttcgggccgctgccaagcgtaataccctactcctgtgtttttgtggatttgtgtatgaatgagctacaaagtgtgagccaaactctcccttgttctaggctctcaatctcgccagaatcaaccctctactctgtgggcaaggtcctccttttatacttcaaggggataccacacgcacccttccctttccaaactggactttc

SEQ ID NO: 39703 - DNA, 2041 bp, Oryza sativa
caacccgaccccccctcggggggaatcaggaggagggcggacacctcaccctcgggcccgacgtccccgaaggtgccaggccacgtgggcgattgtgtctgcctcaagcctctggccatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacatcacttgagcagcgcgcgaatctgggtgagcagatttgtctcgctcggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacaggaaacgagggagcgggatagcgagatacgagggagcgaggtagtgggcgcgagaaacgaggagccaggcccagcgatggcaagggtataaaagcatcgagaaaaggatttgctcccttcctttcgccattgttcctcttgcctttgccgcctgagctctaactctttctctgctacgccctactttcgccacacgcgctcgttcccaatcatctcttcctccaccgccatggcacggggctctgctctgctcgatggcagtgtactaccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcgatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcagcggttggcggctgctacttccagccgcgggggccagtgttgaaccgctacatcccctgcgtcctccgcaagaagtgggacgactggaagagcgaccggttctacaccccccttgccgacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattatctccgtcgccggattgcgccgctccaacggcgcgcccggagcgcctgggagtacactgggcctgaagactacatgcggacccaccagggagccagatgggattgggctcccgaggacttcaagatcgtagtccaaagggtgctgaatcttagctccgcggaggcgtctcgccttcctcaagagatcctccccctctgcagcgatcccgaccgcgtctccattctaaccattatgatgggggtcggggcctcagaggagagagcccctaagggccacgacggcgcgggcgagcgccgccggggggaacaacctgccccaggagggggtcgtgcttctgggccccgcgtcgggggctcggggagcagccgccctgccgtcgcccaggggaagaggaagctgggaggaacacctccgccatctcctccccgagggggcggggcggtgcgtgccagcagtcggcgcccggagggggccgcgccgacatcgcagcccgagggggtgcgcaagaagaagcggctccgtaagacgggggagcggaaccatgccggggaaacctgatttcccctccaaggtggtcattcaaccgaccccctcgcaggttcgtctcactctcattgcaaccatctg

SEQ ID NO: 39704 - DNA, 19460 bp, Oryza sativa
  unsure (1)..(19460): unsure at all n locations
gaggaggccacccgggctcgccaggctgaggcgacagctgctgctggcgcgtcacttgggcctactccctcgggcggccctcaggcgacatcctccgaggcggctcgcgacgaggccgcgggcgcatcgcctgggcctacctcaccgggcgacgcccatgatcaaacgggcccgggggacatccccgagcccagcgcatcttccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggtgatgtgaccatggctactatggatacgaccattgctcacatcatgaaacaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaaccaaggtgctgcgtctcctgtattgggccaatgggcttgtaactttgtttgggaccctggcccatgtgaggcccatgtggggtgcgccccaatctggtggagcacgacccttggaccctcttggtcgtcctcccacctctataaatagttaggtaccccttcagggtttcttgggttttgttagattaaagtttagccattgctacttgcttgcagcgcgcgtgtcggctagaccgtccgtctgcttgttcttcggaaccccaacttatcattcgtatttaactcctatttgcaattcagattgcttttatcttgttcttgcttgtttcttcgatttgcttgcaggaataaggttgatttgcaccggcaagatcaacaacccacggagaggtgtatcgatcgctaaggcgcaacgcaacgtcttgtacggttgtagtcgggtcgtcaacgtttcttccaaatcgtagttttcatcaactcaccgaaagatcgggccaacaacaaccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagacgtttctatcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattttaattttgggtttagacttttacatttgagtccctataaattttatatttatgtttgagtccctgtaatcttacattaaggtccttgagtcagtttttgttaaaaaaaatcaagaaaaaagtgaaaaaaaggcagaaaggtgcaaaaaaaaagaaaaaaaaagccgcaccaaaaaaaaaacagaaaagaaaaggaaagaaaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcgttctctgatttgagcatttgctattcctttgctacatatttaagcctacccagagctccacagatttgattgcagccgtacagcaagtgtttgccgaggcatcgatatatccaacctctattgggctgcttggttgagtcggtgtacatcaccattccacttgcattggtaagatcttgtaagagcttggttaaaagcttgagtgtgtgtgacatttgagctgccagtacctaatagttgataggagcgtgtatattcttgtgtatgtttcttgtttgctgctaaccatggcaggattgcgcaaggggaaacaagatggtcatgctcaacgtcaacatctacaccttcgacgagatatgacaacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtaccggttctgcatctttttggtggcatactgtggggaataagcttgaaacttgggatgaatgcaaaatactgatgagaaaaagatttgtgttttcatactatagacgtgctctccttgagaaatgggaacatctaaaacaaggtgacaaaactgttagggagtactttcatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgcattgttgagcgcaaaattttggagaatccaacggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgtttcttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacggttttctgtgaagaaggggaggatgatgtgaccatggctactatggatacgaccattgctcacatcatgaaacaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaaccaaggtgctgcgtctcctgtattgggccaatgggcttgtaactttgtttgggaccctggcccatgtgaggcccatgtggggtgcgccccaatctggtggagcacgacccttggaccctcttggtcgtcctcccacctctataaatagttaggtaccccttcagggtttcttgggttttgttagattaaagtttagccattgctacttgcttgcagcgcgcgtgtcggctagaccgtccgtctgcttgttcttcggaaccccaacttatcattcgtatttaactcctatttgcaattcagattgcttttatcttgttcttgcttgtttcttcgatttgcttgcaggaataaggttgatttgcaccggcaagatcaacaacccacggagaggtgtatcgatcgctaaggcgcaacgcaacgtcttgtacggttgtagtcgggtcgtcaacgtttcttccaaatcgtagttttcatcaactcaccgaaagatcgggccaacaacaaccttgagtgtcgagaggaactcagggttcatcacgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccagggggcggtcgaactcgtgctggcgagctaccaggcccgggaccccgacttctctccctggatggcgctggaggagttccctcccggaaccgaggacgacgcgcgcgcgcgcgtccgggatgctgccgaccatatcgtcgacggcttcgaggggtcggcccctctgctcgcgttcgcccccagctccgacgaggagagcgacgccagcgatgaggatgacggcggcgacgaggccggcgacccgggcgcattggaatgagcccccaggcccccgccaatctttttttctttttctttcttctaaggccttcatacctcttttttgtacaaattaacttaatctgcaatcagaaatgaaatgatgaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcccggggagatccacatgtcgagactggccaggccgggaacgtggtgaccgaggggtatgggtgacccgattgtgggtttttgccggttcccccccggagttcaccacgccccggggcacggctcggttctgggccccgtttggcgattttagctgaccgaactgagccccctagggcaaggttgagcacgagtgaccttatttcaagttaagattcttcagaaggaaaaacggcacagacacaacctttagaaaattgaaactgcttctattgaaatgctgaaataaggaaaaagggaatatatgtgcatgtgtggtagcccccggccaatcctgcacacccgaggggggtgtggggttggcccgagccaaaatctgacacccgacccccccccctttaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggcctcttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgtgaggcggaatgggctccgcactcgccctcatggatgtctgcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttgaagcgctcccttcgggtcccgaggcctggactccgacgggcctcgggggccggtcaggcacatccgtctcccctaagggatcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcatccatctgcgggtcagagcaccggtactccttacagacctggttaacgactagctgggagtcgcctaacaccaagaggcggcggatccccagtccagctgccactctgagtccggcaaggagtccctcgtactctgccatattgttagtcgctcgaaagtcgagacggaccaagtatctgaggacgtctccgtttggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctctattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcctggcgtcccggagggcctcactaacaaagtagacaggccgctgcacccttcggtggggccgatcctctctgctaggggccgtatccccggggcgttcttcgttcaagtggcctttcggggcgcacttgtcttctgtaccgatgaccttggggtcggaggatgaaaggggcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcagagggcgttaagtgcggccttcccgcagtggcctcggggccttcctgagggtcgggggcacccagcaccgtctgacgagcgggcagagggccgtctccggtcgtcaggggccttaggccaccgtttgactcgggggcctctcctccctgcttgctcccgggccaagttagcacagaatgggggtgcacgaaatgaggattgtcctcatcgcgctccacaaccaacgctgcactaactacttggggggtcgctgctaagtaaagtagcagggactcatttggctctggagcgactagaaccgggggagagctgagatatgcctttaaccgagtgagggcatgttctgcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcagagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtctcgccacctcctcgcggatgaagacttgacgttccggggcctgccgccgcactttctgccggaccggcctcgcgcccggccgcacggcgagacggtgctcaatcacctccctgggaaccccgggcatgtccgctggtctccatgcgaagacgtcagcgtttgcccgcaggaaggagacgagcgcgtcttcctatttgccatccaggagaccaccgatccgtgtggtcttggatgggccgtcgcccaaggcaacctccttgaccgggacctcgtcgcatgtagcgatccgctgcctcggggcggtgggggcagaggggccaggcctctcgtcaccaccctcgggcttggatgcagcagcgaggcggtcggcacgctgctccatgcaagcgagcgcgaccttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatcgatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcgtcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttgtggacggagcaccacctgccggcggggcgctccttgctgggagtaccagcctctttctttttgtcgctcgcaggcctcccctttcgggtggcccgcggagcgccctcgacggcgaggacatgaccctcatcgccggaacggtccgacctcttcttcctcctcctgtcacgccgccctgtctgagcggcggatccgggggcggccgaagctgccactccggaactggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcaaggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcatcagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacggggggtacgccggctattacgccggcgctcgatgttgaggcgggcatccggctccccatgctgatcctcccgagtcgaaggtgtcgacgagggagtagcagccgaatgacgtgcagccgccgccgctcgccgcgccctccgccttgacgacacggagccggtggtagcggcaccggaggtcttggtggtggcggaccgtccaccagcacccaggcgctgctgtgccgtcatgaccaagttggccacatcttccagccatcgttgggctggagactccgggtcatggacgacaggcggatgtcgtaggagcgcgccagcagcctgaagcgcaccctgaggcgtgctgccgtcgccgtagacgaggaggcggcgctccccatcttgccgtcctcctgcaccacctgcgactggtgatgccatggacttgtcgaccttctcaagcgcctccccctgcttagggcttgggcgcggaggagatgggggagtacgagctcgacggcgtggattcagctccccgtcgtcgccgctcacactcggagagaggtcgtgcgcctttgctcgctcggccattaggctgaacaagggaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagattgtctgctagcaagggaacgcgagacacggcgatgtatacaggttcgggccgctgccaagcgtaataccctactcctgtgtttttgtggatttgtgtatgaatgagctacaaagtgtgagccaaactctcccttgttctaggctctcaatctcgccagaatcaaccctctactctgtgggcaaggtcctccttttatacttcaaggggataccacacgcacccttccctttccaaactggactttccttctctttacgaacggagattgatatggttgccgtccgaatcacacttcgatgggacagcccacacctacctccactcccggcggagacgggcgcaacgtgggatcgtggctgctcgttgctgacgcgaccagtgtcagaccggtcattcttgtccaccacgcgtcagattaacaacgtgcatgtttgcccttcttcgtgtaacaccttgcctgtaatggttaggatgaagcctggtattcatctaaccagggctaacgtgccatctctaagaggtaacacgctagctccggctggagacgtgtgcctagaggcactcgtcttgacgggacggggcgaggcgtgcgtcagaccgccagtcgccacctaaccgttgatctgaccggtctgtgactggtcacagaccggataaaagagcgcgctgtattgcgctgcatgcagcgtgacacgcttgaccagaccgcaataaatgctgttaggtgagcacagctgtgctcacttatcccatatatgtggcgcagacttccttaaggggtcggggtgcctcggccctcggggtcggggcaagcgcaacccgaccccccctcggggggaatcaggaggagggcggacacctcaccctcgggcccgacgtccccgaaggtgccaggccacgtgggcgattgtgtctgcctcaagcctctggccatgatactcccggtcccatatcaccgacactatcatatgcactgttgttatgatggcttgctgagtacggttggtactcactcttgctattacaaaatttaatcagtggatggcaatgaagtcgaggaggatccctatgcttatcttcaggaggatgcggaggatgacggcgctctgtaggtcttagttatggtcgttgcctgtggcaatggcatagccgctgcctataatctgctgccttacctatttctgttattgtttgtattgtggaccgtttagtcctatgatctaagactgcccgcgggcctatgatgtaataattcgcgctaaacaatctttgtatgcgcacttgataattcaacaatgtaaccgtgagtaccagactacttgatccagggaaatggtactattaatatgagtgattccgttataaaaacgggggtctacattaagttcaatcccgatcgtgccccgctctaattcaatggtcagattaagttttgtacctggggttaccggtacctggggtaccgtttgctggacgggagcagtgctcaaaaattaaagatggtttctgtgatactttgatatgccgttcgtatttaagtctatttttatgttcgttcacttttgtaaatacataaggagtcatataagaaatccttttaaaaccctcacatgctaacttggggtgaaagtcggactcctaattgcttaacaattctcgctagaccataagaaagcaacgtacatgatttttcacgtgaacaatgatataatcatcatcccaacaaaaattccgaattagacatcaatactatcaatataaaaattccatataccttttagaaaaaaaaatctaacaatagagattctaccaaggcctatatgtaaatgacctatgttcctcttactatgaggaatcgctgtcgttcggccaacactaaacctgctgaatcttcaacatcttattttggggtaattataaatttgccactgttttgaatcgttattgcaagactgtcactagaacattgcgaaaattcaacttgaactgttgttcgagcggcatgcttgcaaaattgaaaaaaaagtggtaaattcgcaaatgctcgtatagtcgtattttctctcttttgataaccagcggaaatgaaaattatttgacaaataagttgggtgttttgccgttagaaactaactaaaacaaaagactaaccattttaactggagagcgcctcctcctagctttgaaacaaaataaaactaataaagataaattaatcgaactcgatctgtggatgagaaaaggggaagtggtgaagtgcacctagctggcgacccaactcgaatatctcgatctgctgcaagcttcaaaatctggcgctgtgagaagggtctagcaggacgcgggggcttcatgtgattatatacaaagcgtgcacggttttccaagacatggggcgtccaggcctccagggtcagctgcagtaacagctatgaatttgcggtcattattgatccaaacatctaacggaaatgataaggctagttcgctagttgtggttcgcagcgctaggctgtgtggttaggaaccccgcactgttcaactgctctagtgcactgttccggatggacggacgcaaggtgatggtgacgacgccgttgggccgctgacaaaagccgtcagcctgcaggcgtcgtctgcccagcaggagagaagcgtgcagcgctgcatcgtatttgaccgaaaaaaaaagtggagaacagtgcaaccgtcaaagaaatatggcaacaccaaaaaaaaaaactgaaaaggcaaataaaaccaaaaaaaaatgttgcaaatgtaccctcgatttatatggattatttttgttaattgtgcaacgtaaattcattaagcacgtcattagcgacggacaaacatattttattcggtccattttaccctcaactatatagcatttgtctgaaatacaccccttacttcaaaaccgggtataatacacccctcaatttttaaaaccgttcgaagtttgaaacattgtggtttcgccaatgtggcgctgatgtgtcaatcatatctaagtcaataaaatatatttgaaaataattaatgtcccactcactactggagaaaccatctttgcccggtcagccaaaatccactatactcctggattgagtaagaactgggactaaatctttagtcctggttcaaaaagcccggggtacttttttaccaaccgggacaaattgtcaggctggtgtcatgcttatactatttttagtccccgttggtaataccaaccgggacaaaagaaaaatccggatcagccctctctgcgtcattctccccgccctgttaccaaccagattatataatcaacacttagaaaaatctctccgcattgtcctctctcaactctctgcggagagatttttctccctctctcgatatcaagccgctccctctccctctccctccctcttagcaacagccggcagtgggaggggaagggaagcggcggggcggcgggggcggcctcccctccgccggtcctggaggggaggcggcggggcgagccgagcggccgggaaagtggcgaggggtggcggcctcccctctgccaaatctgggaggggaggcggccggggaagcggcggggcgacggcctcccctccgccagatctgggagggggaggcggcagggcgagctagccggcggggtggcggcggtggcactagggcggtgcgagggtggcggcggactctcctccaccggatccgggaggggaggtggtcgggtggtggttgtggtcctgtggagcttttttttattttgtgaattgatgtgtagatttttttgttgatttggggatgatttgtggattgtggatgggcatgtgttgtgtatgatttgtaaatgatttttgtggatgatttaggtgtgttgtgcgtgatttgtaaatgatttatgcatgtgatttttgtgcgattgtgctcgagatggaaatagaaaaacagcagtggaagcaaaaaaaacaaaaaagaaaaaaaatcccttactcccggttggtaacattaatccgggctaaagacgattttatctttagtcctggttgaccaggactaaaaatcgatctttagtcccgggtatttgaatcgggactaaagatagtggtctttagtcccggattcatagtcctagttgaaaaaccggggttacagagggttaccaatcgggagcacaaatcatttctccaccagtgacatgtcagactgattcatcatcttcctcacctctcttcccctgccagcagccactgagttggtcagctcaaggcatcaagtgctgatgccgatgaacgcggcagacaacgcaaagaggggagacacgccgcctggagctccacggcgcctgttgacggctgttaagtgccaaaataacgtcgtcaatacctgtataaaaccacaaatgtgaaacttccaacatagtggtaggatttatttctaacaatttccacgagtggtggtgtatatttgtatgcaggtgatcaaccaccaaagttgggagagaatgagcataaagaatggaaacatattttgctctcatgaactcacatggttttaagctacaacatataaaatgtgcaattatttggaccaaaacatggagcatcatgaagtggggcccacatgtcagcatcctgaagaaagatgtgggccaggggagccaatcagggttcggccgaacccctggatcggcggaacccgcagctggcccaatccagcccatattcggtatgacgattgtactcctcatcccaatgacggttgtgtccttttctaccggtggaaaccgtcatagagaggacacttgtcaagaggagatgaagctagaaggaatatgctcataggatgcttggagcatctccactctcccaaggcaactctccacctataaatacccctctcctctccctcattcacacacaccaaagcataagatgaattacaagaggacctagtgtactttattgttatgggaatgataagggagagagtaagtgtaacaccccaggtaaccacgtacctagagtgccacaccaaaaaaacactcaaaccactaacttccaaaattattagaaatttcggcagagtcacccctgcaaatacggacatccacaacaggcaattataagttaaactaataacaatatcattcccataatacgatccatccttataatccatggagaaaaaactattagaaatctaaaagattattataagaccaaaccaggatataatttaagtgtcattatggacctaagcaatatagtttgatagtgtgcaagtagatgtgaatataagggtgctacttcccgcccatgcatgtcggtctcaatgcgtacctaaaaccaaataaaacacaagagtataaaaataatcagcaagtacaatatggaactagaaaacacatatacacatcattgacaataaagcatgaacagaagattttctttctttgataggaaacacatttccaaacaccaagtcaaaggagatagtagttcccatccctgcagacatgaattgaaatagtagtttccattccggacaatagtgaatacatcctaacatttgccggcaaagccgagtaagcgtgatcagcgcttatccacgggaacttgaataaagaaccaaattgcagtaccatgactacacatggtacttgaataattgaaaccggaatcaaagaaccaaattgaaacacatccatggcaagcagggaatttgaattatttaagcagaatcagaatccagaatattaaaacaagaataagatcgtacacataagatcaacttgaaatctaaatggcatgaacaataatatgaatacaagcagttacttatcacgttgaaatatatcagaaataaatagatagagtaaacaatccatgaatcacacaattagttcgtcatacacttgccttcaacgaaggattggtatcatgcacgagctgatggaccaccacctaatcacaaacaaaaccttagcaaacacattcaaacatgcgtataaaacaataaaaaggtgaacctactgccccatcccatcaaaactcaataacaaggaacaccacttggattatacacaagactgctgcttcaaacctttatatctcgaaatatgaaaaggctatgacggaaaatgtataaattttgaaaatctacagagcaatacctacaactttcatgtagaaagcatatttttattgtgctatttaaatggtctaatttgcgcttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39705 - DNA, 839 bp, Oryza sativa
gggtaaggttttttacggtgaatctggttgaccgcccataaccgcgggcacggctattcgaatagttttactctgatcagaggtgtacaactatacccacaagacacagccccataacacgtttccgtgcgccgacatgccaccacgacataccggaaagaggccgtgacaggacccttcgcataaccccctctaaccaagcacaccacacctcaggtttcacccccactccttgcaaagcagcgggcagtcccctctcgtgcctaggtgaatccagaagcgacagaggccgtcgcagggcccgccccgctccatcacgcccacccttgcctggatgcgtcagctagaggaaagctacactacaagcccagccgttgcccatgctggcttgtggtaagtatgataagttcttccagggcatcccgcgaaccggtccttaactgccatgggtgcgactagcagaaccatgcacccacagcccaccatgtgattcattttaattgaccaacaccaaaacggtggtactaaaccaaccttaccaattgaacctaaagtctatattttagtgagctttccccattgtgtgctagtggaactaagcatggctaagcaattcctagtccaaaatctattcatgttataacccaagctaacaaaggagcatggtatcaaaaatggcatggctgtaacaataggtaaacaccccatagtaacattataaaacaatgcaatatttgaagaaaaacaatagagcatttgcaatataggatcaacatgttcaagtgacaagcatgacttgccttgctctgctgctggagaaacctcggcgactatctcga

SEQ ID NO: 39706 - DNA, 1766 bp, Oryza sativa
gtcgacctgcaggcatgcaagcttgcagaaggtaatctagtgagcccacacatgatcaaaatgattggttacaccaagagtctggataaacttggctttccccttagccgagagttggctactgatttgattctccagttgctccctcccagctttgagccgttcataatgaatttcaacatgaacaatctgaacaggaccttggcagaattgcatgggatgctaaagactgcggaggaaagcattaagaaaaattccaaccatgtgatggttatgcataagcgcaagcccaacaacaagaagagtggtcaaaagagaaagctaaactctgatgagatcacgagtactagcaactctaagaccaaggttcaaaagacatggcccgctaaggatgcagagtgcttcttttgcaaagagacaggtcattggaaaagaaactgtaagaaatacctagagcagctcaagcagaagcagcaggatggaaagagttaaacctcaggtattaatgttatagaaattaatcttgctacttactctactgattcttgggtatttgataccgggtcagttgctcacatatgcaaatcgttgcaggggctgaaagaagtaggagcttagcaagaggcgaagtggacattcgcgtgggcaatggagcaagagttgctgctgttgcggtcggcactatgccattatctttaccgtcaggattagttttggagttaaataattgttattgcattccagctttgtgtaagaacattatctctgcttcttgtttgcaagcagagggttatggttttagatctgtggacaatggttgttcagtctattataatgacattttctatttccatgcatccatgatgaatggcctatacattgtgaatcttgatggatgttcagtctataacattaatgcaaaaaggcaacatcctaatgatttgaatcccacttttatttggtattgtcgcttgggtcatataaatgagaaacgcatggtgaagcttcatagagatggacttctacacttgtttgattttgaatcatttgagacatatgaatcttgtttacttggcaaaatgacaaaggcacctttcacgggtcaaagtggaagggcaagtgaactattgggactagtgcatactgatgtatgtggaccaatgagctcaactgccagaggtggttttgggtactttattacctttaccgatgactttagtagatatggttatgtctacttaatgagtcataagtctgagtcctttgaaaagttcaaggaatttcagaatgaggtacaaaatcatttgggaaagacaatcaagtatctacgatctgatcgtggtggagagtacttgagccttgaatttggcaatcatctaaaggagtgtggaattgttccacaactcactccaccaagaacgcctcagtggaatggggtgtctgaacggaggaatcgtacattgttggacatggtacgatcaatgatgagccaaactgatctgccgctaagcttttggggttacgctctagagacagctgcgttcacactaaacagggttccatcaaaatcagtggataagacaccatatgagatatggacagggaagcgtcccagtttgtctttcctaaagatttgggctgtgaggtctatgtaaaacgtttgcatcggacaaactcacacctaaatcagataaatgcttctttgtggggtatcctaaggaaacgaaaggatattatttttataatcgggaagagggccaaagtgt

SEQ ID NO: 39707 - DNA, 15771 bp, Oryza sativa
gaacctactacctattatgaagcaatggtgggaccagactctgagaaatggcttggagccatgaaatccgaaatagaatctatgcatgtcaatcaagtttggaacttggttgatccacctgatggtgtaaaagccattgagtgcaaatgggtctttaagaaaaagatagatgtagatggaaatgttcacatctacaaggcacgattggtggcgaaaggtttcagacaaattcaatgtgttgattatgatgaaactttctcgccagtcgccatgctaaaatctattcggattgttttagcgattgttgcctatttcgattatgagatatagcaaattgatgtcaaaacaactttcctcaatggaaatctcgatgaggatgtgtacatgacacaacccaagggttttgttgatccacaatcagctaaaaagatatgcaaattgcagaaatctatttatgggttgaagcaagcatctcagagttggaatattcgttttgacaaagtaggcattgggctttgtcaaaaacgaagaagagccttgtgtatacaagaagattagtgggagcgcactcgtgtttctaatcctatatgtagatgacatattattgattgggaatgatattcctatgcttgaatccgttaagacatcgttgaaaaaatagtttttcaatgaaggacttaggggaagcagcatatattctgggcataaggatctatagagatagatcaaagaggctaattggattaagccagagtacatacattgacaaggtgttgaagaggttcaacatggcattaatcttggcaagaatcaatgtcctcaaacgactgatgagcgaaacaagatgagtgtgattccatatgccttggcaatcggatccatcatgtatgctatgctatgtacacgtccagatttttcatatgcacttagtgcaacaagccgataccaatcagatctaggtgagagtcactggatagctataaagaatatcctgaagtacttgagaagaactaaggatatgttcctagtctatggagaacaggaagagctcgttgtaaatggttacactgatccaagcttccaaaccgacaaagatgattttagatcgcagtttggatttgtggtctgcctgaatggaggcgttgtgagttgaaagagttccaagcaagatacagtggctgattctacaacagaagccgaatacattgccgcttctgaagcaacaaaggaggctgtttcgataaagaaatttgtttctcaactaggtgtgatgactagtgcttctagccctttggacctgtattgcgataatagtggtgccattgcgcaagccaaggagcctagatcacatcaaaagtacaaacacattttacggcggtatcacctcattcgcgagatagtgggtagaggaaatgtgaagatatgcaaaatacatacggatttgaatgttgcagatccgttgacaaagccactccctcagcctaagcatgagacacacactagggcaatgggtgtaagatacattcatgattgactctagtgcaagtggaagactgttagtgacatgccctagagacaatcatagagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatgtggacacatgatagtgaacatgttgttggatagacccaacatgagacactgcaagagccatatgtgttgtgtcatcagtgatctcatttagtgttggtgttgaatccttagacctgagattatcatggttctcaacatgtgtagtagcttacttaggactgctaaacgctactccgtaattggatagttataaaagtagtttttgggtatgctatgaaacatgtagtgggatatgaataatcaagatgggatttgcgcttcctatggagagatatctctaggcccctcgatgttgtagattatggaaatgcatggccatgccaaaggtgattgaggaatcaatcacaagttatataatctatcaacaggttcgagtggatgattgagctattagaggatggcacatatctagccttgagtttaatcgatatcgtgaggcaaaggggttcgtacaagtatacactagagattcagccgatatgatctttatgtaagcccggtgggtcaatacgttctgctaggggccgttgttgatgcgtggaccaaaaaggagttttcgggttacagcggagtatatatgaacctacagggtcgcatgcttaatgggccggaataaggggattggatagagatgcaatataagcttaattcggatagggatccgaataggagtcctacgggccttggaggcccgagtgatggatcctatatattcgtgaggggtgtgaccggcggaggcattgcatcacgtgagaaaccctagccatcacttccctctccgagcaaaaccctagccgcgcgcgggtgctagcagatctgcgcgtggcgttccgtccctatacgtgtggataccggtagaggcgccgctattttgcggtgctgattggcgtgggagtacggcgaggagaacgcacgaggaggacaaggtcgagccggtgcgatcgactacttcctctacatcgacgcgcgctacttcgcgatagttcctttgacttctcagcgtcttcttccgctggacagcacgtcgagtggtaacgatctatgatctaatacttgcatggttcctggtttacgcgatagaaaattttgatttatgctatcgtagcctacgcgtatcccaacatgaggaggcgcggcccaccactggaagaggcggttgctgcattgcgagggcgttggcggtggcggcaccgggtggtacttgtggagcagcggcgttggtggtgggagcaaggacgacgttatggacaacggaggcggtggcgcagccgcgacaccatcatgtccttcatgtgtcgccgccgcactgtgtagtcctgctccaccttagacgttgtgcaccctatcaacccccgcaaactggtgccactactgccaatgccgacccatgcactacataccgccgacggtgctccccgcatcctcctcccgtgcctcacttgatctacaccgtaactgttgtgggcgtcatcgcacggtgtccctactccgccgctgtcctgactgtccccgttccttcgtcatcgtcgcgcactccacccgctggtcgcgccactgctcgtggcttgcagtgctcactggagaagagagaaaggagggagatagaggatgtgataaggaagaagatctagaggatgaggaacacaaaggatggacaattagtggagtgaagagatttaaaagtaaaaatagaatgggacttctgaaagctgatcagatcaagctttgatctacgtaccttaagtacaaacaggtctatcttctaaatgaagatgtaacatattttcgtatatggttgccatgcaaagaaaggggtctgtgcccaaaccacatattttcctatatagcaaaatatgagtaatattgatctcaatttatttgtttaattacaaattaaataacagttttaaaaattaaaaactggagattttgttcagtacatgatcacttttatacgtacaggagggagggaggtggggatggtcgtacatacgtacaggagtgagggaggtgttggtggaagggatttattttttaaaagatttgatctaataactgaaaatactggatccaccaaattgagtgaaaatcaacgattagatatttttattttcttagaatttttaggatttcctttaatttattagaatgccacttggtgacttaggagcgttcgtaggatgctacgtggtggtgtaggagcgtttgtagaaagtttaatagactaaaaacaattgtttatttatagtagcatcgagaccgctcctgtacatgaacagctagtgattgcacgttcactacccgctaaaactccgtggaaaaacagatctaattatttatggtaacaaattatggtgcatatctttgaactgctttaattaggaaagaaaataagagaatgagggggaggaacgggatagatcgtgcacatggatggagggatttgtacgtacgtacacacgtgtggggccggccaggagagaagggtgaaggggatttagttttgatctaatggttaatattattgggtccacctttttaagtgaaaactgatggttagatgtttttcttttttacagatttttctataaattattagagcgccacatggcggcttaggagcgtttgtagaatgcttcgtggcggtgtaggagcgtttgtaagaagtttaatagacttttagtatataatagaagatagatagatagatagattttgtatatataataaatgaagctcctagtcttgtactaggaaagaggttagagaatatgggttgtgttggggttttatgaagagaaaaggaaagttgggaccattgttgaatcaaagttgattcctttgttcccgagaaggcaaattaattaatcaggttacttgagaagagaacctgattttctacaagaatatcacatggtaagttactttataagataaatcgaagtgtgctaaaatccattatgccttcctgagcagaagaaaagacctgaaatcccatactgatttgtgagttgtgaggaattcattaacgactggatgagaaggcgattctctcattagcatccttaatacatagagcaatgaggttcagaacacacattaacccaaactctgctcacggacacatttcatcacaacattctattgggactttttgccatgtagtctaaaaaatccaagtagctccatggtccttccagatccatccatgccaaatttacaaccacagctcatcaaatatatagcatagtattgttgggggagtgggttcaccctcaaagccaagaggccttatgccccccaccattttcttggtgtgtaggagggagcctccgggaagaatccctttgaaggccttgccacaggtctctctaggtgagctctgggagacctccaggggcaccttcaagaccggtcatccaggctccaggggtgctattggcacaagcaagtagaggagggcagcattgatggcgcattcaaggcaaccaaccacccctgacttcaatggcagtagcaggtgaagcggggccgatgcgcctcggtatcacgcctcgctctcgagccgcacactccgggaatcacaggacccccagcaatgctggtttaatgggtgaaatcccatcctttatcccctaaggttttacctcgctaccctcgagctggaggccacctgccacccttagccaaagggctagctagctccataagggcaccgttgtaatctcccatactgctgtaagggtatataagtataatcctaccccccatgaggggacataatgaatagagaaggatactaccatagactggtggttgaccttaatttgatgaacttggttccaacacatacttaaaattaaattagagtatataagtgccagatggactcaaagcacttaaaccgaaggacaaatccaatagctccaacaacctgtctctaaacaacaagcaaaagcaacaagtagaataatatggaaacaaaagtggtaggtgaagatgaccttgcacatatatagatgccttagagaccactatggcgatggagacaacatgtggtaagacggtcttgccaccaaagagtaaggaacacctgagatagagctagacctagtgctggtggcacttgtactagaaagaccagcgactgtgatgtccgagaaaacacaggagcactagcagccacgttagaattggagatcacttaagcctagctggataatcaactaacttctccagatgaagatagaagcaatcataggaagtatgcccaataacttttggtactgccctgacattgtgagtaatcaataggagtaaatgtagtgtctagggagcaaagacgtgtatcctcagcgattatatatatctacaagaacctctggccatggtaggatgtgcacgtcatccaatcaactggacttgaatggactcaaattgggagggaaattgcatgacaaattggtacagtagattttcctggtcgttctcctctctcgccttgcattgtgcacaacctgaacttggccagacaactgaataaaaccatcataaaattcttcaatggactattcttgttgtttaattaatagccacctatacactcatgaatatttattccataacaggatcaactgcatgttctccatgccttaaccttagttgcatctgttcgatcatcaggaggatcatctgcgagttgacatgcttggccaattaacattcgaagcatataaaccgaaagttcccattcttgaaaatttttaccatttagcttaatgtccatggagagctagcagagatcaacctccaagaaaaggttcgaatgtttccatcaagaaatgcagaggaaaaattgataagttgagtggagtgaagcttggttattgaacttgatgtagtgtctcttggatgaagatgactttgtattgaaaattttgtggagcctctgataagtatatagtatactagtatcattgccagcttaaatcttatgttactataaagttcatgcccactaacatctaaagcttaacacgcaaatatgccacatcaccctcattagcaattattatatagattattttaaatcacatgcaagtgtgccacatcatcacctactaacaattattatctatattattttaaatatcaagcaaacatgacatatcatttacaatttttttatattttaaaacttaatatgaaagcaatgtcaaatcattatttccacatcattttcatattatttaaacatatacattcaccatttctagaatgtatgacatgcatttgacatgcattcatctagacatctcgtagcaaagcgtggggtatcaactagttgattcaaggtgggaatacgaactgaaacgtcaattatatactaacaacgtcggttcacagcgaaccggcagtggtgacccttttggggtagtgatgtttcctaggagatatttaactatttgccactcttacaagtggcaattaagaatttagcactggactcgcatgttatacacacatgaggatccaaatgtcgagtggtaaatccttaattgccacatcttaaaagtggcgaaaagttaaatgccccatttttaaaccctagtattaatgcgcaaacttaatttggtggagcctctaattagttaagataacgaaaaaaataggaaatgctcctgaactaaacatgctgcatcatgttagaataagcgttcactacttaaaagatacacatagaggtcggcactataggtgccggaagtgttaaaattggcacctctagaccttttcccactcagcgggacacctttaagcaactataaatggtggttcaaaagaaaaaccggcccctatactatagaagtttttttaaaaaaaatagaacctttaatatattataggtgtcagttaattaaaaaaacaaaaaaaacaacatctaaaatcgagccgaaccaaacggtgacctcccgtccttatcatctcctcctcctcctcatctatcacgtcattatcctctcatttctcctccaccgcactctcctctctctctctctcgctcttggtccctctctctctctccctcggctctctacccggtgttggcgcgaggaggcaacggcttgcagccgctggaggggaggcggcagcggcaggcagcgacctcgcctccgccaagtcaggctggaagggaggcgacagcggtggcatgcgacggtgggagggaggtggaggcatcgactggtggcgcttcgccagatccgtcgggaggaaaggctgcgacagcagagtgccaccgcgggtgggaggcagaggcagcgacgggcggtggcctctccttcgctagatctattttttagtgattttagtgctcttagtattctagtgttcccatgttcttggatgttcttgattggtttgggtgaaggggagttgctcgatgcttgaattgaatcgagccgatgcatcgagcttgctttttttttattcgtggaacctcaaagtactggttctctagcacctattctcttttcatatcagtgccgacttcaaggtgttggctgaaaaatactgcacctttgtggggttcacaacaatgtcactttctgtagcattggttgtatatactagccctagtttagtacttttcggttacagttggacttgtaattgtaataggtcgtaggagatagagttagagtcggactctataacacggcaaccctttaaataaagagcaaacatcacaatgcaaccatgacaactataatgtagcgtagacacgtatggagaggatgacggcaacgccatggacctgtagcttctaggtgctatattgattgggatgagcgcccataatcaaagccccagagaatatgtttcagctgaacctctcgttaacaaatattgtttgttcaggtgtctccatctgacgtgtcttaggtgatcgatgactgaagtgatcgggaatgttagttgtagttccgctatatcggctaaattttataacacatcattccatctagagcaaactaaatccaaaacgaatgcacatcatatgattcaattgccaaggcaattagcaaagcttggtgcagtgtatgccgagtgaggacagaatggttggaacacgtcacaggaaacaaccatcctactgtactcctctgattctgactcttctattcttcctccaaggctccaccatgacattacagcttgtctaccttccctgaataaccactgtccgaatttctatctacccgaaaccaaatacatagtaggctgcatcatcagtcagtagcttggagcaatgaagatcattgtacacttgtcagttcaactccaactttattttttcctctttaatttgcatcgactttcctgatgcccctcatgccaaaactccaatgcattctctaaccagaacacataatttgtgtttgcaggagttaatatctaaagccgaagtagaacaacaacattggttgttgtaatctcaaagaagttgactgtgatataacttagtgagagcccctgaacacgaagggacataataagataaattgaggcttcaaacttgctatatggatgattacggtttatcaaaagagagagcaatataagtacaaattaagtagttcagcttgttagtttgtattgtacgagtagtttcttttcataatttcaccaaaaatccaatcttgaaataccgaccatatacatgtcctaagatagcatttgtatattcagcctgcttcaactcacctaacgtacattgtttcgttttacatgatttttcattcctattttgtgagcttatgtcggagaaatataataatctcttgtaaaaaaacaatttaattctaaaatgaggaatatgatcatggcaccagtacaaaaccttccatctgtgacggcttctaacatgtctggaattagcgtaccgtcacaaggaagtcatctcaatcgggccaaaaaaaacaccttattgagattggtcgcacagacatgctagatggacgtaaaactaaggcccgtcatggatgacacctatccgtgacgggccataacttagacccgattgagataacattccatatctcaatcggccctcaatttggcacccgccacggatgaccatcatttgtgacgggcaccaacttggagcctgattgagataacaactaggcccgtcacagataactcatccatgacgttctctatactaatgcccgattgagatcacttaatctctatctagttttaactaatatctctatctagttttaactaatgcccgtcaccgatgagtattttttcatttttcatatgacatgtttatatttgtgagttgacttgtagcaaaataattaactgcaatataataatttattttattagtcaataatttttcaggtagtaaataatttcaaatagaaaaattgtcaacaacaaagttgtataacttatcaagatttacaacttttattttggttattttttatataacttttttgaacagtttgaatttgaatttaaaaatatgacaacttcaaacagcattttgaaatactaaatgatttcaaatggaaaaattgttaacaacaaagttctatatcttatcaagatttacaactttcattttggtcagttttctatataaatttttttttgaatagtttgaatttgaacttgaaaatatgacaacttcaaaacaacatttcaaatactaaatgatttcaactaaaaaagttatcaacaacaaagttgtataacccataaaatctgtaactattattttgatcattttctatataacatttttttgaatagtttgaatttgaatttgaaaatatgacgacttcaaacaacatttttaaatactaaatggtttcaaatttacatatctatgttatagtttataaaaccagatgagagatatgtgaattttgtgaacaatgttactatcactttgtcggatgaagaaatgaccaaaataaaagttataggtcttgatgagttatacaactttgttgttgatgacttgcagttgaaatcatttagtatttccaaatgttgtttgaagttgtcatatttttaaattcaaattcaaattgttaaaaaaatgttatatagaaaaatgacaaaaataaaagttatatatcttgataagctatacaactttgttgttgacaatttttccatttgaagtcatttactacccaaaaattatttgaatttcttatattttaaaatttaaattttatatagttcaatcaaactcggatggagaaatgaccaaaataaaattggtagatttcaatgagttctacaactttttcatatgagttaattcggtatcataaaattcaatttgaaattcattttcacctagaagtctgatttgcctcctcttccctctcaaccttatcttctcttctcactcagtcctctctctctctctcaaccttatcttctcttctcactcaatcctgtctctctctctccctctcttcatttgggcgaagagtgggcggtgagccagcgacgcgggcggcgcctcagtgacttcaggcggtggcgccactgccatattctcctcaccgcagccgccgctgccaacgaggaggcgaccagctccatccccccccccccccgatgtcgatgacaacaaggaggaggcggcatcagcggttgagtgcggctgttctggccatatattttatatttggcttgtcctgaagatcctaccgtaatagatgggttccattggttttctgaaagttcccagctatacttttttcgtaattttctcatttcttacttctactgaaatgagaaaatttaattctagcagcatacatgacggttaagctgatttctctcccatatttgctacaggacatccaaaaaacgtgtaattagagataccgtaaaaatgcgtatttgctgtaggacatcgcaaaaaaatggttattagctcctggacacccgctgcattaatttattatttttggaggaataggagagagaaacggttgtataagtacggttctacccttattcttctctctctcattctttctctctttctctctctgctatttcttcaagtgagcccgagggagagggagagcgctggtgatggcatgggccggtgtagcgccttgactgtggcggcgctgcgcggtcatgcgggagatggtgccagagctagagggcaggttgtgccggcgcagttgggcggcatcggcgcgcaggcaagggcggccgggctcggcggagcgaccacgccaggagctcggctgctccaggccgacttccggaggctggaccggatggcgccggcgccggcgcggcgaggctcaagccgtcgttgcgggcgctcttctcatgtgggatgttcagcacctgcacacacccagcactcagcccaatggcaacgcccaacaacaatgttgtagcggggatgagtgggtctaagggcggatcgagcacgccataaggttggttgtggaggcggcgtcgtcgctggttgtggaggtggcggcagaggtgacggtggatgcagcagcgggcagcggcttcgatgatggtcaacgagcccgacggctgtggtgatggaggcagcggcaagcagcgctgggaagtgggcaacggtgatagtttcgatgacgatcagcgagccggcggcagcggcttcgattgcgacggttggcgagtggcgctgggaagcggctgccagcaatgggggttagatagggctaagggcaattttgtctttttgaaatttctctctcctctttttgataagaaatgataaaatattatctcgggtgtcctatagcaaattatacaaattttgtggtgtccatcaccagcgacacgattttacagtgtctcccagccaattatataatttttggatgtcctagggcaaattttgccttgaaaaaaataggccaaatttgtagtctagcattttggaagacacaaccctccacaacaatttgtgtgtgcatgctttaggggtgtttttgcctcaatatcatatattattaatacgaaggtgcaggtatcatattcgaaaaacataaaagtacaaaagcagcaatccaagaattttcctttggtaaacatggcatttaaaaaccacatcctagcgcataaacaggtgaggtttttacattcaaatttaaattccattaattgacacaaaaatagttcagctgcttccagtattttcagttagaaatatttccacccaaatagcatgagttgtcccaaataccaccgatatatgaaaaatacctggtaattgataacaaatagcatgagttgtccactcttagggaagtactggaagctgaatgtaagaatcttacaagtcagttgaatctagattcagatctgggataatttggatggtcagtcttgagcaattttatggttgttgaggaggtaccaaatttatgatagaaatagtcgtacctcatagtattttctcaaggactttaaaattcctcagcagtcttagctatgattttcctactgatggggcccttactctaaaccgtgtactttgttcacatataattcgctgtcatggaaacttaactagccctgacagccaaaaatcgtcaggaaaatgcataatcacgtaaggaaaatacatcctgacgtggcactgtcagaaaaattccatcagaactgacctatcggctggagcggagctagaacgaaatggagagaagtgacacttgcttaacttactctactttatatcgagtttaagctgatatgggtgcctaaatatatattgagggtgatgcatacaggtgaaaataggtgagttatagctacaaaattttcttaatcgggttcgtgggcaccctcgtcaataccctaactcagctcctgcctatcggcaaaattttaatttgcgtaatgtgtcaccgtcattggtatgttcactgcaaaccattggtgtatttagttcgataagcctagtatgatctttgctttgagttctcaatcgccacaatatttggggctcaaatgtttacttcactatccttcatcactgtgtgccccgttgcatcacctgtgtgtcaattttgtgtttggatgaatattgtacagtagatatacatgattggtttgaatgagaaagcatgtcgtagactagtagttacgttggtttaattgtgtcgattttgtgcaacatttacatccatccaatggaaccaacagcatccacgcgagtttgaactgaaaagcgtcgagttatcccgtttgaatcttctaaggatgaaattaaaagcaaatacgtgaaacgagataaccatttaacgcatgacttaaaaaatagatttatctaatattttaaaacaacttctatatagaatattttcggataaaatacaccgtttagcagtttgaaaaacatgttaacggaaatcgaggaaaaatatgtttctttatgaagtcagaatggggccttagacaaagaactagatagcggactaatttttcattatggacttttctgaggcataagatcagcactacgttttaatttaattagccagctcgacttaattttaaattgtcagtttgaattaactgaaacgtctctcaacttttcatttttaggaatgaagcatttcttgctttgcaccgtgggagattgaattggaccagagtagttcagttttcagaatagtggattggattgaaagcagtatgctagctagatttaactttgcacgctctatgtacatcgtgcagcacgactgtttccctcatttgctaaaatagtacaattctggcaaataattcaaaagccagcaagcaactgattaactaattaaggtttatcaaaggagacgctgaagaagcaacgctaggaaaaatggagcccagagatgacaaattttatcagacaaggagactgatgctgagtagaagagtacaacagattattcgtagaggaagcacgggacaagatgccatagtcaagtgtagtttacttgctttttttttttaaggaatcagcaggagactgtgctatttctttgaatatagaggttaaagaaaatacaacctctgaaggtaaagaaaaaaacatacaaaataataaaggcctatatttagttaggtaaaaactcctgaaacctccttgcacatgctatagcctatgtttttgcctcctcttttattttcgccatcaggctaggtaacacggtctctttgagcctaaaaatatattggttcatttccttccaaatttcccaggcgaaaagtaggattaggattcacagtcctttcttggacgcttcctttatgttggctagtctttcccacccgtcttgaacactgtgacatgggtcccattggttcggattcagtttgtttgagaaactgtcagtgcttcctctgcagcaagcttcttggacaaatcattgatgcagaacgaagcaagacacgagttcaactttccaataggtgaccctcttctgttttgctgattactcccaagccaataccattgggtttatataagaacaaaagaattagtgatctccaaaagtagttttcatatgtacagaaaggtgttgaagaaactagaatcatgggaatgtatatgtgatgctccttttatttttcctacaatgatgtggctatatattcggtatggatgtggacagggctgacaaacaatggaaccatccatgtagcctgcaactttggcactaactataattaatgctaattacttttattatctcttatgaagacatatcacacgaattatttgtagcatttggttaattattctctagctatacacacatattctcatttatacctagaactttatactatgccatccctaattatttgtagtctttgatctcttatgaagccacactatcaa

SEQ ID NO: 39708 - DNA, 4767 bp, Oryza sativa
ctaaaagtccattaaacttccttaaaacgctcttgaaccgccacgtggactcctacgaacgctcctaaactgccacgtggtgctctaataatttaaagaaaattctgagaaaaaagaaaaatatctaaccggtaattttcatttaaagcggtggacccaatactattgaccattggatcaaaactaaatcccccgttacccttctatccccgacccacatgcatgtacgtggacaattatatgtggtagctgcaaacgtttacttatttgattgcttgattgtcattgtcattaggcaggataattatatatggcatccgtgtgctcgattgatgcatgtatccagttcctgattttttttttctaaatacgcgatatacatgtacactataatttatcatcataaattattagatctatttctcacggagactgatttaggtgtgaacgtgcaagcgctagggatttacaataggagtgatcttggtgctataaataaacaattatttttagatgatcttcacgtttaatttaagatacacttgagcagctgtagttttttttaatcaaatcagcaattcaagaccatgttggctatttgctttactattatatcttacgggtcctcctcctacatatattatacaaccacgtatttatgacacatcacattccaaaaataattattacacgattatatttaaccatctaatcgtattcataataggctatgtggagcctcgcacacactctaaatgaaatgttcacagatggattatctctcaaactatgcaatcatattacaaactcatgaatttagtgtagcctcatgtgctaccccatacatctgtcaataaacaatgggcgatctagctaacatcagtaatccaattaaaaaacaaaaaagcacattgcttttactttacatttaatttggtaggcatgtttaatttctaaacaaaataagtctaccttctatttagatgatgaagaagattataaataattgcttatagaaattatttgaatatgatatggtataaatgtaactaataggttaaaattatataagcaatactaacgaaaaaaattgtgaatatatatcgtacttttaaattgtggcagattttctccggtaatattatatccttataagcttctcaaacctaacctatgatgcatgcccgcacattcgcgtggtcttatataaaacaaaacagaaaatagaaaaaaaaatgccaatatgaactacatttgaactaattgctgaaaatcttgtaacttattttgcttcattcttttgtcttagatattaatgatttttcttgcatcgcatcaattttttaattaagtggttagattaatgatttttttctctatcgtgcgccactgtattatgaatttctccgcatattattgcaaatataagcaacacactaaggttacagtacatagtcggtttagaagttatatttcttactactaaatttattttttaagggtcaagttgattaggtttttctttttaaaaaatacaatagatcacatatatcacagagaaacgagacctaggatgcatgcatatcatctctatcttattcatttgtaactaataattaaattgcatcaatataaaccaaataaaagaagcgctagctagatggtacaaatagaacacttttgatagcaactaatgtatttttaagatttgatagaaaaaagttagcccctaaagaaacacctagcttttaaattagatttaatttgtagatatgttttctaaatatactaaatatgtcttattttagatgatgaagaagattatagaaaattgcttaaaggacgattaaatattatatggcataaagctaacaaaaatatgttaaacatttatctaagcaacgcatcctatgatgcatgcccgcgcgaatgcgcgactaccttcctagttatatactaaaagtccattaaacttgcaaaaaaggccctcaagccaccacgtggtactctataaacattcctataccgccacgtggcactgtctaatctcaccgttgattttcatttaattggtggacctatcattttaaaccattagattatatctatatctatatctatagttgatttttatttaaattggtggacctattacgaatcattaggtgtatatataataccttccctatataaaagggaaaatacgtaccgtcggcaaaacaaaaaatcatatcataagtacagtacgatgattcggaaaaaaaaaacaataaagcttatgttccgttcggcggaagaaaaaatatctgtgtgataaagtaaaaataagtacatagtataatcgggagaaaaatataaaatataattttctaccatataagataaagagaaaaaccatatgtacttagttctatctatctatcttatacttaaaaatccattaaaaatcctacaaacactcccaaaccgtgacatggcaccctataaatactctcaagccgccacgtggcatcctaataaaatagataaatcttcgtcgatttttatttaaatcggcgaacccattatcgttagatttatcttagaaaaccaaaaccacccacgtcccccatacagtccaccacgccagagtgatcaattagtaggctcccgattcctttctgttttttatccctgtcatacttaaaactaaaattaactttatagaaaataatctcaaaaataggtgttaaaagtccattaaacatcttataaatatttttaaatcgttgtatgacattgttaaattagagaaacatccatccattgttttccacttaaatcgatacacacattattttacatcattattgtatctaatttttttaataaaaaacatcccaaaccatcttccctttctctccttcctctccttccgtatgggtgttttgctaagctgctacttgtctcacttaaattagaaaaaaaaaccttataaatctgagaaaaaaataatacccaaccatcggttttttacttaaacatcaacacattatattagatctacaatcaatatttttctaaaaaaaagaaacatctcaacccttcctccatccccgttcccatgcagtgtgcgatattacttttctcagctttttatatctctatgataattaaaattaaaattatttttatgagcaaagaaaagaccacaaacgaatctccacctattaggtctagccagctattatttttctaagcgaaaaccataacttaatgcccatattgactatatttaactgctaacaaaaaattacattatgaacccacatccatattgaagcctcttctcaataaagttaaaatttacaacaggacatcaaaaaaaagtataattagttaagagacactgcaagaacatatatctgctatgggataccgcaaaaaactggtaattagcaacctcaccgacggcgggtgcggttgctgcgtccaaggtgtttgcaagccagacttagtaggtaggggaaaagtcatacttttgttattgtctctctctgcatttcctttggatattataaaataatatcgcgggcctctagtagctaatttccaattttttcgatgtgccacaacagatacgtgttcttacggtgtccctcggccaattacatgtttttaatatcctgtagcaaattttaccttaaagaaaagaaaatactaaaattgctcactaaaaatcaaaatatcacagctcaattttttataaaactggtagacccattacttatatcttgttagacatctaacgactttctatcaactttttctcagcttatatataggagctatttacccatacattttgatattgatgcttttatcaataaatgatcacttcatgagataaataaataatcataaaatgatcatagcttctaaattatatatatgatctatgaagtcacgtgtccagttgaacaacatactgattgtactgggcacgttggttgcaccaaggaatcttaagaatgaaacaactatgatgtggcctcagcaatatataagccaattacagataggaattaaaagaccagatctatttttttgggtaaaacttcctacagtatattgtgaatttgtgacatatagcatagaataatctagaaacatgcaattgttacatgacactccagtttagtggtaatttgctaagaaaatactacgacatctattttaatttttcttacttaattggaacgagataatttagaattgatgcctttaccccatggcaggttgtaggatcaacccaatatattttcattctgacttacagagatcaaagcatttcaaagatgcttcataaagtggatttatccaaaaaaaaggagataaaaagaattgaaaataaaatgaaatttatctaatttaaaatttgtttttgttgggtttataacccattctaaatagaaatattcaaacattttatcaagactaataaaatgaatatatttaaaatttcaaacataatctaacaaaaataattggacattcatagggaacacatctattgtttcgacacaaatttttctcatgaattagaaataacacggtttaaagtaattttagttcaatttatatgttgctaagtaaccagcgttcaaagcacgtcgaattagtttaattttagtttacgataaagtgaaagaatatttttgatagaaaaccatccacacatggacattcgtaaaaaaaaatttacgcacatgcccgcgcatatgcgcg

SEQ ID NO: 39709 - DNA, 1983 bp, Oryza sativa
cttaaaaagcacatatgatatctttcctatccagatgagaccattatattgggcaggatcaaactaagaaccgacactaatctggcttcctgcagtggtaacatagttgtaccattcttcagttgttcatgccattcgatttcgtttgtttccttgttttggagatatctgtaattgagtaagcagacagaggaatttgtggggtggataacagacaatcagaaatggtagggcaagtgtggattagtggatccaacaatggtgatgaccatcaagggaattgtctgggttcataatatttacgaaaatttttcttcaaaacaattttcaaaatcatgccgtcaataagtgtaatgataatgctatggaaagaaatcacatcaaaactgtatgatcgaatacaagagctaaacctatcagagtagggtgaatgctttgaatgccaaaaaccaaataactttcagctaaaatataagttatcctcaaccttgatgaagtggcaatgtagctcaatctgacaatcagattaactccggactaaccgtagtacaatcgccagtctgactgttgtcttgctaccggttggaccactgccttaccacggaagtgaccgcccgtcgatctcctctcttactcgccgccgccggtctaattgcccattgtactccgttagaccgtcaggatccagaaaaacataaaaacgatgaaactcttgaaagtaaattgattttattgcatcaatatgtgtttacaaagtgcatctaaagcactcgtctctcaattcatgagctagaatcgaaacttcaaaacaaaccctaactttgacaattgttcataaccaagattaatgatcacatggttctacaaaaaccatgcaaaatatcatagtataagtctcatgacctcaaaaatcaaatttgaattcgttgaatcctaaacttaatattgcaagaatgttagtttacaatttgagatgatcaccttggaagaacaattttgagaacaacaaaaataataacatatattacagctcaccaagttaatgacattgagaacaagataatttccagtcatgacattaaattttgttatatagggcgaccactgcatagtcgctaccttggtaatgtcgatagttatatattacgacaagcccagatcaactatataaagctgtccagatatttctgcatagctgaaatcccaagttggtgataagaagaatgattggtgacagtggaataaacattattgtgccctcagtacatatcaagcatttcatccagctctatagtacatcacccaatttctgatgcttcccatgccaaaattgcttctgggaaacaacatattttacgctgttctcgcaatttgtgccattcaaaatttgtaccggagaagcattggatcgaaattcagagtactgcttgtaaactgcaaattatgctcatctgattttacctttttttttattatcttgtttgggtgcttgtcaatccagaataaatatatgaaaaccggtaaagaaagaataaatgtatgaaacattttctctagtgaatatagatggaggcacctgtattggtagataaatagtgatggtggacatggatagaaaaagaacgctttttattgagatgtatagaaagcttacgccacttgtggtcatgataatccataattcatcgttggttaccttttatgtctgcgattgcaacaagacctactattggccaaatttttccacgaggaaatttaaaaccgaaatatgtagtttgtggcaattttagaacatttgagaagaaaaaattattgaaatttctaatgctgaactatggtacagtgtatatgtcaaatatcattttattgagaggagaaaaacactcagctatatgtgatgtgtgtctgtccggatttgaacaaagttacatggatgtgtaaccaatctgagcaggctgttttttctctactttcgaatcataa

SEQ ID NO: 39710 - DNA, 10961 bp, Oryza sativa
  unsure (1)..(10961): unsure at all n locations
tcagcttcgctataatctgcatttccatgaggccttccaagacaaagaactggagctcaccataggactaaaacaacatgtgggattgcatgaagctgtgtagatctctacactttttgtgtagtaccttctatgctgaaatataattttaaatttttgctttatttgtaaagaggactattgagttccaaattttcaatgctggaaagaacatgagcttccgcgaggcctgagtatactgtaataaagtgctagagtaaacaggctaacattaattatatatggtgaaaatgggtttacaaagcgttcgatcgagaagcgactagcagttatatatggagtagatgcatcacgcacatatatatctctagcttcattttaactccagacctaccattaatatacactttaaagatcttgattacagagtacttttctgagttgcaccctagcatttcctcgacatattttcagacggacacgttaagtcactatgcttcaattctgaattaaaaaaaaaagatccttccatataatgtcaccatgacatggctgatgcatggcccatgaaattgaagcggcctcgcaagctaaaattccaaggtgcaatgcataacattatgttttactccaatgcctgcaacaaaaattcatgaagtattggagtgctcagctggttataggattcggaggtgttggtaaggcagcttcagctggggatttctttgcaacattattcaggcagggctcttgccctagtgaccagcatatcatgtctatgatctcaagcagtagcggcatgctagagtttgtacaccattggagcaagaggtgttggaaatttaattagcagcgtctcttcttagagcattgctagtatagtacaattgcaaggtattgtctagtaatgccatcacatttagttatagtaaattggttgctgggttggtaaactgattgttgaaaaggtgaatccatctccaatgtgtctatgtagaacagttccccttagctacttcatagtatgtgttaaatctcccagtttggcagttttatcttatcttcagctaaatcctttcatggttcgaatacatgcagctgtggattttttttttagaaaaaataaactaaacagtccaacggtagaaaaattgggcgacaaactatatgtgtcgcgcacaactagatcctcgtcaaacatatagtaaagcaaaataacccttaaatgtagcctgtagaaggcccaaaaataacctaacccagcaaaatattgagatatataaaaaaaaccctagctctagccttatcctctccagtctccttgtctcccctcccgttcgccccatgcaaccagccacagagagaggcggtgcatgtcaccaaggcgcaccggcaccgtgcactcctctagatctcgtcgtcgtcagtcgccatctctcctcccctcctctcccctctggcctcatgtcctctccagtgtcccctcaccctccggtctcccgacaacgcacgggcggcgtgcggggaggcgcatagtcacggcgcagagcaacggcacggccgcgcggcaagggcgcggcgaccggcgaggatatgtgatgtgttgaaccttgaactcatgtctgtgtcatgtgtttgcttggctggctgagtgtgagtggctggcagcttgctagactatcatggtgaatggtgaagtgttgtttgtgtattgaatgtcaaagtatttgtggactttgtggaattgtggtcatgcatgcatttagttaatggatggaatgatggatcaatatgtgtttttgctgagttttttatgatactatttaaatattcatgctatttttgatagtgtgtcaattatatatgtacaatatttgtcctgtgttgattggatggagatgctacccctgcatctccagttggggttggggtcgggggcagggctgtttttgtccnatccgnccntgccccgctccgttgccatccctagtgcttgaacatctagagccatcagaatacccgggagcatgattggcagcacatatatgggtagcaggaaagacgccatgtcccaagcacatcctcaacacaatctgttcgtgaatccggtttccactgaagcctcctaagccaaaagtattactgatcctgctaaagttaggaaatgaaatttatatataattggaaatgtcatgcatataaaaaaaatatcttcatttggaagtcatacctgttaaagtttgatgtagtaccctcttttttttattcatgtcctacgaagtatgaacaatacaatagagaacaagtgaacaaccatgcaatcagctactccaccatatgttccattcctttcgtatattacttttattgtgtgcaatatatggaaagggatcctctaacgtaaagttacctctgacgtcccgagagcagggggcccacatgtcagtcaccacgttcctctgactttacgtcggaggatctcaatccgccatatatacagcctctagtgcaagaatatatttgatggcacctcaaccagagcaagcaaaagcaaagtagctatgctaacagagatatataactcgtggaggaaaaagattggagaagcatactgaatttgagaactactagggtagtattaacgaaggcaagaatggcccatttgtgagtagtactgttattgtttttttttaggaaaaatacctaaaaattctcttccaaacctgcaagagcattctcttccagatcttttaaattccaaaacatttttcctgttcaattaaaagtacgacatatctgttacgtacgtaaggagggaagttcaattaaactaatgagaatgtccggttaagctagaacgtgtggctgtacagccacagtgctgctgtagttctagtagaaatttgcttgctaagtcctgttgatgtactgccacagctagctgctcctaacacgggcaatattcagcatgttcttttgcgctagctatctgcatattgtttagcaacatgtaaacacgaaacaatcgatgcctacgttttgcagaatgatactctgctgctcaaacatagccacatccgcagcaaaattatgaaggcacgttagaaatcttgaaaaatgatggccgccattcctcaagtaagtgcaagtggaggaattcatgaagatagtctgcaactgagtgggccaaacactcattggagccatgccttccgtttctacctgatacctcccattcccaaccactcctgtaaatctctcaatgcgatgaaaatatctgagctcctgagcatacaaaatatactgacttgctgctgataaagatgttatttgtgctaaactagactagagggcagaaaggcaataatagtttggaaagatagaatatatctgttggtcactcttttctttcagtgcctatatgtatgcatagaactaaggatttgagaggagaacatgtatatgtttgtcttcaggggtttccatgtctttatagatataccaccacatcacttcatgaaactttgggaggcattcaagagtgttatatctccatttaacacaatgatggaatattgctggctaacttagccgacgtgtaataacgatggaaataatggagtccaactttggtaggttcaaataattatctcttgttaggaaacagtaataatacacacactcactccctctgtctctaaaaacaaatctacaccttttatttttagggatggagggagtatatatatataactacagaaaactattaaaatgtacctccagtacctcctcgcagaccatacaatcactgttcgtaaacttggcaaagacacgcagcatgttttgttatgtgcaagaaaaaatacgatattcaggttgttgcacaaggccttaaaataactaattgaaaaaaaaatgctgagtagctagatagttgtttagtgggtgcgttttcactcataaatatgattgtggatcgcttattatatgaatctaggatgatagaatgtgacgttgcttaataagtcaatctgctctacttgtagcaattgctcttcaattaatgcaattgcatctcaccatgagattctcatgtcatcagagcaggtacaatagcaggctataagccagttgcaaacatattttaataaggagataaatgatgagagagaagggcagtgggctatagatttgtagccagctgtagcacgaactccaagacgcagtgtgtatgacaggtaggaccatgtattaataatgtagtatgtaactattttataaatgagctattagatcggctatagatgaattggagctactagttagctatactattaaacttgctctcattccttctcttatctccaaatcaggacaattgtgaccctgtttcatgcattttctgatcaacacaaaatcagttggccattgtgaaaattcaatcaccctggcaaacatgactggaaatcagaaaggagtgcaaccaattgtgatgaggactgatttgggcttgggtggcatgaggacagcattgcgaacagtaatacattgcttttggacaacgcttttgggctacattcttcatggccgaagacattttccagttctctacagcgcacttgcggaagttctcgattgcactacgaattgattgattcaaagtttgattcattgtccaacacagagaaacattaaacaatataatcaggcctgactgctcaacaatggcccagtgtgtccatggagagatgtacgaaactaaagcatcaaatctgggcattgactgtggatagttaagtgatcgaagtccattgcaggaaccctgaggcctgatcatgtatacatgttcctagcattttaattcattgttgtcttttgtacggcatgagtaaaatacaagagatttggatataagcaaggctgagaggatggtttttaagagttcttttccgcaagtcacaattttttcatttttcattagcacattttccgaactgctaaacggtgttttcatgcaaaaatttcctatataaaaatttcttaaaatcaaataaatatatattttttaagttttcaataagtaatactcgattaatcaaattgttcttatccatctggccccaccccacccaccgctctctctccctctctctctcttttcttccttctctttcttctcctccttgatctctcacactacctcccatcggctctcttgcgcgcccaccccacccagtgtcggcgacagcctaacggtggcgcctcccctccgccagattcgcccgagaggggaggtgtcggcctggcgcgaggtgtagcatcgccctccgccagatctggccgggaggggaggcgtcggcccggcgtgaggtgcgacggcccagcgacgccatcctctcgtgccaaattcgacgggaggggaggcggcgacggcagcatctcccctcctccatatccggtcgggagggaaggcgccggcccagcgcaagatgcggcggcagcctagcaggagttgtgtgcttgctgttcatattgttcttcctgttgattgatgtgtgttcttgtatgtctataaattaaattgttgtatgcaatatttttcatgttcttggatagccttcaatctcagggtttgatgaatgtgcttgtggatggggaagctgctgatggggaacacgctcaatgcatcagctcgatttgagtcggtgcatcgagcctttttttggctcacgtacgcctcaaaggtgccgattttgaaaccagcaccaatcactcagagtcatcaatgccgccttcatggtgccggttgggaaatccgacaccaaagggggttttccaaccggcaccaatagccctttctgtagtagtgaacttgttagtctttaatttaaaatcgatgcataattgtttcattatcgccaggaaaattgtgccgtgaatagttttaaggccctcaaccggcggtctgatcggccaacatatggcggtcagaccggcccactccgaggaaaccggtagacttccaaactttggcaatttttcctattttaatccaaggtgtcaaatttgggtgtaaacaatatttttggccaaaaatttttgagatccaaacatttgtagagctctctctactgaacctacaacgtgcaaatcataagcagcttatgttaattatggcatcattcagtatgagacacgcttagggctgagaggaatcaggagaatgtgacaaccatttgcataggttcctagtacgagttggcaaagtaaaagccctagttatcattccagaacatacatgggcatcgtctgatcctctgcggtgcatggtaaaggaggaagtcgatgcaggctcatatccaacgtgggtatcgagtcaagcactgaagacgagggatacaagcgggccaacccgcgagtttatttatatgtcaaattaatgataattcatgagtattcgcgtcatggtccggtttaccgcatcaagatatgcaaatgggtcgatccataaactcatttataagttaaattaataggtaacccgctgatcaaacccgcgggttacatactaagtttacctataagcaggttcgcggacaagctcacttacacctctactgaagagacttgttagtacatgtttctgcctttctgctacttgaaacatgatcatatctgctaaattaaaattcgaatttaaattggaacaatgcatatcaattttcctccctgtgtgatggatctggattatataatgttgtaatcgctatgattgtatatgatatagttttatgcctataaatgaaaataagagatttgtaaatacattatttgtacatcaaaatgttgttgagttcacgtagctcaatcattttcccacttgcctgggaccacaaaatcaatatagtgctatcatatcgatggtataaaatgaagcaggatagcgtgtgagaaaaaaaagtatattatctccgttctaaaataattgtatttgtagtacttagaaattgtcccaaaataattatctctacagagtattaattatcccatcaatcacttctcattcaaattcgttatattctactgttaatcactctcatactttcaccaatggctctgttatggcaaaggactgaaccacagaatcgccaatggcccacatgactgtccccattcaatgtatccacatctctaaattcaacaattaatataacttaacaacaacacttgtgttttaaatcgctaacggtgttgtcaattatccaaaagtatgttttttctagaaactttctacatcactaatatgattttttctaaaaactttctatattagtgttacttagataaccatttctaagaatttttaggtctatatatatacttaattcatgagcaatttgctgtgtctatactctctgcacagttatcaagttagaatatactcatgacttcatagagttcaacggatcattttcatacatgcttgtgaccacaatgctaagatgccactgtaatattaattgatggtattaattgtttttaatagcatcaatcaatatacccaagtggtgaagccaccggtgtattcacttgttgctgtaaaatcaaagatgtttttgattgttattctgtgatgaacaattgccattggagattattggttttgatatttggaatttatttacgaagtggttttgaagatgattggatttacaggtgagtaacaggtgttgttattttatgtgaccagtcagaccgggcagtgtgtgtcagtcagaccggcgtgtatcgcgcggtcagactagcgcagcctgcggtctgatcggccgactctgtgtcggtttcggtttcgggttatttgtttggatatctgtgattgtttcatgattatggcttctagatggatactatgcgtatgtaatactgttgtttgctactaatgagtcaagttggagatagcttggtctcgggatatggtttctttgtttatttcatgtgtaggtgactcgatgcctcgggagagtatttgcggtgatggaccgggagtcggcttggggataagacgacgtctgtggaggtcagagatcatgcaagatatatacttaggctagagttgatgcacatggttgatgaagatttcatatggcatacgatggacgtattgtgtgcatatgggatgcggagtcgaatttggaaggagtccaaatttggtatgagtggttatgtaaagtttgtttcttgtaatagagggtttcctaaggtttttaggacttctagtatgagtttggttcgtggctttaggctgcctacctcgggtataaatagagggggagcgtgaggattcccggtatcgcttttgagatcaattgagttgagagtttagttagggtttcgagtttagtcgaaatttttgtaaggagtgctgttggtgcactttgtaagcacagagagaatcaataaagtcgtcatccactttaagagttcttcgatttgtgtttcaccgggtttcggcggtctaaccggcggtgcactggcggtcagaccggcagcgtcacagcggtcagaccggcggggaccggcggtcagaccggcttcggcaacaagcgacaagagctgatctcggcggtcagaccggagatctaatcttagtcagaccacggcaaccaggcagaccgcgatccgtcgaattcgagggtaacttttatttccgctaaaagttttcggtttttgggtataccaaccattcaccctcccccctctggttggcttagttcttgtgattcgatcctacaagtggtatcagagccttgttttcttcattggattttaatcgatctagagtttttgccatggctgctcgttttacaactaagcctcatgttttcgatggaaccgatttttctcattggtgtagtaggatgcaatcttacattgtggctgaagattatgatatttggagaaaagtttttcatcctgaagagattaatactgctgctttaaaaattgaatttgaacaaaattgtaaagctcgcaatattcttttcagtgggatttctcgtttggattatgatcgtctttctcatcttcaaactgcctatgagatttggattgctttgagtaattttcatcaaggaacaaataacattaaagaacttcgtcgagatcttttcaaaaaggagtacattaaatttgagatgaaacctggagaagctttggatgactatctttctaggtttaacaaaattttgagtgacttggatctgttgattcttcttatgatgctaattatccacaatctgagatttctcgtcactttttgaatggtcttgacatgtctatttgggagatgaaagttacatctattcaagagtctgttaatatgtctactttgactttggattcgctttacacaaaatcgaaaacacatgagatgaacgttctttctcgtaaagttgattctaagtcgagtgctttggtttcttcctcttcttctttagatgttgatgcttcttcatctaagccttcttttcttgctttatttaatgccacatccgatgataaactcgaacagatcgaggaggaggatttgactttggttgctaacaaagttgctcgagctataaataatatcaagttcgggaaaagaggtggtccaaatcgttgctttgaatgtggttcgattgatcaacttcgttcgcattgtcctaagcttgggagaggcaaaagagaagacaaagatggtgagaagaccaatgacaacaagccgaagggtacattcaaagggaggaagatcaaggagaatctcaagaaggcttttgatcaagtctacgccgcgtttgaagcactaagcgatgtagatggagagagtggagatgaagataagggaaagaacatctccggtgtttgcttcatggcgtgtggtgaatcggagtcagagtgtgaagacaatgaggtaagtgcttttgagaaatctattaatattttgagtgcaaaaagtaagaagtgtgagaagatgtatagaaaacaggagtttatcattgaatctcttaattctgaaattgctagattaaaatatcttattcctaatgatgatgattgcaaaagttgtgaggttttaatgaatgagatttcaaaaattagagatgttaatgctgcacatgatttgaaaaatagatcttctctagttcttagttttgctttgcacacacgcactttggatgtgttgtttttaactaaaaagttgttgcaaaaatatcaaattgcttttcatgctagtttgatgtttaacttgatttgtgctaaaaagttcaaacaatctcatgatgttttggattgctcaacatgtactttgaataagatgaaactaaaaaatgctttaggttgtgttgagtacatggaagatgttgtgaaaaccaatgagttgctttcttgccccaagtgtcgtaaaagcaaaggtgtcatggtagattgtgaaaattgtgctaatttggaaaaagagatttcttatttgaaaaattccttgcaaagattttctgatggtaaaaagaacatcaacatgattttagatcaatctaaggttagcacccataatcgcggtttaggttttaatccttatgctcataatactagacatcctcgtgttgtgttaggtgttggtgctagaagtagtgagattttggttaaaccttatactaataaaactgtatttaaatctgctggtatcatgtctaccttgggtgcatcttcttcaaaatccaatgttgtgtatgcaaaacgtcatgttgttgcttgtgtagctaagtcttctgattctactaatgtgtctaatcatcgtgaaaaatatacttgttctttttgtggcaaagatggacatattgttggtttttgtttcagattagctcataaacagaaaaaggagagagagattgcttttgcaaaatcaaagtggcaaaaatctggtt

SEQ ID NO: 39711 - DNA, 934 bp, Oryza sativa
ctgcagccccttagtaaaaggctctagttatttttcctgtttttttctttatcaatttgtattctcgagtattaatggtactatatttgatttatcttcttatcattgaaggtccattaagccacaaacttcatgcgtacatcggtgaaggtgcataagttgacgacagaagatgcaatgaatacattcttaccatcaagaataaatttttgcgtcaccctgagaagttccatgcattcatacacaccatgattgatttctccaggggcaggtgagtaataggcattaacatagggtggttgcttacaaaatcatgactggatagattggagcaagaaattctcatgtgttactagttgtatgtggataacaagttttattgaaactttggttatgcaggattaacactcatactgttattgaacgtgtgaagatcctttttgatgggtatcctgatctactccttgcattcaacaagttcttgccaagaggcataaatgcaatatgatgaagaattttgtctaaatatgtttcctcgtttaaggctcaagctcactagctataataaatctttgataactttatgagttggtttactcatctattttaattgaataatttagcaatgctacatttgttcttatcgtacttgtctaagtacctaagtgccgactatattttggagtgctgttattcttattttatctatgccatctatttggtggagatagagattctaagtagctagtgagtatccatttggtgaaaaatctagagaagctaaggcatcatttgatgagattctctaattggctacttcctcggttatcgtgaacacactaactaaactactacgatgatttttttccaaacattttctgtatagaagtttattttaaaaaaataaaacatttgtcatgtttacaatagttgg

SEQ ID NO: 39712 - DNA, 723 bp, Oryza sativa
gcgtagaaatctgcaagatttatatcttaagagaacaagctaaggtatgcttcgggcccggcctactcttgggcccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagggctcactccctctgcctagaggagcatcgagacgtacaaatcttggaatattccttcaccaacgacatcttcgagaaactcatccgaggattgccaaacttgccgggaagttgggcgtgctccatagccagctgtgaggcagtatgccccgccataattgaaacaggatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggttctcaggcccaccacgcaccacgtggcgagcacactggtgagatcctactgtctcagatggagcccggggtaatatgaatcgcaagactcaaagggtttcttgaagactgtgttagggaaccagccggcgacaataagacagctgataagacaagactaatagtagatt

SEQ ID NO: 39713 - DNA, 727 bp, Oryza sativa
agaaatttatacaaattcatattcatgaatatgcaccattttggattctaaaacaaattaaggacatgagtacattgttggagttctaattacatgatcttaagctttagtctataaacaatcccttttgcttatgcggaaaaataattgatctactgacctgagttagaagccttaccgttcttctttcttcttcttccagagatgcctcacgaaccccttccagtgcctagatcgattgggcgattaattagggtttgagattagagagagagagagagtttggtcgtctgcctctttccttctctttctttatataggcgacactggtggggctcgggggttatctcaattagtttaggattctgttttctgtaccgatcacataaaaaacaaatttattcttagtttgtttcttgtcaggataaggaaaccgatggtttagatcctctcctaacccttatcgacacaagtcgacaaaatcaaccaacattctccccttgattttgagacttacttacgagtttattaaataaaatagctccccaaggcaatgtgtcttcaacaacattatgcgtcactgagacaacaagacctatagctcactatagtactcaaataaactcaagcttaacttagtgggtgttgattgaaaaatttagtccccctcatccaggatctcagtaaggctctaatttacatatatactggccagaacataatctta

SEQ ID NO: 39714 - DNA, 719 bp, Oryza sativa
ttcctgcagcccctttctagcaggaagcttggacggcagatggcggttttgttgacagtaattatcttcaacttggaaggcttccccttctccatcttaacaggtcctttccaacagattcctcatggctttcaccaatcatggaggattcaagatcttctgtgaccactgggttcagtttctgttttctcctcgccaggagaaatggaaagcttttgggacgatggactacttttaaaatttttttcctttagtatagtgaaaaatatgataaactgtaccataaaaaaaatgaagggacaattgcttatttaaccccttttcagagcctaactaccaatgtaaccctaccttttctagttagttcatttgaccccacttttcaataacaaaggtaccgtcttaccctatttcattacaccgttagggttatatatatttagtaaaaagaaaaaaaaatcaaattactattcaaactgaccaaaatacccttgaggacccaaccctatccattcactcccaacctcatccctctcggctggcactaggtgaggaggccgcgacggcagtggtgtgcagagaaagggagcagcgcgctggtctatctgccataacagggtcaaaataagcaagggcaaaagggactatttgcccttagttaacactgttatcttgacttcacaaagtagggtcaatcttcatcttcgattttgaaaaac

SEQ ID NO: 39715 - DNA, 733 bp, Oryza sativa
ctagttagcactggttttataagttgaggaacgcgttgtatctggttttgcggttcaaggacgattttgtaattcgacgacaagttgagggacctttggtgtacttgttcgtaaaagaaaagaaacaccggcccagtattgataatgaagcccagacggaccaacaggccaagcccatcttatcccaagaaaaaaaaggggaaaaattactcctttctaagcgaaggcctaggctaaagaacagagaagagacctgctcttgcgatccttctcactctcttcctccccgagtcgacggccggccaccgacttgggggaaaccaagccaccgccgccgcagccgccgtaccccaccctccctcccggcggccgcgggccatagccgcgttctcccccgcgcgtctgcctgcggcgtggaggcgtggggggcgacggcgatggggtccatgacgatcggcgccaagtacaagaccacgctcaaggaccccggcaccaccggcgtcctgcgcatggtgcgtcgcgatcccccctctgttcctccctccctctctctctcccgcatagcgtcgcctctctccctccagctccgattggtcgggtttaacccttgcggccgtgccctactggatacacactccgcgggaggtgcggtgggtgtgctgattctgtggagggatgtcgcttgacgggagggttttgatcgggtgttggtcgcggtagtgtttgattgggt

SEQ ID NO: 39716 - DNA, 1270 bp, Oryza sativa
cctgcagcccaccgctcaacacacggcggtcagaccggcccactcggaggaaaccggtagacttacaaattttggcaatctttcctattttaatcctaggtgccaaatttgggtgtaaacaatcattattcttctgtgcatccttataaacaagattaaatctcctgcgatttagcctaggaccaaagaatgcaacagaataccccaaagatcatgaaggaaaagaatcgtctcatctcatcttgtggcctgtaaacacaattcaatcaccatgacccctatcttgggacagaactggactgaggcactatgtgaatcaaccctaccggaactaatggatccaagcttgcttctccatgcaatcaagataccaccagttgcccccaccgaaggaactttaacaaaattgttatcaaatcagacccaagcatagccaagatagtgaaatgaaggaagattgtcatgtttatagagttgggatgatctaggtgacaattaattgtttgttttttaaaaaacaatagaaattttgatagagatggaaatatttgagttgcaaatatgcgtgtcatatcaggtattatatagggtgtcgcatggagtgttcagacactaataaaaaaaactaattacaaaatccgtcagtaaaccgcgagacgaatttattaagcctaattaatctgtcattagtaaatgtttactgtagcaccacattgtcaaatcatggagcaattaggcttaaaagattcatctcgcaatttacacgcaatctgtgtaattagttattttttcgtttatatttaatactccatgcatgtgtccaaacattcgatgtggcaggttgaaaacttttgctaggggatctaaagaggcccttagaatgaagattcaagatttggtttgaaaagtttaattccttctttttaatgattggttgatactgaaccataaaaatttgtgttacatagtctagtatgaatgtcttttcagaatcaccaaaaataggtttgctacaattctgctgaggcgagggataaatttctagacatcacaaaatttctaattaagcttccgtgtgcgccttcagttttttttttcaccataggtctttcctttagagaagtgcaagggacgtgctcatgttcactagcattaatccgttcgtttccactaaaaaggttaataaaattttggatatttgtggcacgctttttaaattgctaaacggtgcgttttgtacgaaaactttctatataaatgttgctctgaa

SEQ ID NO: 39717 - DNA, 957 bp, Oryza sativa
ggcggggtgctgaacggtgcacgaaaccctgaatcaatcggcaagtgaaacggctcacatatatgtgcgagacatgtacagaaagatccttaaaaatacttacctctgtgcggagggggagtcggcctaggaacgtgcgcagctggacggggaccagtcggtacgggtggccgctgtacagctgtgtctgcccgagcaacgtcgtctgcacgacaggtgagcactcggagaatcgactccaccatccgcgtgtacgtcgtccggtgttcctctacgggtaccggaatccccgcgtctaaacgttggctcgtcgttgaaccgtcaacgacgacccggttgatgtcgtccacctgcatggttattttgttcatacatattcgtaaaatttgacgatgagaaagacatgaaaacataaaggaatggtgcgatgcatgggtactcacacaacgagcgaagtcctggtcgcggtgcctggcgtagaggtctctagtgctcgcaatgtggggctgttgctccaagggagcgaaggtgaccctagtacgggtgcgtggctggtaccagcgtaggtaggcctagtacgcctcctcagtgtgtggctctccctcgtggtccacgacctccttggttgcgagcaaccagttctcaacaaaagtcgccaacttggcgggccagtcgccagctgactgctgacccttgcgcgagtgcctgcgaattaatgtactagtgcgaaacgtgccgtcagatcgtcctgccagtccacagccgtggtcactggcccaacagtgtctcccgcgagcggtagccccaacaagtacgatacgtcctgtagggtaggggctacctcaccgcatagcaagtgaaaagtgtgcgtctctggcctccatcggtcaaccaaagctgctaggagggacttgtccacagtccatcgtctggccgggtccacgtggccggcggcag

SEQ ID NO: 39718 - DNA, 1008 bp, Oryza sativa
aattcctgcagccctatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacaaactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaacttgtttagcaaatgaactaaatttctatatattctttcttcccacacacattttctctctcatcaacttacaactaaattttggagaca

SEQ ID NO: 39719 - DNA, 1618 bp, Oryza sativa
aagtcctcaaatattttgtcgatctttcgccactatgacccgtcgacagggtgtctaacatcccgtcttgtttacgttcttctacgtgccagcgcatcattcaagcatgcgctttagtcttgtacatatgtctcagacgtggtattatagagaaataccacatcaccttagcagaaactctcttctttgaaggttgtcggttaacttcatcggggtcatctcgtctaatcttgtatcgtgatgcattacaaaccgggcatgcttcgaggttctcgaactactcaccgcgatagaggatataatcgttcggacatgcatgtatcttctagatttctagtcctagagggcagactaccttttaagcttcatacgttgtttccgacaattcgtttccctccagaagaatattctttacgagtttcaataacttgccaaatgccttgtcagtaacgccattattttgccttccattgcagcaattccagcgtggtacccaaccttttgtgccccctgttcgtaacctgtgtacaataacgttttgtggtccactaacatacgctccaatttttggacctccttttcactttcgcagtctttctttacgtcgcacaatatctgacctagatcatccgcaccgttgttttcttcaacagctccacccccatcgcctgttgtatctgcaaatccaccgtattgagcccagtctggaacgttgtcattttcttcatcatcttcttccattgcaatcccaaagtctctatgcaaggtccaacaattatagctaggtatgaattctgattgcaataagtgggtatgaagagtccttgatgcaaaatactctttctagttttgtactttttgcatggacaatatataaaaccttaggcctgtgggcattggccacataaaaaaaatgtacaccatcaacaaactccttcgatcgtctatccgcggtatgccggtatacatccattgccaattcatctacatcaaataaacaaatgttaaggaaatccacgaaagtgaaaataattaaataatcatataatatttaaaacatcataattaaactcacaactgaagtcacaaatctctctgactatttctttaagaaaattgtaaatatgcttttccatgtattatccttttaaaaaaacattttacaagtttttaaaaaaatgaaaacatatttttaatgattttttcttatttctaactattttaatgtgttaaaaatggacttagttttctattttttttcttcattttctacaattttcctttgttttatttttttaaaacatttttatcaaatgtgtcttattttctccaaatatttttctctccctctttttccatatacttttttgagagataatgacatataaaaacatagctagaaatgtaatatgctaatcatacatcaatacagaataaaattgctaacctttcatatcccttcgatttgtgtaatatcaccaaattattttcacgaaaaattttggcaacacctcctttccttctccaacctcttggcagcaatgacacgggccgaaggaggaagaaggcatataatttttagtactggttggtgttaccaaccgataataaagatcat

SEQ ID NO: 39720 - DNA, 892 bp, Oryza sativa
taattcctgcagccctgctgcagtatatctgacacttgcttctcgatttcagtcttttgcgcagggttgtaatggtaagggcgcaagttaacccgcgacgccctggcaaaagtggaatactgtgatcaaacacacgagaaggaggcaacccagttggttcatcaaaaactgatgcaaattccaacaacaaagtttcaatatcagctggcacaattgtctgagaaggtttcacaggtgtgtccaccggacagagagccactgcctgcaagacaacattatgatgcagcaaacccttaagctgattgcaggtcaccggaggacaatcacttgtatcaggtataactccctgtaatgtcacttgccgattctgccactggaactgcaaagttttgagtttccaatcaatttgcattgggctatgccgctcaagccagtccatgccaagtattacctcataacaacccaacggcaaaactttcagaggagtactgaaagattctccctgaacccaccattgacaatcaggaaactcccttgtgcacttgagtaaacctccatcagtaattttaactgtcaacggcgatacagaagcacatattccctacaatcgatttgccaattgttcactgataaagctatgagtgctgccggaatctacaggcatcaagacttcatggcgctgaattaacccttgcaaccgcattgtcttaggagactcaatgcccagaactgcttccctagaaatggccagcaattcctctgtttcaggttcatcaggagtagcatcattggtgtcagattcaacaacatcctctgagggaaataattgcaacaattcctccaccacatgtaattgcactgtcggtccacaacgatactcctgactcctctt

SEQ ID NO: 39721 - DNA, 3800 bp, Oryza sativa
ttgtctcaacctattaaactagcgcaccaaacgctggaactcctccctaccaaatttcccacacacccacgctgcaaattcttcccaactaccgctaacttcatgagcatgggtggactgcaaccaagtcaatgcagcacccgtgaactgaagaatagccactccaatccagtgatctgaatgagttccacacaacccaaaataagtttcacatttcagtttccatgccttaggatttcccccatcaaaaactggacactcaaccctagatgtagtgttttgaattccccaaaccctaccccgcgaattccctccaaattcatgaacataattagtaggggaaaaggaattgaacgcaccttgaccgggagaaactgtgaagagggatttccccacacagccttcccccggtgattcaagtccacgcgatggctaaatagcccatgagattcttcaccgcgctcctgcggaatcgagcgctcctcctccttcatctgcttcagcttcgggcctggtggagttggaagcagcgcaggtaactcgtcaggcttaatgttgggaggagtcgaggaaggcgctggtcgctcgtcggccttgacctccggcgtcgtccccttggcgagttgatgaacttgcgccctgagatcccccatctcctcccgcagctcggtcaccgccttctccaccgccggtttccaccccaccagctccaccaccattggcttgatttcttcgatggcccctatcgacaccttgatggcgtcgttttgcttttggattgtcgccatggtcgtcatgagctcgctcagctgctgctccatcttgtttgccttgagttgcgctcgcgagtgatagcggggtttctccaagtactccaggatcgactgctctgatacagatttgtcacgaacccctcttgagaattcggtcgaacaacttgagaacgaggaaggaaggaaggaaggaagagtccaggaagaacagaggagttgggagaggagagaggattggaattgatttggggaagatagtctgtacataatatttttcaacgatcctctctccttgcctgggtaacatctttatagactcagatgttcccttacacaacccagtccggcccactcacatgggtattgggcttcctttgtcttgtgcctttgggccttgtcttgataggattagggtcggtaacaagagggagcagttgattacaagccctgatggcagattggcagaggagccttttttttttctgtcaatggaagattacaaagcaggatcaccaaattaatgggagtaaagaaatgttctgatcagatcgtggttgacgtcatgcgttgtttgttttgtttgtccgtagcttgttcaaagattcctcggatcatgcgatcgccaagagtaaatttagtactgctactctccaagttggtgtgctgaaagtttcagaaaatattttcaggaatcagcgaactgcctcttgatgatgcccaagagataggcatggcatctctggatggttcagtatactagttcattttggtgtgataattgttttctaaattcggcaaatcaatgatggtttaggaaacacgttagccaaatgctccgaactaaacttctgtctactgattgagctcgtcagatcagcagacaatacacagttggtgtattgcactcgtctgattcggaagagtgtcctggctctgcaatctttttcacccttgcagtacaattttgacattccccatcagaatttatgaacaaccggacaccctgacataaccaaaagtcaacaaatagatttttgtcaaaaacaacgccattacaagtgcaattagacgactcctttcgcatcataacatccagtgaaatcactttttgactattaaactccatgcaaatgcaacaattaatcaccaagtgtgtttatattttcttttcttcaggtgtcatctgcatcctgccacaagcccataaccaataataaaccccccaaccagagagaatggggttcggttgctgccgtcatggccccgctgtgatgcgggccccacccacccccgtaacgcgaaacggaacggaacgtgggaaccgcgccgccgtgcctcaccgtccccacgccatcaccgtgaagatgacatgtgggccccctggtcggtgggccccctgtcggtgggccccgcgtgtcagcggtaggcgacagtagccgataccgtgccacgaggaatcgcgcctccgacgtgtcgtttcggcgatttcctttttttggtttgttttttttatggtacctttcgtactctttccttcctttccgttcagctttggcattttcttctgagaaagagaaacctcgtgctcggcgaggcccaatatttcggcggaggctgaggcggaggcggaggcggattgtctcctcgccggcgttcagttcagtcgccggataccgtcgtgagtcagctctccttttccctcccgatgcatcgctttgttggtcgcagcggcttccgctgtcatcgcgtgggggcgttaaacccaatgagttttttgtgtgtgcgtgtgtgtgtgtgtgtgggggggggggggtactcgccgctcggatcgctggcgacgagcactccgcgtaggctcgtcgcggccacgtacgccatcccgagctcgggggctaccccggtcggaggcggagcgcttgggggccggggtttaatcgtgcggaggactcggtagggctcgccatacctcgcgccgtccggcggcgcagagcgcggcgtcgccgctggggagaaggacggactcaacgagacgagcgagcgacggccgacaggcgaaggcgttctcgcttcttggcctctcgccgttgaattggagacccacattgggcttgttttgtgtgttactagcatcaccaagagttcccctactactcccaatttcaaattttggggtttttcgagcaaaaaaaatggatccaacagatatccaaaccagcttccaaaaattttgagaccctaatcccgtgtttccgttctccaccagagagaatacctcccgctcccaatccactgcagccgggcagttttcgcgcgctgccgaggtgcttggttcccccatctccattgattccccatctcgtgcgattggcggagctgatgagtgacgacagccacgggcgagcgggaggtggcacgtcgacaggcggcggagggccgccagcgcagctgcggcagccggcaagggcggctgggtgggctgcaggctgtggctgcagttgggcagcgcggcagtagcaggtggcgggccaacaagtagcagggcaggccggcagcagcagcagatcaacaggatgattcaatctttgctatttgccttatccaccttaaagatagcctattaatcgatccatctttgctaggagtatctgttttgcagattatttatatgtctatcctcctttggctatcccatgtactgctgaaacttcattacttgaggtaatttttagtgtcatgaggggttgttgtcatgcttaatatagacttgttaagataatattgtgtggtacaatgtggtgcaatttgagaatttttttcccattattcttgggttgattctcatgataattcatgagccacacctcttctttttttagtcctctgccactgatcgtgcgtgtgagaatttgatagtttatattttggtgtggttcgtggattattattacacatggacagctaatttgcgcacgacatttgtttttactattttttcttgtgaggtgacaaattgatttatttttcccc

SEQ ID NO: 39722 - DNA, 1899 bp, Oryza sativa
ccccgagttccaaagacgtttagctcatatgagatgttggctatgctatatgtgctgcagggatgcgttgctgttcccttgtggagaatcttcggcttgttttccctgactgtgaatcactagttgcattgtacggagtgtgggtatcatatattacaaactttgtgccaaggaagtttgacctacaattcaaaatggagacatattagcagcagcaataatttttagattaaaatggggtaagttctgaaataaggttgtagtttcttcgggttaatacctcaattttccaatgtttgtgttggtagacctagataaattgttagcattcatagatatcacatattctgtacatgttgcatgccagtttctttttgctgatagaaggaatttgccattgtcaacaagcacagctgcagaaaagggaaatcaaaacatctaaaattagtaaatgctggtactgaaatactaaaagtattccagcaaggaaacaaaacatatatgtgcaccagtgacggagcacgcgcaaaaattagtgggtcagacacacaagacatactgaagtaaaagaatgacaatgcttgcatattaaaacggtacaactcataagacgattaaaaataacaaacaaacaacggtttccaccatataatattaattcgttgtgcataaaaatattatgagaagttaagaacatatgccgacatcaaagcagctcaaatatgtcttgcatttacacacataaaattagtaaatgtctttccatacatctcatcccgagattccctcctattttgtttcgtcgtcatttcctaatatatctagtcggcaattagctaagctcacttgatgttactagcaggcggacgcaaggcaacagaagaggattgagttcgcacaacagggctcaaaaggctagcagtggtcgactttgaggcccgtgccggccgatggcagagcttgtgcagctaggagctcaatcgaagcacgctgagctcatcgcctcattctcacgatgcatgcgtgcacaacagtatagccttgaggccctttgtatctgatgtgcactatgttacctataattggaaaccaacaatgacagatgcacaccacatggacacagcaaacagatagcatgcaattccaatcaagcaaaggacacagcagctcaaattacaattgcacagaaccagtcccacttgtgaatatactcgcaccatatgggtgtcattgaactattgaagtggttcgaatgcaaacaatctcaagagaacaacctacttgtgcataacaacgggaatatattttattagtgtactgttgcttaattgacattatcatggatcaggtcaactttttttccagattgtcaagtcaagtagtaaataccaagtggtataggtcaggtaaaacagtagaacaagtgcatgacagaggtatacaatactaaaaaatagcacttaattatacataacaactattgtgtgctgtatcctattattttggttacaaaaatgagacaacttattacagaattgtagttataaagaacctaacttaactgtatgaaagccaaggaatgctgaatgatctgttcacaagttcgcttgtgcatgattgtggaagatagacaatgacaaataaggaataatatgtttctagcatattcatgtcaaatgataaacatggcaccaattaccatcccaaggcaccatctaccctatgcaagggctataagaaagaacagctcttcatttgctatgcaatacaagcatagttttggcagaatatatgcactcattcagcagctcacaagtatatacaactacatatgaatcttcttatgcagaagcaaatatgggctctggtacataggcgcatacaacagggctgcaggaa

SEQ ID NO: 39723 - DNA, 1368 bp, Oryza sativa
attcctgcagcccatggacgaactgatattgcttgtaaaggatataaaactaaaaacaacacaatttgcatgacacctgcctcagagaaatagggaaggtgatcttcccacacaactctggattcttgacgatctctttacacatctccctccatgttctgcagacacccgcacaagcaaccacatgcttcctagaaggccatgtagcctcactttcttccaacctctcaatgatatcacgaagcaattccggaggcaagctagcccagcagctgctctggattacaggcaccgggtcatgcaactcatggacagcaccatgagacttccccctgcgatgccccagaatcctgacctcaaatcccctcctcgataggctcccaaatccatccctcacatcgcgcacgatgctgcgaaacgacatctactctctgaaaaaattgagatctctcctcagctaccaaaagggatctatacttttcgccaatgataacatcccagagtaattccagaccaactcaaattctcctcattattgttgaccccgcaaaaagaacctgcagcacaaatgaattgaattggtcaagattaatcttcgattattctttcttgaaaaagatgggagactagacgacggtgccgcgcacgatggcgacgttgcccctgccctgcgggaatgcaggtcacaatgcccccaattatctctctccacaccgattgcagcagcagtagcagggcggaagctacgagggggcacgcgaaaatgctggattcggcaagcctacctaccaacctactccccggtctcccgcgccgaagatgcccaatcgataaacacgaaacaaaattctctgctactgcaaaccttgtcgtgctcgcgcgaagagggtagacgcatcgtggaagagagcgcccactgctccgccggatcgagcccgccccccgtcgccgcccgcgtcgagccccgcgcgcgcgctgcccgcaccggatcgagcgagcgagcccttccgcgcgtagggtttggtcggggcaaccaattgggcggaagggggagaggggaagaggaggaggtggtggtggttgccggcggcggagatggccggagacggcgggatcggcggaggtggggatgcgatgcgaggcgtgtggtgtgagaggagacgaggcgagagtgtttgggatttctttttatttattttaacgtgtcgtggtccctacttcatacggtgcggtggtgtgtatattcattcccaccaatataaatgtgaaaaattctagaatgacttatatcgtgatacagatgaagtatttgatttgtttaaactttatgttaagatataatcatttctctattatcgggctgcagga

SEQ ID NO: 39724 - DNA, 2043 bp, Oryza sativa
tttagatcccatcccaaacattttacatcatgtcacatcaaatgtttgaacacatacatgaagtattaaatataggctaaaaaataactaattgctcatattgcgactaatttacgagacaaatcttttaatcctaattgctgcatgatttgataatgtgatgctacaataaacatttgctaatgatggattaattagacttaataaattcgtcttgcggtttactgacagattctgaaattagtttttttagtagtgcccgaacaccccatgcgataccctatataatacgcgatatgagacaccaaaactttatacacctggatctaaacacccccttagtcttttaaacattgtatttgtaggtgtaacaccgtcacctcttatatcaactaaggtaattatttatctggatactgccaataataaaggataatctagttttttatcttcgtgaaaaacttcaaagatattatcccaaaatacctttggatacttcggagtattttaattttaagagtattcacaattaaaacttgactgttgattttctttcaaaatatgcttttagtagttataaaatcagagtctgaaagcatttttagtattgaatgttacaattgttatacggtaaatatatttgcagtattgacctactgttgatttaaacctataaatttcaaagtattactatctaataaaaacgacataagaaaacgacatgaataatatgataatcatttttgctccaatacaacaggacatatatgttgattaaattatcggagtcatcatttggcttatatttatgcatatttgtattacttattagcaaccaaataataatttatagatgaaaagtttatatacgtatttttagcaatttaaaaagtaaatactgccaaataaactacaatgataaaaccataaaataaacttcaaatttgaattttaaattttcaaaattggtttataaacatacatagcgaaacaatgggattatctgtgtagtgctgctgatgcattagttgtcagcttctgctattgcatcagcattgcagacgttctgcatccatagcaaaaagatggtggtgtatgtaaaaaaaatcgtttgcaaattgcgagttacggaagcgctgtgttactccatccgtcccataatataacaaattttaactttctacttacactgtttgaccattcgtcttattaaaaaaatttggaattattatttattttatttgtgacttactttattatccaaagcactttaagcacaactttttattttttatatttgtacaaattttttaaataatacgagtagtcaaacagtacccttatattaggggaccccttatattacggggacggagggagtacatttattgcaattatgcggtcgaattttccgtacgctctctctgcccggcagcacgtactgtactgccgatgatgctgcagggtcactgtgtatggtcctccgttctgcatctcggcgatggctctcatcccgggcccaccaaggcctggtcaaaagtcaaaactaacagccatatacgccaatatgacatgattactgtaaaacgaaggtggtaaaatgtgatattacagcaacaacaagcagcagcaaagatgcccggtccatgcagctaccattcaacatacgagttgaccagtcaacattgaccgagggccccacacacagagacccactgctttcttttcacatcgccatctggctagcaaggccaccacattttgacttgacttcagcattcatggtcaggaagagtacccccttgattgagtaaaacaaagttggatagaaaaaaatgatgaaaactttagaatacagatggagcccagtatcacatggaaattttacaagtagagagaatcaggagatataatgatatataaacaacaagaggagaggatcactgagctagctataaagcattgaaattgttgtcacttgtcagtagtcacagataatctgccacctctaccatcttgcataaacaatctgccacctctacc

SEQ ID NO: 39725 - DNA, 750 bp, Oryza sativa
agagagtaaatttgaacttcagtctaattcctgcagcccccatagcttataagcacttccggtgaacaaattgctggacccgactcatcatactctccctttgagatccacatctgtagcatagatgccaaaagaatgatgttaacagaaagcagaaatacctgcattcttgctacctcataaagtgtaggcgtaaggtttacctgttggaaggtgctaagggaggcaaggatggaccctcctatccagacactgtatttcctctcaggcggtgccaccaccttgatcttcatgctgcttggtgcgagggcagtgatctccttgctcatacggtcagcaataccagggaacatggttgatccaccactgagaacaatgttaccatacaagtccttcctgatatccacatcacacttcatgatggaattgtaagtggtctcatggattccaggagcttccataccgatgaaagagggctggaagaggacctcagggcatcggaacctctctgccccaatggtgatcacctgtccatcaggcagctcatagctcttctccacagatgagctgctctttgcagcctccagctcctgctcatagtcaagggccacatatgcaagcttctccttgatgtcccttacaatttcccgttcagcagtggtagtgaaggagtaacctctctcagtaagaatcttcatcaagctgtcagtgaggtcacgcccagcaaggtccaaacgcatgatggcatga

SEQ ID NO: 39726 - DNA, 725 bp, Oryza sativa
tttcgacaaaagatttaactgaacgccgtagcccagaccaagcaatggaacactccagcatgtaaggtctgcaagatttggtgctgtaaagaaggattctctcccacccagattcgtccctgataacgcaaaatgccagcatcaaaggaaaaaggtggacaggcatccggttgcagggtaagtttggcaatcagttgagtggcgtgatcatcctgagcatagccacgctgaacctcttccaaccatacgggtacacagactgaaatggaaagaacttcccctgaagtatcctgcgcacggcgagagagagcgtcagctgcacgattgtcagtaccctttttgtagaccaaacgatactgcaaccccaataacttcgtcatagccttctgttgccaaggtgtggtcaacttctgatcacccaaatgtatcaaactccgctaaagtacggatcacaaattcagctccttgcaaatatgagcgccaatgatcaactgccaataaaatggccaaacattctttttcgtaagtagacagtcctcgattgcgtggtcccaatgccttgcttaaaaacgcaagaggatgtccatcctgcatcaacatagctcctatgccaaaagctgaagcatccgtttcaatctcaaaaactttggagaaatccggcaaagccaataccggggctgatgtaagtgcattcttcaaggcctgaaatgccgcttgagtttctg

SEQ ID NO: 39727 - DNA, 5802 bp, Oryza sativa
  unsure (1)..(5802): unsure at all n locations
caaagcggccaaaaacttcagaacattccgatgcaaaacattacggtaatataagcacacgtagatttaatttatttcataaataaatcacgttattgactatgtatactaacataaccacgatatacgatctagacatatatactaaacagtaaaccctgagcacatcgaatagatgatacatggtgaacacataacgaaagctctggtttgttgtggattagattgatgaggagcagcgcgcactgcaggaacaacggcggtgctggatgtccctagagtgtagaggaagacgagccgtcgtgaaagaccagcaagcagtcacgcgagccgtttccaaaaagctaattatcgtcttctcccgatacagaatgtcgaaggacgaaggttccaagaggggacctttattgatttttcaaaaaaattaatctccatatgagccttagtagcccacgtattaattccaacaaaaatattgtacagaaatccgtacaaatatatgcacacttatttgtataaacgaacagtcgagcacacacaacatgacactatgaccacatccactttccgagggactaaaccagtgcgtcttaaattgattgcgtcattacaaacatctcactatcgatggatataaatcacctaccactaaaaatataattagcagtaaatacgagcacccatcttaaatttaggacttaaaattgaacaactatatttccatggtaagagaaattgtttacatatttatggttttattggttggcttcagctgataagccgtaaaaaaaaagtgagacaacagaaactaagattgaaaatttgaatttcagcttataagtcaacaagcaaacaatcagattccatttaaacaatacaataacatctcactgtacataaacaccactgagaatttagctaggacagaacttcagagtatgaaaaatttcccttagtccaggagaggattgagaagatttgaaagagatttattccacacctattataatgtgaaactatttcttctcaactcctctaattcatctctctaaaattgaaatgactgagtttactgattttttttaaaaataaaatcctgcaatataaaagagcatatcacaaaactccaaccataaccagcagcctctactacgtgccagctcaccatgtcacgcacacgactccagtccctgataggcttttgtacacctcaccccgtttcaccggcaccaacaacggccaggtccggtccgtccgtacaaccacccgcacgcgccgcaccacactccggctccgccaccctcacctcatcccaaccgtttccgacccgcgcccgtgcggccgcttgaccgtttcccactgccacctgggccccacctcgtcgggccccgcgccgcgcctcaccggtggccgcgtggcacccgcccaccggccgcgcccacgccccgcgtgcgccgcggtagtcctattcccaaactgcccccgggtcggtcgccggcgcgagcactggagtgcggggggtagaaaggtaaaatcgtgggggtggaggtgtgaacgcacgggccccgcgtgggaggggcgggttacgcgtgtcgggcccacatggcagggactctcgggccgcgtgtaccactcccctccccgcgtagcactagctttttgctgattgattcgtctcggctcgaggggcttaactcggtttggtttacttttctcttttgatttgatgataatgaattgatctaatgatcccctctgcaaatggcgactggtcaccggagtttgatcggatttgtttagttttgcgatttggttaagctaaacctcgccaattaatctggctgctgatcctgcccttttgcagaaaagccctccaggattgatggtttttgtgtctgcctcaaattggccatgcatcaacatgaagtatggccaattattgtgcatcatgtcagattgtcagtatagtcagctgatcactgtagtagcacagtgagaagaagatgaatacacaaacaacaatctttgctgatatttttcatatccacaagaggggcctggcctatttggaaggtatttctatggctacgatatataaaaccaaaatacgcgacgactgaaggaatgaaagataattttaggataaaaactatatgattgtactcttggcagtcaaaaagttcaaggttgagaaaacccattagactaattctagaattagggtctgaatttagctacagcttataagtcgtagctcaaacaagcatgctcgttaacgtattcaaggcaatacatttttaacaatgataagaggagaccggccgatttggaaggtatttctatggttgcgatatataaaccaataatacatgatcataacaataaaaaaataggataacaattttgtacttctactcttagcagttccaaagttaaaaggtcggcaaataaaccattgaattaattctaaaattacgacgtaaaattagcaacaacttagaaatcgcggctcaaacaagaagggctcttcaagtattccactatagtaaaatgctcgtacctcattctatgcaaaagatgacaatatttcattttaactttgtaaggacccaggagtaattacaacccttttagagcccctcctaccaaaaccccctgagagagaaagctaaacaaaaactagaaacattctcagttccagaagaatatttgcacccacagaaagaaatcatttacaaaccaaagattaaacaaatccaaacaatcatgattagctaagaccacttccccctaaaccccaaaatatcattaaactaatcccctccctaatcacaatcccatacatatatacacccatccatccatccatccacacatcaccacctcaccatctccatccatctcacccgttaacccgctaagctctctctccaagatccgcttcggtttcctctccggcgatctcgccggcgaccatgccggcgaccgactaccagggctcctcctcgacccactcccacccgtcgcccttctcctcgttcggccgctccctcctctcgctccgccgcgacagccccgccgccgccgccggcgcgtccccggccatggcgtccggcgaggaggccgacctggaggcgttccagcggcacgtggcggcgcacctcgccgatctcaggggcggggaggacgagctcctgtccatcgagtggatccggcggctgctcgaggcgttcctgctgtgccaggaggagttccgggtggtggtggcgctggcgcgccgccgcggggcgctgtcggcggcggcggagaagatggtgggggatttctacgagcgcgcggtgaaggcgctcgacgtgtgcaacgccgcacgcgacggcgtcgaccaggtcaggcggtgggagcggctcgccggcatcgcggcgtccgtgctgctcgccccaggggagatccacgagggccagctccgccgcgcgcggaaggcgctctccgacctctcggtgctcctcatcgacgacgccgcggccgccgcgggtggcggcggcgttgcctccttcctctcctcccaccgcaaccgctccttcggccgcgcccgcgcgtcgccctcccgctccgagacgctcgcctcctcctcatcctccttgtagttgtcctcctcctcctcccacttccgctcgctctcgtggagcgtctcccgcaactggtcggcggctaggcagctgcaggccatcgggtccggcctggcggcgccgcgcgcgcacgaggggggactcgtggcgccggtgtactccatgggctgcctgctccacctcgccgcgtgggccctcgtcgccgccgtgccgtgcccggaccgcgccgccgcgctccaggcgcaccacctccccgccgcgccgccgcgcgccggttcccatgggcgccgccgctgctcgcgctccaggagcgcctcaccgaggaggggaagcgcaaggacaggcgcaactcctgcggcctcctcaaggaaatccacgcgctggagaaatgcacgcagcggctcgccgaggcgatcgacgccgcacccgtcccgctctccggtgagcgcgaggccgaggtacgggaggccgccgccgagctggctgccgtgtgcgccgccatgagggccggccttgagcctctcgaaagcaggtcagggaggtgttccaccgcattgttcgcagccgcatggaggggctcgattcgccgatgctcaacgccgattgaaacatggagaattcacatttgatcgcgcaatgtggtggtgataggtaatgccgatcgaaccgtcgagaatttggatttgatcgcgcaaatgtggtggttataggtagctctcctgttcttggtttttttcctcacttgtggtggtctagtagtaattataaaatgtgtgccgttctgtaaagaaaggggggaaaggaaaggaaccatctttatgtanagatgagccttcttcccatgttttgatgctgcatttggtgtatatcatggcatttttgttagtcctccatgtgtgcgcggctaattctgggagtaacttatagttgaaaaatctgtgaggtcgctatgaaatgtggcctgttgtcgagaatgtcgacaaaaaaattaaacaagaaaaaaaaatctactgtggtttagttcgattgtgttgtgtcataattcatgtttggtcctgatatttggatggtttaatcaaaaggtcaaatcttgaaactatcatgcgtgcaaaattcagcaatgtttgacatttgaagtactgctgtagcggtgtagactttttccatcctttcagttctacatatggttctgtgaaatccttaatttggttttatattcaatatgggaatctttttaagagttcctcattgtggattgcagtttgtgatggatcagttctgttgtccaatttatttgaaggcttcttgccagcagaaaatataatatattaagaattagattaggagatcaacatggatagagtgcggagtaacagatttcacattacacacacttatgagttaaattctagtgccaataatgataagacccctgcaagattgtctgtgtgatattgtcaataatctatatctaggtgatcttcttatctcctgcataattctatctgacataaaagatcaggtcaaactgtattagtgctgctaccaaactattataaaattaggatggaaaagatactagtgcagatcttgtcatatgttaataaacaataacctgattcactgaataggtgcatgtcggctttgtagttcagcttggttagatgtactcctgtataatatttctactttggttgatgtacttgaccctaatatttcagtcttctgtgcaatctttttcatggttctggacttgtagttgtccctgacaccaaaactcaggcctgaacaagtgaacatttccacttgttttgaactagtgaatgcttctgcatgtcacaactcacaactgaaactcctgagagtgtttgctaatcttgtacataaccaatagaggaaaaattcagcttctgatgtacctaaaaaacccactagtttgagatgcattttctcacagttgtggcaaaaggtcaataatgatgtgcagaagaagcacaaggttggaagaaaagatctgatgatcctcaattatagtgatcatcctcctccttttacctctgaaaatgtagaattgagtttccatcatcatcatcccagtcactgtcctgaatcctctgtaccctaaagtatttctccaattagtgacaccattataatggcttcccggctggttcat

SEQ ID NO: 39728 - DNA, 2246 bp, Oryza sativa
ttagggggagtgacaccaacttaaaaaggggaggggtccctcacctcatgagctagctttggggtgtagaaaggctttctcccggttgggccaacatctcccggttttgggccaacaagtggtatcagagctgggcccacaatctctctaagtgccgtgcacactcgtgtggtgtaagcccgaagcccagtggaccgcgggtgtgaggcccgtatgtgcctatgtgttgggccagtcagtggaccgcgggtgtgaggcctgtatgtgctcgtgtgtggagcctggtcagggctaaggggcaccaatgtgtgacgggagagattgttgggaatagtcccacattgaaagtttagggggagtggcaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctggttttcgagttcgagggggtaattcagtcgtctacgatagttcaagaggtaattcgtactttttcctaaaaatacaacgctatgtttgtacattgacttagcataatatcgttgcacgcatcatggtattgataggatcatcacttcaaatgagttcacgcgcgatttgaaattattaccttcccatatatatgattgatgtagcattattatttaactttactttttctccattttcttttttactatagcccttttgtgccttcagtatttttgagttagtttataattttctttggagatagcagtgctgttattttattggtgtttcaaagtttggtagggtaataaacctttgttacatagttgtacaatgtatgtatttgattttttttttagaaagtggctaagtccataccagtttgtttattagattatatatgctcagatttttgtaataaaaaatagtcgtgacatccttttaaatataaaattttataattttacacttagctttctttacaacatgtaggagtgaaatagagcaagaaaagaataataaggaagatagagggaaaaaaaaagaaaggggggggggggcaaggcaggcccaagacaaacaggcccagcacccgtctcctacctgttgggccaggcgagctgaagcccacgccccagcagcagccagtttggctctagtgcgggcgtagcgcgagcgtttgatgaagcggtagcacgcgttgcgcaactattggtgccacgtggcgcataattttgcaagagaacccgtcaattttagaatattagatttttatttttgttttttatacattttttttgtttcactttgaactcctttttacctaatcctcaatgttactctccgtgtgacaacgtaaactgcactctggtgctcatctcgaccatgccgttgcattgatgtcctttgcatacccaaagacggcagggttcaggaaaatgggactaaagtgaatcaagaagatgtttaaaaagggtgtccaaagtgaaaatatgctaaaccaaatcgaaacttgggttaaatactaaagttaatctatttctttcttgattaatatgaatgctagttgcaaatatacgagttcaaaatttttgagtttttcatttgcactataataagaaaaaaagcaatgtacttgtatgtagcaccaataattattggtccggaacaaattaaggagctacacaaatcctgaattgtcattcgccattactagtcacgggaatattaggccctgttc

SEQ ID NO: 39729 - DNA, 6004 bp, Oryza sativa
  unsure (1)..(6004): unsure at all n locations
aactcttgtgtaggtttatcttgggtaggtttagactttgtggtccagtttgggctaaaacccaatttattcccacgcaaaaattttcaccatgtcaaatcgaatgtttggacacatgcatagagtattaaatatagacaataaaaaataattacaaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccaggaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcannnnnnnnnnnnnnnnnnnnnnnnggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgccgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatgcgggatttttcgccgccgctgtcctcatccgctcccgctgctcctttgatggtgcccgcgatgacggtaccggccctaggaggttgtcgccgacggcggtggcggcaacgacgacgaagacgcaccaacgcgctacatccgctgtcgccgctgacgaagccgctcctgggcagacgtgctaccgccgccgccgccgacgcgcggacgcgctactgccgctgctgccgatgcgctacagtcgtcgccgccgacggaaccgctcctgggcagacgcgcttccgccaccgccgtcgacagagccgacgactcatctgggtgtgtgtaggagagaggaagagaggaggaagggagaggaggctaacatggatagtttgacatgtagggcccacgtgggtcctacgctgactcagccgccacgtcagacaaaaccaggatcaaaaccaccgagagacctaaagtgaacggttttatcagttgagggacgcccggtatcagattttgcgtttggaggatgattttatatctcgatgacaagttgagggaccttggatgcactttttcctcatacctacagcatagaggcaccacaccctcctctcgtccggcccaaatttgaaaggcccaaccagaagaaagccccaaaaccaaaacgattttgctatatctcactcggaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatacaaatattaaaaatctgtgtgatacgattataaaaatcttttgaaagatgtataggtactcccaaaccaaaaattaagcagtgggagaaactgaaacgtccaacgacgcttcccctcgaagcctcgcgtgataccgaagcggtagtttcgattttctcgcctgagtcgcctcaacgcccaatctctctcctcgcattcgtctgacctgtcacctctccccgggaggtcgcccttttctcgccgcctcaccggggacccagcccggcagccccaatcgaagaaatttctcatgtgtaaagcactaaagcctttccctggtaggtttgcctcccttttccaaaattttgcactgattaggctagcttagggcttgcaactatagaggcatatagagatagatgacgggggcaggaggaggatgactggaggaggacggcggcaagctgcaagctagcaacggccaatagctggagcttgccggctggccgctcaccctagcttatcgatctactctgagccccacaaaaattgcagccagcagcactagctgagagcaactgaataagtgaactctttctctcaatttttcttatccttagtttgtagttttgtgccaaaataaacttgaaaatttttatttggtcttaatagattgctatatagcactggatagtacgaacaatatgaagaaatttgttttaatttgtaccaaatcatttcataacttattctcggttgaaaattaaactatattttcaaggtcattatcctatggaggaatgaagacggtgacattcgcatgatatattcatattattagttgatttcttcattatggtacgtattttttatttttttatgtatttcttgtggtatattcccttcaaatgaagaaataatgcttatatttatttattggtatgcaactatttagtataatatcgctctataattatagatgttagtattacataaataaaggtaggaatccctcgtcttttctctagctccgcccctagtcttacatgggtgtcgcagggcggtgggtaggtggagtcgtcagtacggctgcggctgtagatgacgtcgttgcagaagctgatggtgccgcagggcggcggcgcccgcgaagatctccgcagttggtcgtacgcggccagatcgtcgccggtcggggcgtcgctgtaccccgtcgccgccgccatgaatgagagatcgaatactctcgtcgatcgatcggcacccgcccaccgattaccgaatgtatcggggacagtctgcactgagcgaatagtatcaaatcagtgggtagagaaagacgcaaacggaaatcaaaaccagaaggagaagaatcaaggaggaggaagctggagtggaggaggagatcgatcgtcgaaccttgcggcgccggagcaccgatcaccgctgtcgggcgtggagtagcactctaggagagaactagacaaaaaggaaggagagaagatcgaacgactactcgacgaggattgccgggatgcggcgggccggggagcagcgtggaggctggatccgggcatgacgacgacctctctctaggccgcaccgccgtgtgcgtgtgcccctcctccccgagccgccccggccccgccgcgtgcctccgccacgatggaaaatttttaatgtgttttttctacttttgtatttttcaaaagaatttctcaaggaaatagtccaaatatcaccttagactttggacgaaattccatctagaatcatgagttttaaaaccgatatctaaccccctaaattttatattaccctctaagatgattttggatggtggtttttcatattttgaaagcttacatgaacaactttgaataactaatataatatatttgcataccatcaattgtaagtcaccaatttatactcatacagtgatactatattattattatacactggttcttatttataaatgtgagctaacgagtgataaaaagaaagatttaattaagtggagattttaatatatatatgtccaatttgtatatcacatgatcaaattcatccaagttatatacaaattagataaaaatcactaaacaaaatcaccttaggggataatatgaacgattttgcaaagtttagggagttgaatttctagttttaaagttcaggatgatggatggatttctatctaaggtttatggggggtatttggattttcttcatttttccaataatgcattctaaaagggccctgacagaacaaaatgattctctgataaaatttcattttaattttcctagatggaaatcacacgaaccactgttttcaaaggttcgataatacaagttgcaaatgcccacggtaataccattgtcttcttccaattaattaatgtcgatcagtatatagtcaactgcattatatatatgcctcacgtctgcaaaagggacgtgtgtattaccttctcccacagcgcgcacagtaagcagcaaccaacaagcacgctggcacacagtagatagctagatgagattattacttcaatttattcgttgcgcatataattaagaagaaaccaagatcattctgtactgctgccaatttatagctagtcagtccggtgtccatagacgcaagctctactgctgttgctcgatcgaccggtgtttgcaattatcatgagcctggtcaagaagtaagtttttaatttgttcactttattgcctatttcattatctacagattagtgaaatactccttccgtccaaaataaaaacacactaatctccttccgtccaaaataaaaacatatagtatagattaatggacaaagagtttttcagatttgttgtattagtaggggtcatatttcgattattttttattttcggatggagggagtacacatttatggcatagtttagatctaaagtttggatacaaacttcagtcctttaccatcacatcaacctgtcatatacatacaacttttcagtcacatcatctccaattttaaccaaaatccaaactttgcgctgaactaaacacagcctatagagagcgagatagcccgcaaaattgatcgactctatgccgctgaattgacaatctcattccaagtttcccacacgatttctgaggaattgtccgtggtacggcgttttttgaaccagaaaaggtccgcaaaacgaagttaattaagacaaacatatagtacgatctatattttgctccagatctccgatgttttagagaaaatatagttttatatatactcaatatcgtaatcatattctcttgagctatcccaacgcaattgtaaaagcgtgcgttgctaattgctctaggactgcaggatttctcacataatttcactgatatatcactactacgaaaccggtttttgcaaacgggcgaaaaacattttgtat

SEQ ID NO: 39730 - DNA, 1670 bp, Oryza sativa
gcccactctcggagagggagagggagaggacagaagaaagagagagagaggagaggagagaaagagagaggggagagtaaaactaatagaggggtagagagaggaaatgagttagaaaaaaattgaagtggtgagagggaaaagagagtggagggatatgaaaaaaataggggtggcatttttgcatacgggtatcttaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcgcaaacttaaatattactgtagattccagaaaagcatgtctgagacttatcaacgtcattatgagtacaacaagtagggatacaatttataaataacataatatcggaataaaaaatattaatttttcagaaaaacacaatccatctagaaaca

SEQ ID NO: 39731 - DNA, 970 bp, Oryza sativa
atatgtaaataattttgtatggatacttgtcgtgcgattgcgtgggccacctagctagttcttattttatcttatagtaattatcaggtttatactacatattttcccacaaagaattcatttaacacttgatatgtgtgtatacacctatagtaaaacaaccagtgaataatacagaactgtaggcaaataatacaaataatttgtaaaattatgattgttttgtccctatcataatttgttactaaaaccagacatagtggttaagtgactagacacaggaccactaccaaaaaaaaaaaaacctcatcggtactgcccaagaagacccatcagtgctggttccctgcctggcacaaccatttgggcaccaatgcacgccgttcggggtattttgctatgttaagatgccattcggactgataaccgcagggaatattttccagcgcacggtccagggcgcacttagcgaccagctcggcaacaatgtcgaggcatacgtcgacgacatcgttgtcaagaccaagacaagcgactaattgattgacgatctgcgggaaacgttcgacaacctccgacgatatcgcctcatgctcaatccagagaagtgcacgttcggagtaccgtcgggcaagctgctcggtttccttgtctctagcagaggaatagaagcaaatcccgagaagatcaaggcaatcgagaacatgaagtcgcccacaagactcaaggaagtacaaaaactaaccggatgcatggcagcactaagcaggtttgttgccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcac

SEQ ID NO: 39732 - DNA, 14352 bp, Oryza sativa
  unsure (1)..(14352): unsure at all n locations
ttgtggttggcggggagaagtttgtgaaggtcggatctcacctccgagaaggaagagatacccttagtggaaggaggagtgcttagtgcaacctcttgaggaaagtgttagctaagacccggctcttagtgagctcctcaacggagagtagaatcccctcaaggattcgaacttcgggaacaacctcgtgagcttcatctttggtgactttacttcctccctctccactagctttgcttgttcgagctgcaataggtctagttgctgtttgtgctagcatattcttgttgtaggcagctagatctaggatttactttgctatttgtgctgactccaaaaatttttggttatatccgaaaatttcggaaatatccgaaaattactgcttccgcttttaattgatttttgaattagcgtattcacccccctctaggcctaattgacactttcaattggtatcagagcctaatctcctaattagacttaaccgcttggagagatcatgtcgggccaagcgggggatgggaacgatggtgataagggagctaagatcccttatgactatccctctacatctacatcttatgtgagtacctatagcggcaaagctccgtacttcaatggtacggactatgccgcttggaagcataagatgaagatgcatttgaagtctattaacccatctatttggagaatagtcaaaaaaggctatgttttgcagaatcccgaagatcccaccaaggaggacgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatctgtgatgttagatggtgagagcccaagcgacatgtacgaccggttgagcaagatcatcaatgagatcaagggacttggctccaaggacatgaccgatgaggttgtggtcaagaagatggttcgagcaatcactccaaggaactctaccttgagcgtccggactacaagactctcacacctcatgatttgctcggatgcatccttgcccttgacatgctcgtgcaagagtccaaggatgtcatccaatacatcaaccaaagctcaaccgcaagcatcaagaaggaagacttagctttgaaggcaaaggaagaagaagaagagaatcgcaagagcaagagcaaggcggagatcgatgatgaagagatggctcccttcgtcaagaagttcggcaagttcatgaggcgaagcggcttcttcaagggaggatcttccaagcactactccaacaagtcaagtggaagacactccgcaagagtgtgctacgtgtgcaaagagcccgggcacttcattgcggattgcccccacctcaaggatggttcccacatcaaggaagataagaagaaggatgagaagaaggagaagcacaagcatagcaagagggaacattatggccaagctcaccttgggatgatcttcggctccgactccgagtcaagctcaagtgatgaagaaggagtcgccacgtttgccgtcaagccctcatcaccaccgagactcttcgactactcaagtgatgaggatgctccggtttgtctcatggcaaaggagcctaaggtaccttctcttcttaagtcatttaatgttgatcttgttagtgatgaggaggatgaggttgaggatgaggttatagatgacgaattgttcaagtccataactaaggaatccctaccacacttgagtgagttgcttgagagaattgaggaccaatatgcaactcttgagaggcaagagactttgctcattcgtgagaaagagcggtctcatgaactcaagagtgagcttgctaaggagagagagaaaaatgaggcattggtacggctttacaagcaaatcaaagagtctcatgctaatcttgaggtggcgaacgctcaactttaagagagagtggatggcttggacaaagcatacctcactcttgaagagaacttggtaaccttaaagaatagtgtctctctccctagcgagccatcttgttccaaaattgtcccaagcaatgaaccatgtgtgagatgcaatgatattgatattgaagcttgtgctactaactctatttccttgagtgctttgcaaaagaaaaatgagaagcttatgggactccttcacaatggcctacttaagtgccatatgggtagtaaggccctaaaggagtacctaggctatcaaaagggacaacttcaaccatgagggtcttgggtatgtttctccaccaaaaggaaaggtggacaagagtgtgatgatcaagaggccccaaggtcttagcaattttgttaaggccaaaagtatccttcctaatgattatgcttcatattgttcttttgatgtatcttatgttcttaggaagaatgctagtggtcgtgttgttgctaagtatgtaggcccaaggggcaagaatatttctatcaagagagtactttgggtgcctaaggcacttgttactaacatgagaggacccaagcaagtatgggtacctaaaattagaaattgatctcttgtaggaatatgtctccggtggaagaagttgggtaattgatagtggatgcacaaatcacatgaccagagaagaatcaatgttttcaactcttgatccaaatggcacttcacaagataacatagttttcggggacgatggaaagggaaaggttatgggattgggtaagattgcaatttctaatgatctttccattgccaacattctcttggtaaaatctctaaactacaatcttttgtccgtttctcaattatgttctatgggttataatggctttttaccgatgttgatgtgaccgtctatagaaggaatgattcctcggtagtctttaagggtgtcctcaagggaaagctttaccttgtggatttttcctcaagtaaagccaaacatgacacatgttaagtggttaagtccaacacggggtggcttgggcatcaaaggctagcccatgttggtatgaggaatcttcacaagcttctaaagcacgatcacatccttggactaacaaatgttcaatttgagaaagatagggtgtgtagcgcatgtcaagccggcaaacaaattggagcacatcaccccgtcaagaatgtgatgaccactacaagaccattggtgcttctccacatggacctcttcggaccaattgcttatctaagcattggaggtaacaaatatggtcttgttattgttgatgacttttcacgcttcacgtgggtgttctttttgcatgacaagagtgagacacaagctatcttcaagaagtttgcaagaagagcacaaaacgagttcgacctcaagatcaagaacattcgaagtgacaacagcaaggagtttaagaacacgtgcatcgagagtttccttgatgaagaaggcatcaagcacgagttctcggctgcatattcacctcaacaaaatggagtagctgagaggaagaataggactctcaatgagatggcgaggaccatgttggatgagtacaagacatcggacaatttttgggccgaagccgtcaacaccgcatgccataccatcaactgcctttatcttcaccgccttcttaagaagactccctatgagcttcttaccggtaataaaccaaatgtctcttactttcgtgttttcggtagtaagtgttacattcttaataagaaggctagatcctctaagttcgctcctaaagtggatgagggattcttgcttgggtatgggtcaaatgaatgcgcataccgcgttttcaacaaaacctctagtattgttgagattgcgcgtgatgtgacatttgacaaaattaatggctctcaagtatccgagcgaagcaatcaaaagattggctcttggggacgtacgtcctaggaagccccaacaaggagcctcttccttaacacaagtggagccacctacatcaacccaagccgacgatccctctatctcaagcttggatcaaggtgaagaaggcgagcaagtgccaccctcaccgatcaacttagctcgcccaagaatccaccaaagtatccaaagagatcatcctaccgacaacatcttaggagacatcaacaagggagtatccactcgttctcgtattgcaaatttttgtgagcattactcgtttgtgtcttctcttgaacctctaagggtggaagaagctcttaatgatccggattgggtgatagcgatgcaagaggagttgaacaatttcacccggaatgaagtgtggactttggtggagcgacctcggcaaaatgtgattggcacaaagtggatcttctgcaacaagccaaaccaggccggggtcgtaataaggaccaaggagcaggttagaggcgcaagggttcacccaaatcgaaggattagatttcggtcaaacttttgcgccggtggctagacttgagtcgattcgcatattgcttgcttttgctactaacctcaattttaagctatatcaaatggatgtcaaaagcgccttcctcaacgggcctatcaacgagttggtatacgtggagcaaccaccgggcttcgaggatccgaagtatcccaaccacgtgtacaagctccacaaggcactatacgggcttaagcaagcccctagagcttggtatgagtgtcttcgcaattttcttgtgaaaagaggctttaaaatcgggaaagccgattcaaccctttttactaaaagacataataatgatatttttgtgtgccaaatatatgtcgatgacattatattgggttctactaacaagtcttttagtgaagagtttagtaggatgatgaccaaacgttttgagatgtccatgatgggtgaattgaagttcttcctcggccttcaaattaagcaactcaaggaaggaactttcatttgccaatcaaagtatttgaagaacatgcttaagaagtttgggatggagaacgccaagccaatccacactcccatgccatcaaatggccacctcgacctcaacgagcaaggtaaagacgtcgatcaaaaggtataccgttccatcattggctcacttctttacctttgtgcatctaagcctgatattatacttagtgtgtgcatgtgtgcaagatttcaagtcgctctgaaggagtgtcaccttgtggccgtgaagagaattcttagatatttagtgcacacacctaaccttggtctttggtatcctaagggagcgaggtttgatctcattggttatgccgatgaggattatgccgggtgcaaagtggataagaaaagcacattgggtacttgccaattcttgggtaggtcccttgtttcttggtcttccaagaagcaaaactccgtcgccctatccaccgccgaagcggaatatgtttcggtggggagttgttgtgctcaacttctttgaatgaagcaaaccttgagagactatggcctcaatgtatccaaaatcccactcctatgtgacaatgagagcgccattaagatagccaacaaccctgttcaacactcccgaaccaaacatatcgatattcgccaccatttcttgagagatcattccacaagaggcgacctagacatccaacatgtgagaaccgacaaacaattggcggatatctttaccaagcctctagatgaagctaggttttgtgagttcaggagtgaactaaatattttagattctcggaatgtggcttgatctattgcatgcgtgtttgcttagtagaataggtttgcataccactttgtgacaaaatggtcattcaattcatggatggacactagtcatttttttgtggagattttgaatctatgtgtatggggatctcatttttcaatgaattttggtcctagcacaacttcatagattcacacattccctctctcgagggtgaattatcttgtctcatggtaattccctctcttttgatcccttggatcgtccatttgacttgtggctattgttttgtgtgattgattgtgtgctagtcacaaattcaaatggagcctctagtgctcgaccatcccttccttcctaaatcctataaaaaatccttgtaaaaattgtttttgtcaaaattcccggtgcttgtcccttgcaaaattcctttaaaatgtttgaaaaataatttcatcaaaattcccagcgaaatctcattgcaaaactgtgttttccaggaattttcggacattccgaaaatctctgtcctgtccctctttcaattgctgcaatcccaggatttttcggacttttcgaaaaattttcagacatatccgaaaaacatcagaaccgtgcgcaactcttctgtatcctttcggacatatccgaaaattttcggaaatatccgaaaatctcggggtccttatatatcaccccgtggactcccttctctctcctttccacttcttttccctacgggttgactccctcctccctccccattggacctctccgcattcatacccccgagagggatccggcggtgattcgccaagtgtatgattggcggtgcaagtctgaggttgttgctcctcgtcgggatgagaatccgcgctcccttcgctgcaccgccacggatccgcgtttttggaccctctttcagcaagacttttatgagtctgtgattaagtccaaagctcatcccactgttcccatgcaatagatcaattgggaggagttgcaggcacacaacgatccggtgattgactctatgattgccaattgtgatctcatgggtatccgctccttcatgacgttgcagcaaaattggtgcaacgaggtcattgctcagttttatgccaccgtctactttgatcgttatcgtgccatgcactgcatgactcaggggtcctggtattctgtttcttatcagcagttggctgagatctggggcttccgtcttcgttctttgctcaaccttgatgaccttcataatcttcaaattcctgccaacacagaattgcttcccctttacactccaaatgatccaaatgtggtgttgggcaaggtcgacggcctcaagccgtactttgcctacttgaaccggatgtttcgccggtcttttgtgtctatggatagtgatgctaacagcattaaccacctctctaggaccgtgcttctccgttttgatccccctcctcatcgcttccatgtctatcactttgtgtgggaggagatccgcatggcttcaattcagtacaagaaggggttggtcttatgcccccttttttccaaaaccccaaaattttttttctttatgcggatgatcgaaactgtgactcagctccagtttccccatgatgtgactcattctcagcttcacttgcgccttcttaaggccccccgctcctcggctgcttgggacataccctcttcttccactttgccgcctcctgctcntgagcgccctgcctctgtggctcgtcgtgagccgtctcccttattccacaatttacggagtctttttggtctttgctccacggaggccaaaaagaaccgccgattgcggaattcggcgaagaaaacggctcgtgatgtcaagttcctcaaggcaaggtattatgaggaccaccacattgatatccctccttctcctccgggtttcgaggccgagcccgatgagccacaggatgaagcgattgaggatccttttgctgggttgccttacgacttcgacttctttggatatggccatggctatggctatcctcctccaccacctccagaggatccttctcaggcgcccttcgcttgagtcgtcatctcatcgtcctctctttttcgtgtcttgatgccaaagggggagactatctatcatggctttagattatctatcttgtccttagagtcgagcacagttggtttttatctgtatgagactattgtgattttttatgttaggtttaaagctttgtaagactattgtttaattatgaatgcttgtgatgtaatagatctttttatcttttaatgtggtgcaatgccttatcctctttatatggtgcttgtgatgagatgtaattattcctttgcatgcgatgtgttggatgtaatgagcatatgtgatatatttgttctcttgtgagcttcaatgtggatgcaataatttagggggagctctccacttgcttttatgcacactcttagggggagcttccactaaaattttgcacaaaaaaaccttaaattatattcattctcttgtgttctaatcgtattgtcatcaatcaccaaaaagggggagattgaaagtgcatctaggcccctaatgattttggtgattaattacaatgtgattagagaggactaacatttttatttaagcaaatgtgaaggttgttatgtcctcaataagttagcgtaatgcatatcccgccgaatacgttgatgtgatgtgatgcggcaaatgagcaaatggtattttgtacgttttcgtttccttgagttaataggaaagccgcactattaagagggatgatgcattgacatacgaggagtgatcaaagtgctcaaaatctattttcaaaaaaagggtttctcctcagtttggtgtgttctggattttttcggagttttccgaaactcattttcggactttccgaaaacacacagaaccagattttcgcttctggaaatttttggatttatccgaaagtgattttcggactttccgaaaatgactgcgaaggcaaaagtggttctgtatattttcggacttgtccgaaactgattatcggatttttctgaaaaatatcagtagagtcaatttcgcttcggtatattttcggacttttccgagaacatctagaacgatgttgttggtactggaaattttcggacttgtccgaatagttttcggaatgtccgaaaaatccttccatgaccaaactgttggtgctgagctagaatttttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctctctagcacttttgagccttgctttcttgtttcccctctcacccgtgttcgatatggatttggtgtgtgtgtgagagttgtggattcgagtttgtgtgagtgcctgttgttgacttcgtgaagatttgtgagcacttgcatcatctccgggagttctttgcttcatttgttactcttggaggttgaggactcctaggcggctaggtgtcgctcccgagccactgatctacttgtggttggccaggagaagtttgtgaaggtcggatctcacctccgaaagggaagagatacccttagtggaaggaggagtgcttagtgcaacctcttgaggaaaggattagctaagacccggctcttagtgagctcctcaacggagagtagaatccccttaaggattcgaacttcgggaacaacctcgtgagcttcatctttggtgactttactttctccctctccactagctttgcttgttcgagccgctataggtctagttgctgtttgtgctagcatattcttgttgtaggcagctagatctaggatttactctgctatttgtgctgactccgaaaattttcggatatatccgaaaattttggaaatatccgaaaattacatcttccgcttttaattgatttttgaattagcctattcaccccccctctaggcctaattgacactttcaaggttccaccgtaatgaggctaatggatgcatgacaccatgtgttgacggtcaccaagccaaggacatcgccatgttgaaaagaatgaagtcaagcttgtgatgagaagaaagtcttgacaaaggatggttaagacctcggcataaatatggttgaatcgaatggtcacaagtgttgatctcggctcaagcttgatcccaagttggatggtgcaaggcaaaggtataatgtagctaagaatgttttcttagtcttttcctggtcttggtgtttggcgtagaccggatttgctagataggcgccgtactatcaagaggggtctatgaagcgagcatgtggatgatcttgcaccatattagttcatatgcatgtaggtgtatttggtgggcttgtctagccaagtgtggtgagttttctcaagtcccaaacaaagagagaagtgagcacatcctataggtttgggtagcctcatatggttttgtctggtggagtatcttttggagtgtgagccctttttccctaagcaaagttgtgtttcttggatggattgttcatgggttggatagccctttgaataagctttccatagagtccaagaacgtcaaattccgagactcaagtcaagagatatcaccgttttactaatggccgattgagctgaaaagtgccctgtggtctgaccgcagcccttatggaggtctgaccgaagtatgtcgtccggtctgaccgcagatcacatggcggtttgaccgcacatcctgattttgaaggaggtctcgtcttggcaatccagagccactagagccgcagccggtcaaaccgagcccctggcaatctgaccgagctgtggacggtctgaccggccactacactgcgatcagaccggccaggttgactgggctcaatgattgccatgtaatggctagttttctagccgttaagtagtccggtcttaccggccacactatggcgttctgaccgacagagcacagagttggggattttgactccaacggctagtttttgtggttgggggtatatatacccactccccaacagcaagggtaaggttttggcactccattgcattatcttgaacccttgcaagagctctcacacccttgtgcacttagtttatctagtgaggtgttggagagtgagttaagccaatccaagtgcattgattcattgttagagctagtgtggtacttgatcatcctcggcaagcatcctagacttgttactcttggaggttgccgcctcctagacggctttgtggaggtgttgccggtgacctctccgaagagattgtggagaagacccggcgccggttgagagtggtttggagttaaccaccttcggagagaagtaagaactatccctagtgatcgaggcttgtgtaatcctctctgtgggccggcccccaccttgcccaccccttgacgaagggggcgtgcggtggcttcgtggttgagcggtggagttggcctcgcctcaacagagattaggaaaccggcgagtttccgaacctcggtgaaaaattccttgtctcttgtctcatttatttgttgcatttacatttgagcaagtttacatactaagcttatttgtgctattatcaccctaagcttgcaaaccttaacataggctagcttttttgtgcacttacttgagactagttgatttaggttttgaattgtgcaaaaccattttgatttacgcttccgcatacaaaattcggttttagccaaaagttttaaaaccgcctattcaccccccccccctctagtcggcctccttgatcctacagccaccccttttagttttgccgaaatattgtttcaacaagaactacgaggaagccgagataatgtttcgacaagaactacgaggaagttaagtttccaacaggtccacatctgataataaagagactctcaaggtttgctacctcaacttcttatctcttgaaggttattgatactgaagtgctagctgatagaatgttctatatccaaacacttgctaataccattgtggcttcggttcttttggaggctatcctagctaagctcagctcatttgcaatggacatgaccctatatttttcttgcatgttcatctaccaaagtagttggcagcatggtctcttcatctcttcaaacaagtgcaaatcaggtgaacaagaaatctattttgcttcccttcaatatcccaattattttcttctatcatggataatttgtattcttccacctctagggtaccagccaaaaccagctaaataaaactagtgtatatatataatatgtattcatccttcttgaaagaaaatcacataaatatcatgcatgtactattgtgatgtgttttttccatgccactacggcgcagcagaggctatgtgtgttcagatgatgagtagagctgtcacttggaataaaactgacaaatcaattactacatttcaacaaaaaatctggaggcatattgaggtttggtaaatttctagtgacatatatataaggaattttcctatagcatactatagttctcctgttcagttatgggcctgatgcacttcacatcagggattccaattttgttttggaaaaaaaataatcagaactgaaaaaaattaatgaccatatataattgtttgaactcgatttatgaacgtaaaattgtgataaaaaaattcgaagcctaggtaccttggttacacagataataatatctttcgagtttcacaccaaagagatgttgaaaccacaatagcttacattttcttctctctctctccatgaacttggcgtgcttaggctcgaatgagtcatttataacaatgattcatgtcatactccatccgttcacaaacataagagattctatattgtttagcaaagttaagattgaggttcaaattactttgatgtctgtcacgcccagaaatttagcccaaaatttcatactattttgtggattaaatccttggtcagggattaggcaggggtccccaaacggccaatttatatacaaggtccaacgtaaataaagcgtaaaatacttacagaagaggcacttagttctcacaccaaaaccgaagcagcagcaacggaaaaaggcgatcatagcgaggcttcagctccactccacaggcaaaactcaactggggtctgagccttggtcctctaacttcgtcttcagctcagaagcactacacttctgaaaagggggaataatagcaaggttgagtacaaccaccgtactcaccaagccacaccaatgatgcactcatgcaacgggagacaaagagaggtttgtggctatttgcataaaggtagttgcaaaacattttattgagcaaaatagtaaaactgttgattaattaaggtagtactaaatcttcactgatcaacgctacaccacgttgatcaggcctaaccatcccacctgaactaaaccagttcattaagccaatttattaagggtgagactaatcacggtgaatctggtcgatcgcccattaccacgggcacggttatttgaatagttttactctggccagaggtgcacaactgtacccacaagacacaatccaccggcatgtcaccgtgcccggctggacacgtcaccatgtcgagtgattgtggcaagacccttcatataactccctctgaccaatcgatgccacacctcaggtttcacccctcccccagcaggcagcaggcagtcccccctcgtgccacggtgaatccggaagcagcataggccgtcgcagggcccatccatactcgatcacacccaccctagcctgggtacgtcagccaaaggaaagctatactacaagtcaagcaattacccattcctgcttgtggtacgcgcggtaagtcttccagtgcatccagcgaaccagtccttaatttgctatgggcgcaactagaaaaaccatgcacccacaaaccaccattaagtcatgttttagttggataattacaaccaatgaaacatggctagatgtctcgagcacgcagctcgtcaagatatatactaggtgtctaatgatgtaattatcccattatgtgaactagtggtaattaagtatggataagcatataattctagctaggtcaacataagtaacacaaaatagtcgaattatcacctaagtttgacaaaggacgaacatcaagtaatatggcacaagcgaagaagtagataaaaccctgatcccatgtaattagcatgacatgcaattttatttgcaaacgataaaacatttataaattaggatcaacatgctcaaggggaatgtgtgacttgccctgcttcttcaaaagaatcctctgaactctttcctcgtaatcgcgagcttccgaaacagcggaatctacgcgctggcacgcaaaacaaggaaaaactctaataaaaaccaagtaaacagtatatgaaaagtaaacaaacatgtagagctcaagtttagatgaattttgcaagtt

SEQ ID NO: 39733 - DNA, 10728 bp, Oryza sativa
  unsure (1)..(10728): unsure at all n locations
tattgatccggaaaagctcacacctgaccagaagaaggacttcgaagcaatgatgcaacaagcacgagaacagttcttcaaatcattcacacagactcgcaagggaaaatttgtttaaaagtacaaggtaaaggtggttcccgatgagcctgagaccagtacctttaaggagggagaagggaaaagagttttagatggctcggctcaagagaatcagggtgacgactctcagggggcacatgcagttcaaggtgatggtgctcacgagccacaacgaggaaatcttaatcagaatggtgagacagcacaagatttcttcaacaatttccaagatcgagtggactacgccgtacacaatgctttgatcaatcaatctggagtgttagtcaacaccttgtctaacatgatgaagacgatagccgatggatcaatagttgagcatcaagctgcaggcccggtttacttgccgggaggtgtttttccgaattatcgatctttgatcactgatgttcagccgcttgctcaggcagttcttccgagtgcaccatcggctcagccgatggcaccgccattgacttctttgcctgctccatcagcgtcgacaccaggccagccgattaatcctcggctattgatgagggagcagccacagcatagcggacagacggtaaatcggccagcacaggatcaggtggctgctatgtttctacccctccaatctactgtcaattcgattcagcagacgccaccaaggcaacaggttgtgcagccgattcaacagactccaccaaggcagcaggttgtgtagccagttcagccaacacttccgggacaacaaactatacagccgattccgcagcaagctttgatgaatcaatcggctgagcaatcagctggacacgccctgaatcaggttgttccagaacatttggttcaccatatacaaccagatggtacgacgatgcctcagattgtgccagagcacttggtgcaaagtattcagccaaattaacagaatttattcagccaaattaacagaattaccaatgaggcaatataatcagtttgaaccaatacagcaacagtcgcaaggagcaggtcaacaacgaccatgggctgatgtaattgccgatgtgatgagagaacaatttgggcttaagccgaaagatactggaaaattgtatcggcaaccttaccctaaatggtttgagaaagttcctcttcccaaccgatttaaaatcccagacttctccaaattttcgggacaagatggtgtgtcaacttatgaacacattagccgatttttagctcagtgcggcgaagcatcggctgtggacgctctcagagttagattattccggttgtccttgtctgggtcggcttttacatggttttcttctttgccgtatgggttagtcaatagttgggccgacttggagaagcagtttcatagctatttctatagtggagttcatgagatgaagttatctgacttgacagcaatcaaacaaaggcatgatgaacctgtgcatgagtatattcagagattcagggagatgaggaacaagtgctttagcttaagtttgactgatgcccagttagccgatttggcttttcaaggcatgattcctccgattagggagaaattctgatctgaagattttgatagcctgtcgcatctcgtacagaagataacattgcatgaacagaggtttgcagaggccaggagaagctctaagagggttaatcatgtctgcccttacatgtatggatcggatgatgacgatgatgactccgaaatagctgcagccgaatgggtaaggagtaaaaaggttataccttgtcagtgggaaaagaattctggaaaagaggagagatatgattttgatattaccaaagctgacaagatttttgatatgctactccgggagaagcaaattcaactccccgctggtcatgtaattccatcggctaaggaactaggcaaaaggaggtattgcaaatggcataattctggatctcattctactaatgattgcaaggtctttagacagcagattcaagtagccattgaaggagggaagattaagtttgatgattccaaaaagccgatgaaggtcgatggtaatcctttccttgttaacatggtgcataccgttggtcggacagccgatgtgggacgagcgagaggtttttgcgtgaattcggctagaattataaataagtatcagaggaaatacgacaaacaacaagagaggcattatgaagaagataatgatggtttcgatccttattggaattgtgagttctttcggttctactggaacgaaggtatgaggctaccatctattgaagactgtcctgagtgcagtgatattacagagagttcaagccgatcgtacaatagaggcaatcggctgaagcaagctagagttcccgttcatcaaaggttgggcccggcaaatcaaaatgattacttggaggaagacgagaacgcgaagactcagtggtgtccttctgatatttttacaaagaatcagaaaagaagggttcaaaggttgaggaatagggagcgctttcaggaggtcgagcaagaaattggtcatcggctgaagaaagcaaagccaaggaaggagtggcgtgttaagaatcaagttcttggagccgatgatattgcagccgatgaagcaaagaggttggcaaaagggaaaagtattgtaacggcgccaattaacatggtctttactttgccagccgaattcgggattgaccaagccgatgttgacgaactggaagaggaattggctaagttggttctatcaccagaacgagcagtttttgaaaagcctgaagggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatcaagacaaacatggtgcttaaagactttggtggcaaccaatcggaaacaaagggtgttctgaatgtagaattgacagtcggcagtaaaactatccctaccacattttttgtcatcgatgggaaaggttcttacagcttgttgcttggaagggattggattcatgccaattgttgtattccttcgaccatgcaccaatgcttgattcaatggcaaggcgacaaggttgagattgtaccagccgacaggtcagttaatgttgctagtgccgatctagctctttgggagatggatggccttgattgtttatccaggaagatttgggttggagattttctaaaagtgtccgattctgatatacagccgattgaagatgaagaacccaagctattattttgagggcgtcgtggagggttcaagcgtctacgccaaggacacggtagatgatctcgatgacaagcaaggttagggttttatgtcggccgatgatttagaagaagtggatataggtctgggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaagccagggattagaccacaccagcagcctccgagaagatgcaaagccgatatgcttgaacctgtcaaggctgaaatcaaacgtttgtatgatgctggttttattcgtccttaccgatatgctgaatgggtttctggtatagttcctgttatcaagaaaaatggtaaggtgagggtttgcattgatttcagggatttgaataaagctaccccaaaggatgaatatccgatgccagtggccgatcagttggttgatgctgcttcaggacataagatactaagttttatggatgggaacgcaggatataatcaaatctttatggccgaagaagatatccataagacagccttcaggtgtcctggtgcgatcggcttgtttgaatgggttgtaatgactttcggcttaaagagcgctggagctacgtactagagggctatgaattatatatatcatgatctgatcggatggttggttgaggtctacattgatgatgtggttgttaaatctagagaaatagaggaccacatagccgatttgagaaaggttttcgagaggactaggaaatatggtttaaagatgaatccgacaaaatgtgcttttggtgtatcggctggccagttcttgggatttcttgttcatgagagggggattgaaatacctcagaggagtatcaatgcgatcaaaaagattaagcctccggaaaactaagacagagttgcaggagatgatcggcaaaattaattttgttcgaaggtttatttctaatttgtctagaaaactggaaccttttacaccattgttaagattgagagctgatcagcaattcacttggggggcaaaacaacagaaagctttggataatattaaagaatatttaagttctcctccagtattgatccctccacaaaaagggattcctttccggttatatttgtcggccggtgataagtcaatcggcttggtcttgattcaggaacttgaaggaaaagagagggttgtgttttatttaagccgtcggctcttagatgcagaaacaaggtattctcctgtggagaaattgtgtttgtgtttatatttctcttgcactaagttgaggcattacttgttgtccaatgaatgcactgtggtatgtaaagccgatgtgattaagtacatgctatcggctccgattttaaaagggagagttggcaagtggatattttctttaacgtagtttgatcttcggcacgaatcaccaaaggcgattaagggacaggctgtaaccgattttattgtgggtcatcgtgatgattcaatcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttggccgacaatactggaggattgtttaagatattataaaggttgtcaagattgtcagaagtttggagcgatccaaagggcgccagcatcggctatgaatcctattattaaaccgtggccttttagaggttggggaattgatatgatcggtatgattaatccaccctcgagtaaaggacataagtttatattggtggcaaccgattattttaccaagtgggtagaggcgattcctttaaagaaagttgattctggggatgctatacagttcgttcaagagcatataatctatcaatttggtatccctccaactattacgactgatcaaggttcaatttttgtatctgatgagtttgttcaatttgccgatagcatgggaattaaattgttgaattcttcaccgtattatgcacaagctaatggacaggccgaggcatctaataagagtttgatcaagttgattaagaggaagatttctgattatcctcggcaatggcatactcggctggctgaagcattgtggtcttatcggatggcttgtcatggatcgatacaggttcctccttataaacttgtttatggtcatgaggctgttctgccatgggaagttcgaatcggctcgaggagaacagagttgcaaaatactttaacagccgatgagtattataaccttatggccgatgaaagggaagatctggttcaatcacggctatgagctcttgcaaaggttactagggataaggagcgtgttgtccggcattataataagagagtagtacccaaggacttttcggagggtgaacttgtatggaagttgattctgccgattgggactcgggatagcaaatttggcaagtggtcgccaaattgggaaggaccgttccaaatttataaggtggtatctaagggagcatacatgttgcaaggactcgatggagaagtttatggccgagctctaaatagcaaatacttgaagaaatattatcccagtgtttgggttaatgcatgatcgactagtgttgccgatacatgatagccgatgtgtttgcatcgcctggagatggccgatattgttatatcgcccttagttgcttttcactattgtaatcggttgtggtttgccgatctacaaatggccgatattgttatatcgcccttagtcgtttctataattttgtcaatgttttcaacattgtaaaattaggggggcacatacatagagaattgcaaagaaaaatgagagaattgaaatttttgaacaagccggcacaaggatggcagcaaagtaattagggtgtcttagccgattacaacagttttctacaaactattacatggaaatcactgagacaagtatcgctggatagccgatatagccctttgcctaatttgatctatttcttcgatagcttgggcgtcttgagcatcggttccaggaatgactttcaaggatttagtcatctcagcaatgttcttgatagctgattttagccttgccttctgttcttcgacagcttgcatgagatcggttaacttcttgtgctctagatccagtttagcattgcattcttgaagttgtgccaagagttcaatcttgtgagcttcaagccgatcaacattagatttgatcgggccttcagataactgatcaagcttggctttctcttcatgaacacgctgccgattggtttggattgtagcctcgatgtccttgcgctcccggcgatcggataacctctgcctggctttctccagtttgaattgatgctgctcgaggtagacagctggagtaagagcatcggctaattcgtccgaaagaaaggcttggatatctgcaaatcttgcccggattgagccacagttggtcaccaggttatctagtgatgctcctaaccgatgggagatgtcttcgagtgttttcttcatatcatcagacaggagagctatcgctttactggtggtgtcttcttctgtttcatcgaggtaatctttgatgtcaaaggagaacagatcggctaagacctgcaagagacaatatcatggatgattaaggatcaagatatgattggccgatctcaaatttatgttaataaaccttactggaatagtaggtgcagctaattgttcctcctcttcaacatgatgactgcctgcagtcgatggagtgtggccgcctgattctgcctgcacaagaggggaagaaggaggaggagactgctaaagggataaatattagatataatcagcccaaatcagttaatgagatgataaaagtatcttactgtaggagctggtttaagggttgaagtagctgatctattcctcacagcaattttctttctctatatttattaaaattgtgaggaatcggctataaagtaaatgactgcaaaagtggacagataaagtcgcttacctttgccaattgagctgaagcagaaggggatggaggagattgcttaggtgaagccaatggtgttctttcagtatcgcttatttcggctgcagcttggtcgatgtcttcctcgatttcttcttcatccagagcttgttcaatggatggatctagggcgggtagatcgtcagctggcttagctttctttgtcttagccttattcttcggagccggggctgaagtatctgcagccgatgatctggttctccgcttcttgccggcatcggctggttctctgatgagtcctcggggaagtgctgaggtctttggggcattgtagccaatggcagaaggggatggcccacctccatttggaattagacccggagcatacttaatgaccttgccgctattgctctggtgaggaggagaagattctgttgtctgcaaaacagaagaaaagttagtcaaggttcaaatcggttgattgactattcaagcaagattgaagaaataaagattaacatgagggatagcatcagggaataagtctgtcatgtacatggaagccgattgatggaacagatgcagcttccactcgccccaccatctgtcaaatgtcctgctcctgaaccttgccagctttatgttctcgatgctgcccaacggaggtccagggatgttcaatagctgatccatcattaaagttgaggagatgtcgcctctgcattggatcttgttggcaaagtacagaccgattggcaattgtcccattccaagttgtctggccgatgacatcggatgataaaactcgtaagagacttggatatttctcccttgatggatgccgactgggaggatacatgggctgatagcagtagtaaagatttctctggattgctgaaacttctcatgattaatatcctcgaacctgaaatcggctggcagttcgaaatccattgagtcggcatagaagaaccaaactcgggcatctttttggaatccatcataaaagctgaagaaccagtccttcagaagttcagccgataactttgctcctgcatcggctggtgtagatgcatattctccgtatgacatacatctgcgatgggtgtgttcttctccatcatcttccacaatcggctccaaacttggaaattcagcttctgtcacagatggccgattgacaactttcatgactaccaggttcagctaggattgcaagagccaccatggtccacctgtccaaccactgagccgataattatcttgcccgatgcgttgtttaatatcttgtatagatagccaagaaggttttgcctaagggaaattgtttcttcgttactagggcctcggctagaattgccagttggttgtaggaccgcagcttgatccgcagaaaaggaatttttccaaccacatcagcaaanaagctacgtgctctctaggagtgactggccctttgcccatatatgctgtgatatatcctgaccaacccccaatgctcttagttttgaactcaaaagtgttcttggtgttcaggttcatagggttagctgatgaggttacatctaggccagtgagcatgataatatccagcagcgttggggtcatcggcccttggttgaaaagaaaagcattgagagtgttggaccagaaataagttgcagcagccattaggggttcatctttggccgaatttgctattgtgagggctagggcttggctgattccgatctcatcccaatgggcttgtttgctagccgatatccgcttataccatacaggccagcttttctccaaagaaggccaggatttgaaggtgtttttccaatggcttgtgtttggattggccgacctaaaaggggttctgttggtttcggctatgataaactcagtggggtctagattgccgattggaccgagaaagtattgttggtcatgaaacagactgggaaccgcaacaagattggaaagatgctacaagaatagagaagaagaaaacaagataaggtgagcgaaaaccggtctgatgaacggaaaagggggtctagccgatggggacttacctcagcgtattcggctgatgatgcggcggtcggattggtggaggtcgacatcgtcacgggtgaagatctggccgggagtggaatcgcctagaaatcgccatgcgtgttgaggaggtcgccggagagagaaaggacgggatctgtttaagcggtgaaaacggaaatcacgacgtgaagattctttggggcaacggttagtatttaaagtagagcgataacggacaggaaaacagcaagtgcgagtttctctcagagtcggtatatggcaaatccgaaacattatccaatattccggacttggggggcatgtgttaacgaccaaatttggtaaattctatcactattggcatcggaggtgaagatcagattgaagtgggatccaaaatgaagatcgttgcggaaacagagtaagagtcggctgcagtccaaatcggctaaggtcaagtcggaagagttcgagtcggacgaggctagccgatacagccgattctgataatatgactcggtgtacgtcatcgggttcaagtggatgtgcttcaaaatggtcgccatgcatggatagagtcctgggaaggcaatggtatctat

SEQ ID NO: 39734 - DNA, 4657 bp, Oryza sativa
agtgtttgatactccaccaactaaggtaggtcccgtttataacaccaaatattatccatcagtcttgaagtgattgaagttcaatcattcaactggctactttgaagcagcatgtaaattaaaatggcttaccaaatgggtagggccccttatcttaatatagtctacggggatgatttatcattttgggaattttatgtcacttgtcgagatgcgataaaaccaccttggccttgcatattgtctttcatttttacagagatgatttatatgtaaaaaaaatagtaatacaaaaaacaacaaatagtaaactaaggcttcatagaactaagaacaaacaaaaggcttgaataggctccaagagtgtaatttaaaaatcatcagttgatggtcgagttgacaagaataataatctatatgtctatcaaaactttggaaatggcatggatcaattattcagattgtaaggtagatagatatatattgaagaaaaaataatatatagacaaaattagataaataagtaattgtaataaaaacagagtaagtgggcatatagaagctatgtggtagctagagtatatttgaataaataatggcacattttccccattaaattatatatatcaaccacatatttcgccttccttaataggggtaaagaatgccaagccattaccggtagggatatcaggtcatttaggatgacatgaggagagtgacattgagtagagagagtgggaaaagagcgagaggtgtgatgtattcatctacaaaacactgtaaggactgcataaagaatcaagccattaattatacaaatctacctgcgtaatatataaaattaacatggaaattatattatccaaatatgatatgaaaaacatatgtatgagttgttatgcgtattacctaaatatgaatggagaacatgttttgtttttgaatggaaaacatgttgtatgagttatttacatatagatataatgtaaaagatttacaagtggcagtacaaaatgtttttatgcatgatgaaatcatattattttgctaaatttctttggaaaaccgctattgtttttgcttgcaaccaccaagtagtttctctcagatgtttggtagttagtttgttggtatcaattaaaaaaacaaaaaaaatacatatcttaatagggacatatgttttattttaggctctatggtttaagtaattaagaatggtgtggttttggataaaattctaactaaatcttatatgcgtacttttcaagacaacacatttgttttggctccgagcccaactacaaggatatgatgagaacaaatacttcattcatgttgcatgtcagaatttagagacaacaattatgcaaatattcgttaacttcggatggcgatttaccaatagaattgttgtctaaataagttgtatctactcactattgttgatggttcatcactaaaccattgatcacgccatacaacttcgaaggcaaatgatagacctgtgtgctcatcatcagctgaacacttcctttcatggtttctcttttcctttcggcttattcggctgcctattttggacgcctttaggctctagctagtgtgctccatggtcaaccaacttgcagtgccttttggcctgacctcgtgatcatgaaattcatgattctccaatcatgtcactgggtgcaattagctagaaccatggcatttctatagacttttaccctacctacctagctaccacccccactaattcgatcgtgacatatattcagttactcgtacactgcctagattaagcagagatccatgcatgaacaaattaaagattgttgcatctcaatgtgcttcccagctttgccatgatttgcagtttaagatgtggacacctgacttgactcgatatcaatctggtaatcggatatgtgcatcacttcatgcatgcacaaaattcggctcatttgtttcgatgaaaattggctttcggcgcaccttgattaattccaaagcaatttaagtaaataatcattacaaaggaatatcatcatactagtacccaataggacaaattaacctttttcttttgcagcaccagaagggaatgaatgagtgaaggatcatgaaattattgtcttttcggcctttttgggctagaacatgtaaggaaaagagagtaaagtgtgactcacataaagaccagtaatgatgatgaatctctaacaattaaaaataagatttattataggtcatgaaaattgtacaaagataacagcaggaatatggaactattgcccaacttttttcttctggaataaggatagttcatgccgtcacgcatcaagtgtgcaaaacatctgcacgtattatcaaattccattctttttcaacaaacggaaaaaaagttaatggccatggaattcggattacccgagaaatatatgtggctgatagagcgtgaacataaacagtctttcaatttctagatgaatttctttcataagtgtcaattcagccgagtataaccaaagtcttgattacaccgtttaaccaatgttaatttgacaaagagagatttgagatagtttcactacaatttacaaattcaagtattgtacataaatgtccacaaaataaacaaaagtgtctcacaatgcttactaaggcaacaaagcaaaacaaataggaattattactataaaaaaatgatcaagaaacatgtaaaaacaagacgttttgctaggggaggaaaatgggatagacatgttacatatggctgttgtatctagctccatggatcgtcccaacctttgggcccctctctcttaacaaaatctacaatggcccgaactgcttcttgcaccctattggagagagcatggtttccccattctatttcaactttctccgcgttgcccaatgcgcgacataatctgcagtgaaacatatatagagcattagagcatgatgatatcatatcaaaattgtatctggtatgtttggatttctaatttcacctgtccacaagtgcctccttatcaacgtattccgggacatattcatcccccattgagaaaataacctgcagccaaagcacttgcaagatataaaattcagcagctacagcataatgtcatcgtagcttacctcatttggcaacctttaactctacgaacaaaaagtcttttttttgtagaatgcattatacagtatgccaaagagaagcttctgggatgtttgttatgctcaaatttcgctaatttccttaaggttattgattttcacattctaatgcagattttaaatgtacttcttttcctgatttctattccattagcttgcttaatgtggtcaaaaagcaaatagaaccaaaacagcccactgggaaaattaccccatttacaatctatgcatgtataaattacgaaagcccaatgctcaaagttaggttcaggacccccatcaatatatatgagttcttcggttctttctgtttttgtatcttcacacctttcaattacttaacatgcaagtcaagtactaaacgtaatcaagcctagttttattacattatagcattgaggaaaccaagtctaatatatctatgcatatatggccaccaatgcaaatgcaagcattcaacctacaagctgtaaacagattcaaggaacaacataatttaactacttggtgaattaggcattaagaaaatatcaaatatctgatagtgaaacggttatttttcttagatcgatcagcttgaaattgttgctttaagtagatacagaaacaaaggaccataaaaggataaccatcactaatccctgtattcatagtcatcagaacagaatgataatgaaaatgtgaacgcaatatttaccaccaattctgggctctggctatgaccaaaaaaagtggtgtttccatgtgtgttgacaaagtcacaagtagaaagggacaatacctggcactgtgttgttgacatatgaccaagtctctgcctcaactgatcttcactaagatctgagctgaacatgtcatcatcacccatatatgcacaaagggagtgatacctacacattatttctatggcattagagtacaactgaagaaaaaatgatgtttgattcgttgcagataattttttaagatcacactgactaacaaaggatactaggagatatgctggtaaatagatctaataaaataaaagatatggaacaaaaagaagtaataggatattggatcatttgaaacaatacagaaaggttaactttgcatcatttgaaaagaaaaaaggactaagaccccactaagagttggtcatgagaaacataagtgggagacaaaaacatcaggtttgttacatagtgtttcattcttatcatgtttgttctattcatgtggttcaattttcatcatccatgattttaacttgtatttgcgagtttctttgctcaacataacatagataactctcccatgctacatggtccacagagtctacgagcaagaaattttgtatcattggtcatcatagccgaaggaggcgcaacaagttgtgtcttaggtcatcatcatcacaatctagagaactataagggattctacaaaattctcaagtcccaactaaagtttttcagaacataggtta

SEQ ID NO: 39735 - DNA, 2729 bp, Oryza sativa
atagctcaagcaaccacattctgcatacagtactttcggatggcaagtataaattaagatctcatgactactttggtggtcattggaaaatacaaatgagattctagaactagcttcctgggtatgagtgaatgtgtagtcaaatcatgtaagtaagtcgatcaaagtgcggaatgacaagattgaaaaactgaacatattatgtaaaaaagaatatgaaaattaacttgagaacattaaaatcattcttaagtacctcaattcttctttcagcatgccactaagaccatgaacacctcaatgtatgcaaatgcggttcttaaactctaaggatgaaaaggtccatgttacagatcatacctgctctaagctggaaattccatacccagtgtatgatgaagaaagtaacggctgtaccagtgaccatttctcgacctctagtgcaagtgacaaaggctccaagtagctgtaatgttccaacatggattagaataataaaattagttccagtcttaaccaagagaaaaaaaaatgataacatatgtattatgattatatacttacagaacttattgtgttatttttcctatccttctccaattcatcatttttcagatttttctcatgtttgttactctcaacatataatgaattataacttgaaattttatacatatgccgagtaaataataacaacaactagattatctcatactgatttggtgagagggaagtgattgcatgaatgcatcatgaagtactaaatggtgattatatagtatatatttccatgtttccatgtatgcatcatgctatgcaactcagtacatcagggcagcttccatactgaggagtgacatggctgaagggaaggcactttaggatagggaggagaccacagactaggatgaaagaactttcagggagaaaggcatttcactccatgcttcagaacaactattttatagactaatcaaaacaataacttgactaactaacagtaaagataccaaataacgttgttactgaagcgcttggacagtaccctaattggaaactcatgagaactttcactatcaatagtgtcttctaattcaacaaatgatatggaaaaatatttaatggaactgcatattgccaacttactcggttgctaaaaacccatccgtcaaaccaccgatgaagatcacctggtggttaaaatcaccagttttaaatgcgacctgcaagaagaaatttatagaagaaacaaaacagtaatgacaagccatatctaattagaagttaatatatggatggtgaggctgtgagggtttcctttgtatatgcaaatcatcagaaaatgaagggtgttacagaatgtacacaacataacaaagcatagtgcatagacatctgggcctctgaggtagttaaaacaactaggttaaagaccatgtttggtgcttgaactattctagaagtcctttttcatgctaaactcaataaccagttttttttttcattttttcgccctcgactctcaaaagcaaatcaataacactctagaccatattcacagtgtttttattgacatggtgatggttttcactagtgcagactcctactatacatgtcttgctaatgtggatgccacttaggtccacagttccacaccaacaaagtttagtacctgaaggctatgtcagttgtcatgtcaatcaaaactaccatggaatcagcttttgggtgttatttttctggttttgaaagttgagtgtgagaaatgactgggttttaagttaacggtaaaaaatggaatccaacaagttttgagtgccaaaaatggactttaccttagaattaaaatgataaaacttccaagagatttcaaaattccaaccagattctataatgtgtaaaagggtacatcttaccggcagaataagttatctagaaaccacaatattgcaaccacatcctggcatgatataatgctgatgttctataggcttactaccaactgatcatcttaataaggtcacaaatggcaatgtggcactacgtggtccaaacaaaggaaagaatgcaggtacattgtgacagattatcccattcagagttgagaccctcacttttgtactacaacaaaaggtgtatataaacaaccttgcttgtagcaacaaaggatcataacaaacatagctggcagagatttgtacacttatttcgtcgcaatttcaaagtagaaaacaaatcctctacacgcagcaaaaggaactactatgcaaaagggaccataagcctagatagggtcaaacattgtatattcattcagtaggctttcttccacgcgagaaatgatacagaagcaaggagacaagacgcaaaaggcctagctagccgtgttaacatcagcaaaagaaaactaagagaagaaaattattagcacacaagttgggctcccaaaagtgcaacccctctaaagaaagaatcgcctgcgcttatttccattacaagccctggatcatgagtagaaacacggctatgctacagaagcttccttattccataagcctctatctctctctctctcaacaaccgcacgcacccagcggaaaagggcagaaggacgaatccaacgaggagatccccgcatcgcatctcgaaggctgggcggcacgaacgcggtaaccttctagaagattctagaaccatctcgacctagggaaattcctcctcgtcccccg

SEQ ID NO: 39736 - DNA, 8107 bp, Oryza sativa
tttccagatttccactacatatatggtttccaccacatattttccccacatgttgaggggatattttgctagttggccatatttggcacttccatcctcgctcgatgagtattatcctcgatacttctaccgtcattatccaacatgtaatacaggttttttaccatcgtactaaaaccaaaagtacctttttaaataatataaaatctataaaatgactaatactacctccattttagaatatatgacgccgttgacttttcgcacaaagtttgatcatttgtctcattaaaaattcagtatgaatatgtaaaactataggttaatattatattttatttgatgataaaacaagtggtaacaaaataaattaaatttatatatttttttaaaataagacgaatggtcaaacatcgtgtaaaaagtcaatgacatcctgcattttgaaatggagggagtatatggttagcccaaaagtacaattttggaatatataatattgactaatacatagtccaaatagaaattacatcagtatttctttttgaaaacagaaattacatcagtatattgtcactatggctgcgtttagatccaggggtgtaaagttttggcgtgtcacatcggatatgctgacacacatttgaagtattaaacgtagactaataacaaaacaaattacataatccgcctgtaaactgtgagacaaatttattaagcctaattaatctgtcattagcaaatgtttactgtagcaccacattgtcagatcatgtagcgattaggcttaaagattcgtctcgcaatttacacgcaatatgtgtaattagttattttttcgtttatattcaatacttcatgcatgtgtccaaacattcgatgtgacaaggtaaaaatttttgccacgggatctaaacagggcctatgtaatcttgatgtagtgtagttaatcacaacgtgcttatgagcgcgtaaacttgaaacttaaaattctatctactatatagacataaggaggaagagatggaaatatttttattaaggttacattgaaattggtattgatctattcccatataatgtcaaacatcaatgatataacctacctagtattgataacataacaagggtgttctacattgacatggatgcaatcaagtctcccttgctactttgtacaatctgattttatattccccaggcatgcacatagaacaaaagtacagtacgatagaagatttaaaaaggatgtgcatcaatcatcttgggtaagtatgatgtagtagtaatggattcatgatctattttaatgccctgttgatattatttttcaggcagaataatacatacaggtagactttcttcaaattaagttgacaatacctcaccgtagatgttgatttgttaaaaaaaatcgttttcttttatagaatattcagatcaaacttgataaataaagagacaggaaacactagaatattcagatcaaacttcagtgattgaagtggcaataacaaattcaactttccatcgacaggttcttgtgcttgtgctgatttgtcacatcatcaaaacatcaactcacacaccatctgtttcacaaaactcatcattcacaccaaacacatataagattaaagcaatcaccttccttctattgttgcaactcatcatgataaagcctacaatatttatcaaatatgaaacaaaaaatacagttccctctttcaaataccatgtaatgtaaaagtaaaactcctatatctatactacgaattttaacaacagtagctcaaaaaggatcattcttttttttttaatctcggcaccacaagccaaaaatcaatatacaacaactaatcaacctatgaacataaacaaaaagaaagaaagattacaacaacaaaagaacttatattattcatccagttggtcattggtgtgtgcaatcgaccacacgcccttgaacatcccagctgactgaagtgagaaatccgacacaactctgaacagctccggcaaattcgtcctgagaaggctgagggacttctccctgaccaccctgcactgcttgacatacatctcctcccgctccttcatagaaagctccaacttttccatggcagccttccgttccgccatcggatcggggcgtgcaccgtcagggttcctgtcctcaggaaggatacccgcagtttggtggatgtacttttgtgcccagtcatcgaattgcctcctcttcttcccataatccctcctggtatcctcgatcttcatccggagcttcagttcgtcttcctgatgaaccaggattgtctttacgatctctgcaaacgtgtttatcgccttcttggcagcctcatcggggagctttccgaggatttcatgccaagcatgcagcaccctcttgatgggaggtgtggtctcatgtggctgtgatgaatttggctccaattggtgtcgatggggatcacattcagcttgatccaggtgtagagggatcccacatactgcttctggtatgtcatgaacttgtcgaactgagtgtgccactcatgtacaacattccacagctgcacggtccggtcatggtgttgctcgcttgtttcccgcggggcgaccgagatgtccaacgacttgagctccaagatgatcttgagctgtgttttgtgatgaaggtacattgcatcccacatgtgccacattctgcccatgtaagaaaacaaaacaattaagttctcttgagtctatatctattgttcttttttgtttcgttagcaatgttgttattcatagtagaaggagaaatcattgaaaaaggcttaccccttcacaagttcaagaagttttgggtataattgttgatctttgagacggttgatctctgcaactgttgactccattgtttgcagatcaactacatattttgtgtgcaagtgactaacaaccgacttggtcttctcaagtgaggaagaagtgacaccacgctgcttctttttgttgagaacagctagcttttgttgatattccctcctgataacctcaaaatcctggctcagatgtacaaacataacagtttagatcaagaaacaagtgacaatatggtgttgcttcaatcattttcacatcctaggagtctaaaacatggaagcaactgtcctttcaaaggaaaaaacaacatggataggtaatgaaattggattaaaatggctagaaaggtttacagatcagatgattgcatgaacaaaaaattccacaagaacaggaaaataacttaacaggaagaaagaaaatactccagcaaactagtagcagaggtcgtctttatgtgctgaacaaatcatattgcaaaattattgtcgtaagaaagtgctattgaatttagcaatctataagattgtaccaataaatgagtgggtggttgcaaagatttatattttgaactagtggtaaacaaaaaagaaacaccatgtaccttgacttcatggtatagttttttctcccatgcaagcagcttatcaagagtggtagcatgtgtctcccattcgtcatcgtccatttcattcctcacattttccggttgaggtatccctttaaacgagcgattccaagtgattacttgcatcactctggcagaatggtccacaaatcctagcaagaccgaagagggatgccatttaacaacagaaggaactcaaatatgtaattcctatttttttcgaggaatggttctcaaatcctactaagataggatgcaaatggcatttacgttaacaatggaaggaaaccaaattaacctgagagttctcaaaagaagaaaaaaaagaatgctgagtatgaagaaaataatcacagcgagcactaaaaaacaagcaagacagagactgctcaactgaacttgaaagtgaatcatgagaatacaggtcatcaacaatttaaatgtgaaccccaaacaactcattcccctgtaccctgtgacccatatgtgattagatgctctgtccggttcttcgctttacccgctaaatgcggctccactaccataaccattccattggcccattccaataattaaaacaatgcaatcattctgttgttcttgacagtgcagattagtaatctattcaaagtcttaatacaatcgtgtggaacgggttaacttcttccataatcaccaagtcaccattaataaaacgtatctgaacttctctatccaatcttgctaaagcatattccccgaaacaagtgtactgattattttactcattccaatgagtaatctgaaatggtagataagcagcaagtgttctatctatctagtatcacagtgaaaaattgaaaaagattgtaaagaagatattttattttgctgttggtttgaaagtaatctgaatcgtgaagtgaattcatcgtgttggcttgaaaattgaaattacctcgcgtctcagcgaagttggagtggtagtgcatcctggcggcctcgagcagcttggacacctcgtgcgcgctctgcgacgccttgaggaagtgttcgtccagggcgcggaggatgtcgccgacgcccagcttggccggctgcggctgcggcggcgccaccagcatcaccgccttcgccttccccttcctcgccgccttctgcgtcatcgcccgccgcgtcgtcgccgcctctgccgcggccggcctcttgccctccgccacctctctcgccgccgccgatggctggtgttcgtccggcgcggggggtggtggttctctccgctcggccgacgccgaagacgatggctcggcggcggcggtgtccagagtgggcggcggcatggagtcgaacaaggagctgatgaacccgccgggggtgtccaccttgtggtcattctccggcgggaggggaggcggggagcgggagggaggggggcgctgcgaggggagcggcgggggtggcttcagttcggcgtcgtcgtcacctcgccgtcctcccgcgtcgccgccgtcgccgccctcgtcgtcctcctcctccatgatgggcgcctcgccggacggcttcttcttgatcggctgctgcaggtgcaggtccggcgcgctcatcgacctcgcgagcggcgccgcctcaacgtcgccatgcggaggcagcggcgggggcgggggaggcgggggaagctcgggcggcggcggcggcaggatagccagcacgggcttgccatcggaggacgccgtgacgagcgccgccgccgcggccgaagagtcagccgaccccgaccgcagagccccgccggcgtgggcctcgccctcgccggaggcgtagtcggagagcgcggcgccgacgttcttgagcgcggcggcgtggcccgcgtgcgcgcccgccagcgcgtggcgggcggcgacggcgtcgcgcaggaggtgcttccgctcgcggcaccgcgccacggggccctcgccgtcctcattggactgcgcgcaccccatggggtcgccctcgccggcggctggagtgggggtctctggtcggtggtggtggtgggcgagtgattcgatggaggtgttcgtccgatggatcgaaaggctggcgaatgatccttttgggggaaggggagatggtggtggggggcgggtggttttgtgctttggaataaaggtgggaatgggatgggatcagtggagggccacgtcgttgcgacggtgaagaggaccccggatgtgtcatgtatatgtccacttgtcccacacgtttaccgtgtcagacacacaaatttcatatgaagaaaatttaagttcagttcagttaacctcagttttttttaagtagtatatccatcccataaaaagttcatttttcagtttttaatacaacatttaactcttcgtcttatttaaaacctttcataattaaattttttattattagatgataaaatatgaatagtagtattttatgtgtgacaaatttttttaaataagacagacggttaaacgttagacagagaaactcaaaaataaacttattttgagacagaggtaggactcatctttcttgttttccacgcatacgtttttttcaaactactaaacggtgtgtttttttgcaaaaattttctatacgaaaatagttttaaaaatcatattaatccattttaaaaaatattaataattaattaatcacgtgctaatgagttgctccattttacgtactggagggattagttcccgtcccctaccaaggaaccttaggggtggttggtaagaacaggtataataatagactataagccatctataaacatatttttaggagataagagatgatagagaatagcattggattacagatttgtagctagctgtagcacggactctaaaacgtaatatgtgtatgacatgtgggaccaggtattaatagtgtagtatatgtttatagctaactattgtatgaattagctattaaattgactatagataatttagagctggaaattggctatactattaaatttgctttaacccttctttcctggcaaaaaaaaaaagtagatcattagcacatgattaattaagttaaaaacttgaaaaatagattaatatgatttttaaaataggtttcctatattatttttttaaaaaaacaaatcgtttagcaattcagcctagtcaacctagtcaaaaaaaatattcatctaaaaaatagtttaatatgggactcaaccaagtcaacaaaaaaaattcatctaaaacatactagggtggatggactacgcttgtttatttgtttaagctctttcagacacatggccgaatgcttaaaataatagataagatttctgtacttttattcttaagctgttgtaaagccaatgcttaataaacgaatctgatggagaaaaccttaaattaatttaaaagtaaagtaacataaaaaattggatgtggtttcggtgatataaaaacttcgaggatatagcgaacccatttcctggctccaaccaatgaattgcacctttgattatgtctttcaaagggacttgatcgtaatttaacattttcattagctcctctctaaagcttttctagtatggatccagtcgcttgttcaagcctttcaaatccaatttatggatcttactttatcatgattttataatcatccatatttcaaaaccaacactttgtgtcatgctcgaaagttagtcattctttttcttgctaaggggtgaaagaaccagcgtgataatggtcctgtttgggggtgtttggggagtttataacaattgcacctggtttcagaacctccgagtaatacagattttcattaaagttgtgaaattcgtagcaataggtctatagtgttatgaaacctatcttattatcgacgaattaaattataagtgggaagtttactacagaagaaaacttacgccagaagccagcttacagaggaagccagtttacagcgtaagccggcttacggcacaagccagaaggtccaaggcttacgatgtaagcctccaccctccgcctataaatagggcccataaggtccaaggcgaggacaaccgatcttcggtctcctgcttctcctcttgtagcttgtactcaaatccagaagaaataaagcttccactcgctcatactttttgtgttccacaactctgtgtttggtttgcttgtgtgctgatcagtagaatcgactggtttctcaacacgttatcagcacgagactctaccaagctaaaaaggtaaacatgtgagaaatcagtttctactgatcatcttgctctttatgtgcaaatcattcttctgttatagttgaaataagcagaagaacatggtacctgaagtaccatcccccgatatcctctcagcaatacacgatacatgatggcggctctgccgccgttatcattcaattgctagagttgatacatcctcttagcaacgcccggtaacatgatggcggctctgccgtcgttaccgtccaaaggcttgagatggtacatccccttagcactatttgataacacaatggcggctctgccgccgttatcgtccaaatgctagaggtgatataggtgcctgaagcaccggcatggcaacttaatggacggctctgccgccgttg

SEQ ID NO: 39737 - DNA, 17597 bp, Oryza sativa
  unsure (1)..(17597): unsure at all n locations
actaaatgatgttgcagaacatgtcggacatagtaaagaacgaatcaccgagcttgccttggatggtagtaactacctcacttgggcattggacgttgagattaaactcaactctatgggtctcgatcatactattgtgttgcccgaagttggcactgtggagtctacgaaggccgagaaagaaaaggcattgcatttcttgcaccaccatctccacccaaacctgaaatctgagtatatgaccgagaaagatccactggtattatggcaatccctgaaggatcgctttgaccagcaagggtcaattgtgctcccacaggcacaacatgactggatcaccctacgcttccaagactacaagtctgtggcggcgtataactctgccctccataggatcatttctcagttgtgtttatgtggcctgaagatcacttacactgagatgatcgagaaaaccttatctacctttcatcccaacaacatagtgctgcaacagcaatataggaactcaaagtacccgaagtactatgatcttatctgagtcctgttagttgcagaaaggcagaatgaggttcttctaaagaatcattctgctagacccactgggtctatggcagtgcctgaagcacatgccaatgttgttggaaactcgcgtggccgtaaaagaggccatggtgagaagaaagggaaaggtaagtgaagtatcatattcatgggcaagagcaagggtaaacccagaggtaaaggcgaactcaaaaaggttacaggtgaatcatctggggtaaagcaggataactgctatagatgtggaggcagagggcattggtcccgtaattgccgtgtccccaagcacctggttgagctctaccaacaaagcatgaatgagaaaaagagccaacatgagtcccacttcaccattgagcctgaagctcaaattgaaagcatgatgacatgcttatcaatgttaaggatggtggggacgttcgtatggacgatgattgggacaaccttcttgaaaaaagatgatgacatattcggagacgtgaagtaatctcctatatgtcagtcatatgcagtgttccgcatgactagcacatgtagaactttggtcatgaataatgctcctgaagagcacgcttagtctttaactgggcctaaagtccttgtaatgtttcccttaatagaatcaacttactccatgtttaatttcatttatgtttatgttccataaacagacttgggtgggaatcccatggcagaagaggatatatgtctagtagacagtgccaccactaacacaatcttaagggaaactagatatttccacaccttaaataagaaaactggaaatattatgaccattgccagaagcaatgctcatatagtaggcaccggaagtgctactctagttctccctatgggtacccatatctttgtaaaggatgctctattgtatcctgattcaaagcgtaccctcttaagctttaaagatatccgtgcaaacggtttccatatagaaaccgagattgagcaagatgctgaatatctgctcataacaaaaatagatggatatcaaaagcaagtggtggaaaggctcccttcatcgccattgggtttgtactacacgtacataaaacccactgaggaatatgtcgcgatgaagaccatatttagaaacccagagtcatttagagttcagcatgacagactgggtcatcctgggttgggtatgatgaggaggatcatcaacaattatgctggccacaatgttgaaactaaagacttccctaaccctgaagattttagttgccctgcttgtgcaaaagggaagttgatcactaggccatccctcctgaagattagggatgagtcacctgttttcctggcaaggatacaaggtgacatatgtggacctatccagcccctgtcgggcccgtttaggtatttcatggtactgattgatgcttctaccaggtggagccatgtggacctgttgtccacaaggagccatgctttttcaaagctaattgcccaaatcatcaggctaaaagctagcttccctgatagccgcgtacaatccatttgaatggataatgcttatgagttcaggtcaaaggcttttgatgattattgtttagccatgggcattaaggtagaatattcaggaccacatgtccacactcaaaatggcctagctgagtccttgatcaagaggatcaagttgattgcacggccactgttgcaggattgtaggctgccaaccagttgttggggccatgttgtgttgcatgcagcaacactaatccaactcaggccaactgcatatcatagtacatccccccttcagctagtgcgtggaaaagaaccaagtatttcccatctgcgtaatcccaccaccacagcgtacttctatgggacccaaccggaagttggggatatacgttggttatgagactttgtccataatcaagtatcttgagtctatgactatggatcttcatacggctcggtacgctgattgtatctttgatgaggactattttcccagcatttgggggagaaaggcatccagaagaatgccgagatataatatggaatgcaactggtatgcagtccttagatccacgcgctagtgaagctgaactggaagttcagagaatcataaatttgcaaaatattgcaaataagttgccagatgccatcactgattacaagggagtgacaaggtcgcatatacctgtagtaaatgcaccggaaagagtagaggtaacccagaaggttactgactctgctcttaccccccatcctaggaagagggggagacctccgggtgctcgggacaaggttccgcggagacaaggacctgagccacttgttccactcaaagaatcggttgaagaagctcaacctgaagttgagaaagccccagaagaggcaactcaacctgaagttgagatggtcccagaaggacaccatcctgaagatggagaacccagtgccttacgcgcgcaccttggcactggaagatcggaacactccaactcggtcgttatgggaaatcacgatgagctggaggaaataaatgaggagatttccactaactatgctgatacaggagagtaacatcatagaaagaccactattgtcgacattcactttacctcaaagattgctgtcataatggatttggatccagaaccaaagtccatggctgagtgccagaagcgctcagattgggacaaatggagagcagcaatagaggcagagttgcgctcgctttataaaagagaggtttttgggcctgcagtcccaacacctccaagggtcatccctgtaggatgcaaatgggtcttcctccggaagaggaatggctaggtggtgaggtataaagcgaggctagtggcacaagggttcacgcagaaacccagtattgactatgatgaaacttactctcttgtaatgagtggaatcacgttccgatacttgatctcaatggcaactaatatgaacttggatatgcagttgatggatgtagtgaccgcatacttgtatgggtcactagattcggaaatttatatgagggtccttgaaggactcaagattctgaatctgaaaggaaatcgcaacatgtatagtgttcgcctgcagcgatcattatacggattgaaacaatccggaaggatgtggttcaatcggttaagtaactatctcctgaagagaggttacttaaacaacgatgattgtccctgtgtgtttataaaatccctgaatggattttgtatcatcttggtctatgtcgatgatcttaatatcattggcaccacagaggacattaaagaagcaatggcttatcttaagaccgagtttgagatgaaggacttcgggaaaaccaagttcttcttgggcctgcagctcgagcacctccctgaaggagtgttcatgcaccagtctacctataccaagagggtccttggtaagttcaatatggataaatgtcatccattgaaaacccccatggtggtccgatccctggaagcggataaagacccatttaaacccaagaaagatgatgaggaaatgttgggacctgaagttccctacttaagcgccattggagcactaatgtatctagccaattgcacaagacctgatattgcttttgcagttaatctattggctagatatagtgcaaccccaaccagaagacattgggttggcgtcaaaactatcctcaggtaccttcgaggtactcaagatcttgggttgtggttcccgaagaaccaatatccatccatggtgggatatgtggatgttggctatatgtctgatcctcataatgccagatcccagactgggtttgtatttctttgtggtaatactgccatttcctggcggtctataaagtagaccctagttgcaacgtcaaccaaccactcagaaataattgctctatatgaggccacacgagaatgtgtgtggcttaggcggatgatcggtcacatccagaagtcatgtggtctaaacattgataacacccccaccattatctatgaggataatgctgcttgtgttgcacaaatacatatgggctatgtgaaaagcaatttcacaaagcatattactcccaaattcttttatccccatgagctccagaagagcggggaaataaatgtcctgcaaactaagtcatgcgaaaatctcgcagatttatttacaaagtctctgccagcatcaagcttttacagatgtgttcgtggcatcggcatgagacgacttagtgaattgcaaggatcagggggagcaaacaattagcccatgattgtgatcctgaagaatcacaaacaagtcctgaagacttgatcaactgttgtactctttttcccttggtgaatttttttcccattgggtttttctcacgcaagatttttaacgaggcaacaggtgcaacacaatattcaaagtgccatgtactcttttctcctaccattttttcccattgggtttttgggaggagtttttaatgaggcatgtgcataattcaaattcgtccaagggggagtgttatgaaacctatcttattgtggacgaattaaattatgagtgggaagcttaccacagaagaaagcttacgctagaagctagcttacagaggaagccagcttacagaggaagccagcttacggcacaagccagaaggtccaaggcttacgatgtaagcctccaccctcctccgcctataaatagggcccagaaggtccaaggcgaggacaaccgatcttcggtctcctgcttctcctcttgtagctcgtactcaaatccagaagaaataaagcttccactcgctcatactttatgtgttctacaactctgtgtttggtttgcttgtgtgctgatcagtagaatcgactggtttctcaacttatagaatccagtttttttagatttttataagccggttatcaaccagatactctctaaacaggaccaatatcctatttgaaatggcgattcttttgttaaggggcgcaaagcgatggatagcacctagtctctcctaccaattggttgccacagacttgacaattagggaacaacttaaagctgaaagagttgtaccccctaaaccatggctaatgatgattcagttaaagtgaattatgccccagctttgagccaagtgctgctcctactagaggattcagactacaaatcttgttaagttactgcttaattagtacaaacagctagaacctacaggaaattaaaagaaatcgataaagagccaggacgactctagtcattgctggattcttttgttaggtgctgctttctgctgacctggaacaaaaggattgatgtcctctcttccaatttgtttttttttttcttgtccttcctataattcgtttcttcggaagaaagcaatatggacaattgcaacacgtctccaatcccaacagcactacaaactgtatctggctatgcaatacgaacggtctagtttaggtcgatagtgtgaatggattatggggtgtgctctggggtgtggcaaaattggcgtgttccatcttttggatattggttgtttcggatagacctgttagtttttccttctttttttttcgaactttgggtgtctgaatatttttatttaggtagattttttttggaaaacatgtcgaaaacatttgacgtgtagaacatgattttatcgaacttttaaaattttataaccattaataattttatatatgattagttttcttaagaaaaaaatgagttgctccctgaaataattactgctataaagtagtagattttcgtaagtatccctaaaccatacagacggttcgatcagaagggaaatcgcctgggcgtcggtcaagaaccacctgcaaacatgatctaccacatgttaaaacgatcgaacttttattggataatgctctactctgggtgaccgatgcgggggagccggatcgggcgctccccggcgcgcccctgccccacatgcgtatctactggacccacctacttctccttccttttttcacaaaaaatgtttcatctagtatatttacaatgttcactatttatacatctaatgttgcagggaatttaaatattcttttgcaacaaaaaaacccatatattttagaaactctctattaagggaatttggtttatttttttgttccatcagaaatgttttacctaaggtactcacaatgtttcactatgtatagatctaatgttgcagtgaacgaaacattccattgcaacaaaaaaaacccatatattttggaaaccccctattaagggaatttggtttattttttgttccaccgaaaaatgtttcacctagtgtactcacaatgtttcactatgtatagatctaatgttgcagtgaactgaaacattctttcgctatttgctgaaacattgtttttatataaggtaaaacaacacctgatttaaacgagtgaaacattttcgatctacttagttaaataattccgatatacatggtggaatatcgtgcaacatttaaaaataatttaataataagctaattttttttcgtcagaatatatccatgtgtggtcttgttttgaagatttaattacaataaatttaatggtataatcggatcatgatttgaataagtaatttagaagaaaaatcagtttaaagtagtgttacccgtaaatcggacgccgattttactacaaacggataggtcgcccgagctcgtccacttttatttacacaagcggccgatttcattatccgcctatatttatgttaatcactattattaccccagtgaacggtggaggcaccgaggcccgagaggatcaaggttattttttttattttctgtggttctggtttttgtgtgatgattttttttccgatacgtactaatataagctgttgcacgtaggggctgatttagttttcatgactttgagcatttcgatgatttcttcttagaaaatagatttttcattaattcagtctctatatttataaaagatatacacagccaaaaaaaaaaacatgcacgagttcttatactccaaacctcacacagagcaatacacgcaaaacacaaaagaagaaaagctagaagacttaggggggagtccctatcacatcgaatgtttagatgctaatttagagtattaaatatagattaattacaaaaatcattccaaaatcctggactaattcgcgagacgaatctattgagcctaattaatccatgattagcctatgtgatgttacagtaaacatttgctaattatgtattaattaggcttaaaaaaatcatctcgcaaattagctctcatttatacaattagttttattatttgtctatgtttattacttcaaattagtgtccaaacatctaatgtgataaaaactaaagtttagtctctggatccaaacacccccctaaccctcaaccttcattgatgagttattctattcgtcccagcatgagaggggggaataggagaaacggaactagtcagtgctaattgtcgtcgcaccatctccgcctctatagaactcaaccaccaattgctgccaactgctaagtctgttttctgtcgtcgccattgaaaatccccttatgcggttgctgcatttcgaacggccatagagcaccgggaagccgcttgccaccctaccaccgtcttccgcagactattgaactcaccatagttcctaaagcatcgtggaaccatccaacatgatatacaccttgtcttttctgccatgagcttgctgaaagatgcattgttgtcattcgcacctacctgtaaccagaccttgacgccgacactcacgtgacagttgccacctctaggacgcctccgtcaagagcctccgttgccatcgtccttatctgcatcagtaaagtcaatggccatcgcacaccatcaacccagcctcgtcacggagccatcgacgaccatcgtccactgccctcgcctgaccatggtcagaacgtggcaccgaagctcaccaagttaccgctgcccctaggacaccgccgctaagaacatccaccgccatcgtctcaatctaccgtggccgaaccaaccgtcaaccacaggcgctatgctgctgacccgccatcacaggtgcagggctagcctccaccgttatccgtcatcgccagtgtctgagtaagagaagaaggactagtctcgttactgtccaacactaccatcagcatcctcagcaccgccaaccgccaatgggcaccatcgccccgccattggcgcctccattgccacgctgccaccatcgaaaaaataaaggtatgcagttccattagaaaaaaaaaatcaaaatcacctactcccctggttctacaatttcttacagttttggataataacatggtctcgatgctatattttttctattataatacatacaatttgtatatttattacaatatttttagacaaatctatatacgtcattcaagtgtctttaagataaatatttttaaaattattgatagttaaagttataaagtttaacattaactttatctaaaacatgcagaattataaaactggtggagggagggagtattccgtttgagtgcaacaacgctagacgttcgttccttgagttcaatctccgattggcgcgcgcgggaaaatcacgcgaagccgttaaataacggcctcacagcgccgctcccctccctatcctgcggcccagtgcccaccactcatcacctcccccctctcatcctctcctcctcctccaatggccttctcctccaccgccgccgccgcctccaccgccttcgtctctgggcaccgccgacgcggcggcgcgtgccacctgctgtctcctctttcctcatcgcgttcccgcgcgccgtcgcggcgaggaggtgcggcgaggcggccgcggcgccgaggagggtgggcgcggtgaccgtgcgcgcgcaggcggcggcgggggcggggaagaagagcgtgctgatcgtgaacacgaatggcggcgggcacgccgtgatcgggttctacctcgccaaggacctgctcgccgcgggccacgccgtcaccgtgctcaccgtcggcgacgagggctccgacaagatgaagaagccgcccttctcccgcttctcggtaggtaacattatgggggttcgagggctcacggcggcgatggtgaatgaatggatgcaattaataatgcaggagctgacgagtgccggggcgacgacggtgtggggcgacccggcggacgtcggcgcggcggtcggcggcggcgcctcgttcgacgtcgtcctcgacaacaacggcaaggacctcgacgccgtcaagtacgtcgcctccctcgattattctcccccctcgctccgagcaagcaggcgnnnnnnnnnnnnnnnnnnnnncgttcccgcaggccggtggtggactgggcgaaggcggccggcgtggcgcaattcctcttcgtcagcagcgccggcatctacacgcccagcgacgagccgccgcacgtcgagggggtaaagaaacataacaaccagattcgccggaggattggctcgatgagttgagttcactgactgactttctccggccatgtcggctcgccggcgacgtgcaaatgcaggacgcggtgaaggagagcgcggggcatgtgggcgtggagaagtacatcgcggagcagttcggcagctgggcgtcgttccggccgcagtacatgatcggctccggcaacaacaaggactgcgaggagtggttcttcgacagtaaaatcacccaaatccccccaaccaaattctcccaaatttcaaaccgccccaaacaacattcttcaatttgaagacaaaattgtcaatttttttactgtagtcttttttaaaactatcgaattaagacaaaactgtcgattcttttttctttaacttttgaactatttcgaaatatgaataaaaaattggcaattttttatgtaaattatgaattgtttgaatttgaaaacaaaactttcaaatttttaactgtaagttctgacaaatccaaattatgaggacaaaaccatcaattttttttttgctgtaaactttgaataaatccgatttgtcaaattgtcggtgtaaatttccaagaaatattcgaattgaagtcaagttatttttttggtttcaaattgtttttgcagggattgtgagggggaggccggtgccgatcccggggtcggggatgcaggtgacgaacatatcgcacgtgcgcgacctggcgagcatggtggcgctcgccgtggagagccccggcgcggcggcggggaggatcttcaactgcgtctccgaccgcgccgtcaccttcaacggcctcgtcaagatgtgcgccgccgccgccggcgcccagccggagatcctccactacgaccccgccgccgtcggcgtcgacgccaagaaggccttccccttccgcaacatggttagtactactaaccgttttttattcatgcagcggcacattgctattttgctcgaataaagaaaatgtgatttttttttatctcgggggaatatcggatgaaaactatcggataagcaaggactcatctgtcttataaaaaacccaatcctgaggatgtatttggacaatgtgtatgttcagatatatctttaggattgaattttttttagacgcaggaagtacgtgtgaaaaatagacttagaaaattttttgaatctattcatttcgcaggaaaagaaacaaattttagacgagtagagttcctttttcttacttcaaataaagtcgaggttggaaaacgtggttcattcttgtactgtctctagtaatttctttttatataaatttagaaaaaagaacttttaggcccgattcttaacgggttttcacccgatattttggatgtgaattttatcttgatatcgatgttttttttcccaaaaaggatgtgattttgatatgttaatggttgtgtgaaaattgttagcacttctacgcggagccgagggcggcgaaggaggtgcttggatggaggagctcgacgaacctgccggaggacctcaaggagaggttcgcggagtacgccagcagcggcagagggcagaaggagatgagcttcgacctcgacgacaagatcatcgccgccgcctaacaacacccatctcatctcacctcgtcatggtcaaatacaaatacaaagtgctcggggatctcttcttctcgtgatttattttcttctccctctgtttctttggttcctcttctcataccggaagcatagagaaatgcaaactgaacaattatatatgtaaatgctaggaaaatgctgttacaaataagtgaataagatgagttttcgcttttcgtttttcatttttccatcacatatccaatatgagaatggaactttgcagagtcaatcagattcagcacattttcttggtcttacctcttttttgtctgaatatatagctgagtaattttgtctaactattcgagggtataaaaaatgaattaactattataaagttgaaaaaatggatttgaacagtttcataagaaattcatatatattaagttttcttttccgaaaatcgcatcgtttataagcgctggaaataaatggttgcattccttaagaacagatactcctcaacaagatctgtgttgtgaattgttcaccttgactcgttcttaacaactgaattcaactttgattctgacagaccagaacagacagcaatgctgacaaagaacatcaggatttctttaccccctttctgcaatattcttttggagaccagtgctcacgaacaagccaactcagaaggagcattgcagcacattgatccacaaagccttctttgatttcaggtatttttgcgcacacacaaggggcaacacaccagctgatactgcatggtgtaaaaagaaataaagaaccaagaggactgataatggtagcagcgagaatcaattaaaacttacaattccagcgattctcgacatttccagaactaagattggtcccatctcgacatttccagaactaagattggtcccatcctaggtagtaatatagggcgatcggaactactgaagcatcagggagcacacatacgccgaaatggtcatgtttctgaaaccactagcatggtaaaagagagcatgacccctggccctgatgcttgaggtgcggtcatcttgaacttgggtcgacatggtcgtccccgttgctccagttctcatgccaggtggtgaaacccgttgtaagggcctctcgcacccatgggtaacggctccgctccaccgcctcactgagagtgagccaggtcctcttgcgggtgctctgctcgggccaggaggcaagctcttccttaactcgaagcgcgaacaccgcagctctgcacatcccctcggggcagaacttgtcttgatgcgtcttgctcttgaagtcgtagaagcccaataattgcttatgcacagaaagaatcgcaaataagtagagtttgatggcagaacacatggaagggaataagtgatgttcaataataagccacacgcaagccacaaggactaaggaatcacagaatctatttaaacttggctacacattaaatgtagactatgcaagtacaacctagcgacacaatattcctttgacttagcttgctttcctaaataaacttcctataaaataatccatttataatgcaagattcaggtcaaggtttattggctgcactatgtcgtgtgctcttatgctctgtctagtaccaatagtttcattaaactttcaaacaaacaacttgaccagatgtgcaaatgagcaaaatcagtgtcaacacagtagcagagtagccagcattaagcagttcaggtctggattacaatctaaagtgcgagttagcaacacaagaatcctcccttaacttacaagtgcccttcaaagtttgtgtttactgaaagtccaacaagtgctatttacacaatgaatcttataaaacagtatacaatgatgaggtccaaccagcttgtttgttagtcaagtggcacctaacacttgtcaaatgaccctagttctttaatgcacaaaaaaaaaggcctagtaaagaacaagcagcgttgcatattcatatgctaaagtatgaacatattaacacttaacaaaatggatgctgactctgaatgaacagataaggccggaaattccatagcccagactcagactatgcttaaggatcaattttcaggttaagtgaaggacacagctagttatcagaaggtagtaggtctccataggaaagaagattatatctaattgtctatataaaacacaaaatcgcatgcatacctcaaaaaagacctgaggtcttggacacaaggttgaacaacaaacatatggctataggatataataatggggcttttttctaagagaagatcaaaaagtcaaggtaaaagtgccaaagggtctcaccactaaatctcctcgaactccagcttcttcaatagcttcacgagcagctgcctcttcaacagtttcatcattctcccatcctccctaaagcagtatggcacatcaaacaaaagaccgcatgccacagaatcatgtactatataataaacaaacagatatatttatcccaataactaactagtacacctcgcagacaaggttatcataagattaactctactaatgagtcctgactggctcaaaagtcgactctacggcacctgatttcagtacctacttaatcaaacatttcggagggatattgattatcttgctcatgcccgttatgttagagcattgaggttacaaatcaaggaacatatctttatgtaatggtagatggataacggatattggattatagcctaaataatttcccatcaattactctggaaatctaaagcacaaacagaataacatcacagatgttttcatataccatgttctgagaattgagtgactcttaggcatagatgtttaaaatgttaataccttaggaaataggagaccagatccactctgggagttgatcatgagaacttccacaagtttcttgtgtccatcatcagaagtttcatcattgttatctttatatctaaaaggtatgcacctacatatataagaaacaagtatcagatgaatttaaagcatgacaacattcttctctagggtctttaaccatgttgtcttacagcaaagataagagcagcacgctcacagatacatactaatgtagacagtactgtttaattgagttcataaaatcctgttctgaagtgagtttaagtagaagcttgactatcaagcactattcagatgagtaataactttactaatgttggtaaaatgtttaactgctactccaaataaaatttgacctcaaattttgaaacaaataaattaattctcatatagcttatatcactaacagtaataagcactaatgcaacaacaccagtatttggaacattgtgacaacaggacaaagcagcataaacaacaggtacaaccagctattctcctagttcggtttttagtctccagttaatacaaatatcatttttcgtatttgttaatacaaatatctaactgcacacatgggaacaagaggaccctggggtcatctctatgatcctgaaatccatctccctgtgcccatctcacacatatctatgtttttatcaccactttcttttcttggagaaatcaaataaaaagggagctcttcccttgtccaattttagccaaagggaaccaagttttggcaagcaccctttggaagggttttaattaagggcccaaattaatccccccttgaaacaaaaggcatcccttatcctaaaaaaaaaaacttttagaccctcacaantgagcctagaatccttatccgcgaaaatttccctatcgacgccggcccaccaccgatgccgaatcaatatcaatacaaatctttaccaagattcacctaattgatggcacatcctgggaccaaacagagataccccaacctccctttttttccccacacacaggcacaccccaatcatgtggagccggtaaagaacaaagcacactgagaatcagtaaagaacagaaaacgataagcaggtcgccatcagcaggtgcctacggatgaattaaaggagctaaattttaatggtagccctgctcactgttcattgattaagaccaccccctcccctcctcccataatctagccaccaaatagtcctcctacttcccctccacagcagcagcagcagcaagaggtgaaaatttgattccaatcaagcagcatatcaaaacaaacctaaattacggcaagataaaaataaaagtgatattttttcttggtggtgggggatacgaagatgatgatgatgcaggaggaggagaggaatgggggagtaaaaattggggctttgaggatgtcccacccggccacgagtcgacgcccatgctcgtagcgctgctggtgccgccccgttctcgccaccaaatcgcacatggcttcttcctgtccccgccgccgccgccactaccggaaaccgcctccgccgccgctcgagagggagagagaggggtagggttggtcgccgccggcgacgagcaatgcggcggaaggaggaggaagaaggggagggtgaggggctcgagagatgtgcgtgcgtgcgtgcgcctaagcgccttgcttcgttccttcctgggtctctcgctgttcttgccctttttattttgggaattttttgccctgttttggtcccctttttaccccctttgtgtagcttttttaggactttttctctggtttctatggtttttggctttggtatgtggttttggtttggtaaacattttcaacttcatccctctttccaactcaaggttgttctctgattttgtaatacaatgtgccgtttagttatgaaagtgctttaccgcttccgtctatgtcggttgtgtctttcggtttaactcgtcgacaatatattgtttggaccgatttacggagagcaagaaaacgtacacggtactatgttttaaaggtattgctttacttgaaaaataaactaaataggttgagcgccgttgaaagacgccgacaaatcaagtctcacacgagggggaggaggcaatgctatgtaatgcttcatcgtgaaaggaaaaagaactttacaaataataccttgataaaaatttttgttttcattttcgtcacgttttctgtttaacttggcgacgatgtgctttagcggagcaggcgtgtgtgtttagtatcgtgtgttgcatcatatgaaaaaaaagtaaatgaattggtcgtacataagaaaagagtgaaatacatgactggtccctaaagttgtgtagtggtatcacttaggtccgtgaacttgaaaattacacgtttaggtctgtgaatttggtttaatgtaccacccggtccaaacgtcctttgactgcgtttgatcgctaacgtggcatgccacctaggcaacacttttgctctcagccccctccacatcacaacacgtcgcatatatcttcttatagttatatagtgacaccagaatcccaaaaaaattctcacatcgttcttccatctcattcttctccttgcatgtatagaaaatgcggttctgattagcaattgccattgctctgcactccaaaataaccttatccttgcgcaacgggcacatgattaacaacactttcttccagcgacttcaagacgaggacgagcttggagaatccatgggatgcctagcgcgcaagccgtattgcactgccttccgccgctaatacggccgccttgtgctaccgctaaccccactgcactgcgctgcctcctgccactaatcgcaccgccgaggccaccacagctgctacctctcggcctccttcccctaacctcaccgtcgaaaccctagccgatttagggatattttgagggatttgggttgaaatgcacactggtcatagcaagttatgtgcgaaagtatatgtggagggggctgagcacaaaagtgttgtctacgtggcacgtc

SEQ ID NO: 39738 - DNA, 3230 bp, Oryza sativa
cccccacatcgttcacccatttatcttgtcaacctataatagaaaaaatatataagcattaatataccattatgaagacgaaaagcacatctccgaagtaagaagtaagagataggaacatataaaaattgcaggccacgcaatttcaagtcctacaacatgaccaacaattttgtagcctttgtatggcctaatcaaatcttcggattttgccaatgcaagatcgacatgaaccattaaaaattcatttcctagctcaacacctccaactctgcgtgttggatcacagcttacaatagtggcaagagccacgtttgtattccgatttttccaactttttaagaatactttagttccaacctgaagtgcataatacatccatcaatattatcaatatactttaagaaattcaagtatcataaataatttcacagtaaaatacctccattgaattgtcagtgataaagtccattttgctgcactgttgtttctataaaaaaaaattggatcatggtttgcaatttaaccacaagatagaaagaaagaaagaccaaacagagccaattattgttctccaattcaatcataatactagtgaatcatgcatgttatagtttgaatggactgatatttgtaaacatggtgaataaaaaaacaaccttgtatgcaccaccaactttatgtgcatgtaccatatggctgtcctgattgtcaggtttcttgttctataggggagggcaacaaattagtgctaaaattatatatattaagaaattttactttcaaacttttctatcaaataatttttgaactcaataagaagtgaaaactaaccttggcacaaataatctccatctgtttcccatggtcatttaggccaaaggttcgtttgttctagaataaaagaatacatcacattgtcatgaactatagtaaacattcatagttagttacaaacaataccaaataatataatgctatgtatccatgataaccatataataggatgcaaccatggtgagttcagaataaaaatataaattgaaagacaaggaccttgtgtgcagtagcatgcttggttggtggtgtcttatcctcatcttgagcatggctttgtgaattctgttgtcaaagagagcatatattcccagttacaaaatagtgcaactattcccatgtataaaacaatgaaatttatgtatattaccatcacaatgttttcctgttcaacatgacaaatttcttgcaagggaccgtcaccatacactttctatcacagtggaaaataaaaggacattaagaccagattttattaaactatttagactaaaatgttagcaaggtttaccactgttgaattgtcagttaaaaagtctattgtgttgcattgccgtttctgaaaaaatagagagaatttacagtaaaaaccaacatgctgtgtgtgctattttagttgttgtgtagtgttcaataaacagaaatagcattttgaacttgaaacaattagactaaccttagaagcagtactatacttgtttaggcttggtctaacaagcttgcgggtaaggttctctttgttctgcaatacaattattataactagtaaatcatgtgtgttatagtttcaaagagcttatatctgtagacatggtgacttaaagtgatgaaaaaataaccttgtgtgtacttgtaactttgtgtgcattcaccatatagttgtcctggttgtcaggtttattgttctacagtggaaggtaacaaataaattttacaaatctatatatacatttatatatcgaaattaaactactttcaaacacttattgactatggcattgagtttgaaaggataaagagagaacttaatcaactcaccttgtatgcactagaaatactcttccctggttgcataagctcattatggtccaaatttcctttgcgctgcaatggaataggtcataaaattggcacaaactataatgttccaattatttgtttatgtttgcacaggaagtaatcttcctttgcttcccactgtgattctggcccaaagactgtgtattctagagtaaaagaaggcatatgattataatgaatgctatgtaaataatagtgaatatatatataataatattttaaatgcaaaggcaaggaccttgtaaacagtagaatgcttggttggtggttgcaaattctcatcgtgcacatggctttgtgtattctattgtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacataccctcctttttgaattaggtacgtcatcacaaatagcttttttatttgtagatgctccatctaaacctccctgtaacttcaattaggtaagttagatgcattcattgggtcacacacaagttcatataatttttttaagactcaactcccttaaattcacctgattcttttgtgccttttccaacttggttgccttctcttttaattgtaaaagttcagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctggttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtgggttcttctttgcaggatctttttgtctctatggaacacatgaccaaatcagtaaagtcctaatagtagctatacatgcttgaaatggaaa

SEQ ID NO: 39739 - DNA, 5131 bp, Oryza sativa
attttcctctctcttccctataccatatttccagtctgggtagcctaagctacacagactaccattcctagatatcattccaagaaatttacccaaaattccatcttcttcccctaccgcctgattgagatcattgcattgtaccacaattctaagccctttcggaaggttccaaacatctttcagttttgtcttgccacgtgtttcaggtgctccattttcaactgttcggtgttaaattgcgaagacaaaagtgatccttagtaatcagggatacgagtaataatgtcattatttgttaccattaggactattaaacttagcagttacctcgaacattaatatcaacatcagtatcttcattgccttcatcatcaatatcaacatcgtcattagtgtcttcattgccttctccatcattgatattaaaatcgtcatcagtgtcttcattgccttctccagaatcatcacatacagttttttgttcagatggtgtggcaagctgtggaagggtattttcttcttcagtctgttcctctgacaaatattcctcattgctctgaacaatacgcctttttctactccttgccatatctcttgcacccaaaaaaaacctatctgtcatttatggcatcgaaagtatatcattctcatttcagaagtaggactgtgctgtacatagtttcaaaaagaataatttcagaattgattataccctgagccattttggatttgtttttgaagaacaacagagtactgttgtcccaaaagtaatgctataatatggatctgtttgtcatactcactaattcatttgtccattttataggccaacaatttgaaacaagtaatgggtagaaataacaaaatttaattggctgcaaggtaaaactagatcacatatttattgcttacagttgtgtgaagcctagctgtacgtagaccaggctccttcagctatggacggtcagtgcatctgactccaaacctgaaaatacaacatatcaaattggtaagtattgtagtcctggaagggaattagcctccattgcaatttggcgactcagagaggtagtaagatgtgcagagggaggcagagattccggggcttggaaacattgccgccagccgcgcagcgtggagcagagcgaagtggacagccggtgtcgggaggtataacccgcatcaattgcagtgccccggtcacccggcacatcggctgggggcgtctccggcccgccgcatgccctacatcatccatggggcatgggggtcgcctgctcgtggctgttaatcggcaggaaggtgcggcagcagtgatggctggtacagcagccgacggagcggagcggtggaagatctaggagcgcctgcttggggcggtgggtcagtaaagcgcccggcatcttacctacagatcaacaccgatgaagacgaggaggagaaccgtagaacgacaggagagttcgtaggaaaggggaatcccacaacagaggaaagagatttactcagggagtcaggatagaggaaagagatttttaggggcagttggcttgcttttctcgatggggaaggtgggggcaaaaaaaaaagttggcggcaaaaaaaagaaaacagaaaaaaattgcgggagcaaaaaaaaaaggagggaaagagtggagggagaagaaaataattttcggagaggcataaattgctaaattcaatcgatttggggttgatttgtccgtcaaactagttatttaaattatattagcacaatcaaaaaatcacatgttatttcattgtcgatcttgtccggacagaccgcatgaaaaattatatataattaaataacagtgatttaatttttttagcacgaccaaaaaacaagtgttttttcattgtcggcccggtccggacagactggatgaaattcggacgtaacatattttggttagttatttaatttatctaagcacgactgaaaagacacgtgtttttccattgccaatccggtccggacagaccgcatgaaaaagacatgtaatatatttttgtcctaaaatatagttatttaaaaaatgttagcacgataaaaaacacgtgtttttcgttgtcgacccggtccggacagaccgcatgaatatatatatatatatataattaaataacagtgatttaatattttaggacaaaaataccacgtgttttttcgttgtcgacccggtccagacagaccatatgaaatctggacgtaaaatttgtgttaaaatagtagttagttaatttataacgaccaaaaaaaattgttgacccggtccgaacatacgggatgaaattcggaagtaacatatttttgtcttaaaatagtacttatttaatttatattagaatgaccgaaaagacacgtgtttttccgttgtcgacctggtccggatagactgcatgaaaaagtggcataatatattttaggtcttaaaatatagttaattaaaaatgttagcacgacaaaaaattcatgtgttatttcattgtcgacccggtccggacaaaccgcatggaaaagagatgcaatatatttttggtcttaaaatatagttatttaaaaaatgttagcacgaccaaaaaaatcacgtgttatttcattgtcgacccgttccggatagaccacatgaaaaatatatataattaaataacagtggtttaattttttaggacaacaaaaaccacgtgttttttcattgtcgacacgatccgacagaccgtatgaaatctgtacgtaaaatatttttttgtcttaaaatagtagttagttaatttatcatagcatgacaaaaacatgtgttttttcgttgtcgacccggtccggacagattggatgaaatccggatattcttaaaataagtttttgaatggtttatttttaaaattttaaaataaaaaagttcaaaaaattaaaaaatttctggggcaacagaatttttttcccgttcaaggagaggaaaaagtttttaggaattgacactagagaagaaatgaaacgattatgcatttgctagttctcgaactagagttgtcaatacagtagaagaagctaagtaccactaggctatgtccccctttatttattttttcacgttagctgcaattgagaatgtaaatagacttctcgaggtatttatataagatggaaatttaaattctgttagcacgaccgaaaaggcacatgctatttcgttgtcgacccagtgtggacagaccgcatgaaatttttcattgagacgtaaaatatttttggtcataaaataatagttatttaaattatgtttgcaaaactgataaaccacttgttttttcgttgtcgacctggtctggacaagccgtataaaatcatgatgtaaaataatttttctttaaataattgttatttaatttatgttagcacgaccgaaaaaccacatgttttttcgttgtcgtcttggtccatactgactgatcgcatgatcaaatccagacgtaacatattttgtcctaaaataatagttagtgtggccaaaaatatttatattgaaaaaataagttttcgatcagtttaattttaaaattaaaaataaaaagttcaaaaattctcattatctggccagctaagaaggatagggaaaaaaaattaggaatcgcccctagaaaaaaaataaaaaaaatctaggctggcatatttgttttcctcgttatctagccagctaaggagagggaaaaaattttaagaatcgccactggagaagaaatggaaaaaaaacgcatttgttaggatttgaactacagtcttcgatacggctgaagaagccatgtaccaccaggctatgtccacttcatgttggagttgtccgttcgacttacttattcacgttaggtgccattgacaacgtaaatagtttccattcacaacgtaaatagttttctccaggtatttatataggtggaaatggaataactgaacacaatagatgcaaagattataaacgcccattcctttttctcatcatataaacaatatgatatcctagatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctccatccaaaattactgccataaaaataaagtgctccccaagtgaagatataaacaatataaggaaatcattgataatggacagatagatagtgaaaaaccttcataacctcacctttaattagttaccatgttattgacagttgttccttctatatctcttcgaatccatgtctgaccatcatgtgcactgtcaaatagctccccaagattattgacatggtatggttcgcattccacatcattccattcttcgcccagttcaaatacatctctaggtttcatcttccttacaatagaccaccctggatttaaatggttttcaatgtaaaacacttggtcgacttgatttgcaaatacaaagggctcatgctcaatcttttcaccggtatgaatttatttgagaaattcacaagtgtgcagccaaacatatctattttcactccttttcctttagttacatcgacccattcacatttaaacaacacaactgagaaatttccgtagtagtctaactcaattatattaagtatccttccgtaatacatgatatcaccaaggacagggttagtatcactggcggacgtgtagctcgatgtttttgcagtcacaacaactccactgttttgagtcaccctgtcataacgctttgatatgaacctatacccacgggtattgaatgctctatgtcgttttgctacctcaattggtccacgtgccagccatctaatatcctcatcaatactatcgatacctctttgattctccaactgcaagatctacaccaaaccaaaagatgtattagttgtactcatatttgaaaaagagaaacctaaattttgagacttacatgatctctgaaccaatcagggaattgttcattttgcatgttctca

SEQ ID NO: 39740 - DNA, 1345 bp, Oryza sativa
ctagaggaaacaaagtggattcttgcctactcatgggagtctcaaattgatctggtttgtcatgattcgttgatggtatgttatgcttggtagggaaaccttccaagtatcgcgaacaaaatgccatgcactcatctgccaaatatgattatgcaattgaaccttctggacgcgctttgttgcgaacatacgacttcaatttacctaggtacctgtaatatacatacaaggcacaaaactaataagttagtattgtatcatatgacatatgagaaatattataaattgtatgctaatatatttttagtacctttcaataaagtacatccatcgatagcaaactggcccaacaatcttacattcagtagctaaatggacgactaagtgaaccataacagtgaagaatctaggaggaaatatcatttccattctacacaatgtgattttaattgcttcttccaaacggtcaagctcatcaacatggagaacttttgaacatattcctcgaaagtaagcagataagtcaaacaagacagatgtgacttcattgggaagaatacccctcaaagcaattggcatcaattgttgcattagaacatggcaatcatgtgttttgagcccatgaatttttccttcagcagagttcacacatctagatatgtttgaagaatagccatcaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgagcttggagattatcctttgactttccttctaaatttagaagtgtaccataaatattgcatcacatcaagattatgctgaagaagattgacatcctagtaaggtagtgtgaataaactacttactgccttataagtttttgacttcttaaaatcaccgatagaatttatttcatccaataccggacgcccatagtaagtcataggctctgtactaatctctgtggttccatcaaaagaatttctatcaaaacgaaattcatgattaggtggcaaaaatcgacaatgacccataaaacaagatttcttcccatgtgccaaacgtttggaccatacatttggaccacaaggcgggcatgcaaattctccatgcaccatatgtgaagcaagcattcctaaagctggcaagtcatttatagtccacagtacagctatcctcaaattaaaagtttcatttctaaatgcatcatatgtggaaatgccattggcaaatatgtctcttaaatcttctagaagcgg

SEQ ID NO: 39741 - DNA, 5072 bp, Oryza sativa
  unsure (1)..(5072): unsure at all n locations
tcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcactccatttgttcatggatttcatattgaacaaaagcactagtagagataagtgtgatagttcacatccatcccataaaggcttctttgaatctttcaccaactcataaaatgcttgagcttctaaatttggtccatcagtgtgtgtgtatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggttataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaaatttgatatttcaggttcttgtagataataacaatgacaaggaattgtctcttatgatcatgatgtagcaaaaatagggcaattagaaaaataccagtataaaatcagtgtcagctaattttgtcacaacctaatagacctcctttatacactgaaacaaaagcttttactctgcaaaaatagagaagagttaaatcaatttacagaaaaaacatccagcaatctaatgtcaaagctgtcatctccaagttaaattccttactataaattacctctagttaatctacagatgatgactctagaagcacatgcgtttaaaacctatgttccaaatatccgttcggatgaacaagaaaaatctgcaggtgttattaaactcaatcagatagactcatgatgcaacaaacctgaataattaaaaaaaaagttgacattgacctggatctgacactgacctggatttggggccaaatggggaatcaacctatgagaagtggctaagaaaaggaccgtgcttgccgttgacccgctgtcgtcagcctcggcccgtcgccggcctgccgcggccgatcccctcgcgggctcaccgccgccgctgctgagaacgcgccgctggccgtcggtgtgcgccgtggcagtgatgtgcgagtgcgtgagagaaaatgagatgcggtgtgggaacaagatggggcggcgctctcgtgcgtgttgggtgaggttaagaccggggaaaaaaggggaaaagggggggataaagaaggaacaanaaagtgggagactaaggttgcctgctaaagtgctaatttcacagatcgtattttagttgttatgatataaacacctaaagaaatcatttaataagaaatgtgattagctcagttggttgggttgcgcacattctatccttgagacccaggttcgaatcctctgtttgcatctttgcccccctaatttattcctatcaggtatcagcagctcgctcaattattattattttttaaaaagcatgcttagtccaaaagttttaacaggaaaaaaaagcaactcacttgataatttcttttaaaaaacagttcgctagaggtccgaaatgaaaaataaatatctcactcgattattttaaaaaatacaataagttcgcttattccaaaagtttttacagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgactgtctccacggaagaactagatggctacctcagctctcccggcgtcgactcccgtcaaccaaccgagattctcgactatgacgacttcggctacaactatgacttcaacaacttcgacgaccttgatgaagactacgaagacaactacactcctctctttttggcgtctttatggccgacaacgagacagaagaacaacgtctggcacgcgaggccgatgagctgtgcacatgataggaagccaagcgccgccggttggaacaagagcggcaaacccaagagcaagcccgactgctgcatgagcagcaggagcccgagcgattgacatgggaagctgaggagcgacgacagcgtgctttggaatcagggcatcgagcgtgagctaatcagacaacaagacatcgaaggcacatcagtttttcgcaccccacagcagaatgcggttgcggcgattacaattttggataccctccttgtcgacgggtgatacccgtagaccggatatagagggtattggtgtacgctggtacaaggatccacatagtacgacatcgagcaatcaaaagacaagaattatattggttcaggccccttgacaggtaatagccctaatccagttgatgtgggattatatggtggaaaacacaggttacaaaggaaaggatggaacttgtcagatccgacgagattgtagtcgagctgattcgactagctcttgacgacttggctcctcgcaggctccgacttcgtaggctgtgtgggttatgttggcactgagattcgatgatctatgccctccccggggggtcccttttatatcgcaggtctggtgctctccgagtgggactcgaacataccagacctagcacgatacgtaggtgacccagttcttgtccgagaaggacttttcccatctattgatctcgtgaaaggtttccttagatcataaaggaaatatccgcgtgcgcgtgggtatgccatgtcaatacgtaacgtatatcgaagggtagggggtatgcctgacccgtaaccttgacagtagccccccgacttctgctcaaaaaatgaactcgtgcgaccattcgcgacttcgggtgtcgagaacgttatcattcctggtgcaagaaccgcggagatgatgtgtaatcgagcataccgtttgaaacccaacggtcacgagtgaattttgaactgaagtccaaaaactgccgcgcgtaatggacatataaatttccggcgggaatttctctcagttccttggaattcacaccatcgggggtgcgcctatttaaagggattttgggtgcgcattttgaaatccgccaactccgtcaaacacaccgcctgttagcactcctcgccttctccgctgccgtaaagaactctagcttcgccagctctaggtccatctccggcgatcttctagcaacgatggatctcggcaaatcggcttccaccagcgcaaacctgaagaagctccaggaggatggcgcccttcctggccgtgaaaaggcggagaggaaagcaggaggtactaatcctcagcccatcttaggtcgcatggttgcgatcaaagattatattgtctgcgggtttctccctccaccctccgaattccttctactggttttgaatttctatgggctttctcttctgcacttgaaccccaattccattgctttccttagcgtctttgtgcatctttgcgaggcctacattggggtagagccctttcttaatctgtttcgcttttattacgagttgcgctagatggaacccaatagggtatccggttgcgtcgggttccgacttcgtgatggcatgaagtcgcgttatgtccccttccagtgtccatcttctcgcagcaaatggcggaacaggtggttttaccttgaaatcaaggattcaaatcctgtcctcgttgttcccgaggaacaaccggacaagattccggtctggaccgccaagccccccttgaccccctctctccaatcatttatcgacatcatcgatgatctccaagaacggggcttatcgggatatgaagtcgttgcagacttcgtcggtaggcgaatccagccgctccaaagtcaggcccatccagcttataactattccaggccagacgacgcgacccgggtttctcctcggtgtatctttctcgcattcatttagacatgcttgtactcgcgttcctcttcgacttatcaaaaattgattcctttttgacaggtctgagcagcgaaaccgtggagcggcgtgttggtcaggtgatgatcagcggcccgaccacggtgagcaacatccccacgcccctttgtgaaaagggagcgacggagcgcgacgaagcgatcaatatgagttcattcgatagcgtcccgccttctctgctcgaaatcagcttacgacatgatttagcataggcccttcctttgactgatgtcgtcggaacgctcgcggatcatcaggtggcggcatctctgaaggagaaagtcgtcaaggaggcgtctgacgctgccaccaccagtggtggcgaagctccgaccaaggcgaggaagttctcgtctgtgctcagacatcgccgcaaagcagcgactccctcggtaatttcaccttgtcgctaggttatgtagcaaggaaggtttattctcatactacattggttgtcttgcaggcttccgacgcgtctcctccacctccgcgacgtcagagcattgtgacgatcggcgagaagttagtacacagacttttggattctcgtgtcttctgttcaaatggagttttgattcgtggtcgtttgtagggaggcgcgggcgaaggctgctcgggccaaatctgggggaacgtccagcgcatcccctaccacggtgtcgacagatgtcgcgcccgtggtcgggagtcaagaggtgac

SEQ ID NO: 39742 - DNA, 2361 bp, Oryza sativa
gtgtcacgtcctcgcgtgtgtaaggttgtcgcgccctgaactcgatctgcgtgagatcttggatcagggggcggcaagcgacacgcgtaaggaggtgatggaagaagtcagtgacctgggggagtctgtcctccccctttttgaagagtaggacttcttgtattttttataatttgtaaatcttgaactctggttgccttcgtgcatatatgattaccacccttgttcaatgttgatcttggaagtttttcttgtcgattgtagagatgctgatgacgaggatgtccagcagcgcgggcagcccgagtcactggcgataattccggtactcgaatttgaaccacacgtctcacacgacgtcgaggaccatactcttgatgtggaggtcgagatggcgacagccacctcaagtgagtagcctttttaactccgttgggttagtggtttccagcttgtcttagtggtcgttatgtttagcaggtctcaagaatgcccttgcaacccaagatcgtcgtatccaatattggaagactaaattttaagtggcggaactcgagagaaccatgctagccgtgaagaaagagcaagccgtggaaacgctccgaggccgcgaggtgtggtttgtgtcatatttaaagagttgctgtacctcaatggcctgggtatgcagggagcttcgagtagtccacagcgatcctgaagagtcggcggccgagtacatctcgtggctcaacggggcctgtgcccaactcgatggcatcggcaatcgcattgacgaagccttgaagcaagagtgtcgtcgaacgagccgatatgccggaggacatgtgctagcttgcctgcgagatcaccgcccgcgcctggatttcgaattcctccatgaagggtttgctcgttctcggaggacttcggcggagatagaccaccttgcgaggtcgatgtcgccgttagccgagaaggtattccagtctatgaactggcattggccctcttggtagtactcgtggcctgctacagatgtcttaggaaaaagtgtaatgtagtgggagatctatgtaaaaaacagtaagaattattatgtgaataaagaaatattccttaaacaaatgcatcttactctggatgttatgtgttagagtgtgttatcagttaacgacctcggccgtttgagtcgtacactctccctagcccctagccttgtcgtcggagaaattttctcggatgataaggctcttggacacttgatctgccttggttgaataagctctgatcctagcccccagccgtgaagttggaaagctcggtttccagttacacggcttggttaatacgcacggcgagaactcttacatgaccagatcttacatggtctttcgtctctgaaggatctgacaaggccttatcggctttgggcgtccccagccgaagatcccttaggttccttggaggccttgtcgagacggcgtaaagggtcctaaggataggtttcaacgctaggtattatcagagtaagggatcatcgggtgaaaacactttggtcgtggtatgaagcctagaaataggctttattgatactgtaagggtgcttacaggtacggcgttattgactcatacatagaatttacgtagttggtcaatgttccacaaatttgctaattcgcggccgtcgccgtctgcgattttgaatgcacctggccgcaagacttgtgtgattgtgtagggtccttcccattttggtgagagtttgtttcgtcctgcttggctttgaactcgtcggaggacatagtcgccgatcgaaagtatgcgtgctcggatgcgcttctcgtgataacggcagagggcttgttgataactagctgctcggacggcaactcgctcacgatgctcctcgagaaggtttacatcgatgtctcgctgttcctcctggttctcgtcgaaatgcttctgtactcgtgtactttgatgtcgtaactcgctagggagcatggcctcagagccatacacgaggaagaagggtgtttccttgttggatgttgtcggtgtggtgcgtacgacccatagtactgatgggagttcttcaacccattttttgtcatgtgacatgagtttgtcgtagacgcgggtttttatcccttgtagtactatgccgtttgccctttcgacttgtccattgctttgagggtgagagaccgaggcgaaacatattttgactcccaaaccgatgcagtaatcctggaagtcggcgctgatgaattgagagccgttgtcagttatgatgcggtgcggtagtccgtatctgcagaatatccctcttcgaacttaatggcgttgtcggccttgatttccccagtgggtagtgct
